United States Patent 7,745,391 (HUMAN THROMBOSPONDIN POLYPEPTIDE) - sequence listing, part 71

SEQ ID NO: 253152 - DNA, 453 bp, Homo sapiens
ataattaactgtcattaagttaacttggtatttatttgaatattatgtattttgcattaaattatattttaaaattacataataaatcactgtgttgtacattattaaccacacaattgtataatcaaggtattaatgtattatatattagtaagtattaacatgtattcataaaaacattctatattagttgtagatttatgtactctgagaatgcttctttcctctgtatatatgagataattagtcttgaattatgttagttttgaattatttagttttttaggaacatatacctcatatttcatgtagctgccctatatatgttttccctatgtggagtatttctataattcaccagtcatttaaactatgttacagaatagttttgattaatatttttactttagtctataaaaagtataataaataatgtagtgctcttacaatgtg

SEQ ID NO: 253153 - DNA, 377 bp, Homo sapiens
tctgcaccccagctccaagcacaaggcattacaagaaggtccagtggttcctactttagactacacaacaaaagaaatgaaaacccagcccaccgaggcttggcccctgtggggatttccttcccctgctccatcagccagacaaggcacctgcatcgtgggtccttcattccatgtgaatggaaaccccggtccctggcagaagtattcatgctttggttgcatttaaattgctgttctctgggccattttcatccccttcttttccagcctccagcctctcatttctggggctcccagccctccctctctaatgcacccttttgtgttgctgcaaattgccttcagttccatcaaagcagactgccagctttcca

SEQ ID NO: 253154 - DNA, 273 bp, Homo sapiens
ttctttcccgtcaccataaccaccatcttgaatttgatttttattattttcgtacatttctttttacttttaccatgtaagtttttgtccctaagtgatatatagtatcagtttgcatgttcttaaaccttaggtcaatgtatcacactgttcttttttttttttttccagtggagactcactctgtcacccaggctggagtgcggaggttgcagtgagctgagatcacaccactgcactccatcctgggcgacagagcgagaccccgtctca

SEQ ID NO: 253155 - DNA, 410 bp, Homo sapiens
ataaaaaggaataaactgttgatacattcaaaaacctggatgaatattgggaagaatatgcggagtaaaaacagccagtctcaaacggtcgcaaaaaaccaaggcataattccacatatatagaacatttgtgaaatgacaaaattataaaatggaagacacattttttttccattatttaagaaggaatggggtcgtgtctataaaaggtcagcatgagggatccttgtggtgatggaaatgttgtatatcttgaatatattaatgttaatatcctggttgtaataccatatcagtttttcaaaatgttaccactgaggaagactggcttaagggaagactgatctctctgtactatttcttacaactatatgcttatctcaatcgcaaaataaaaattgtaattaatc

SEQ ID NO: 253156 - DNA, 488 bp, Homo sapiens
ttttaaatccaggctcttgtaaaatgagactagcagagccattcccaagttctcaggatggggagatggtagtcagagttaaaatatcacccaaatagtttaaaaactcaagagaagggcttaagagataagacattttttatgatcccaatacaactgcatctaacagatactgcatcttttctctggaagagaacattatagagctgaaacccttgccttttaacctgtctttgtaatgaaggcaagaatgaagttgtggatttgtaggagtccttttttcctatggtgcccagtatgttttcccacccactgcagtacagcaattagggttgttcttgagctcttaaagacccagtggacttgaacgggagcatttcttccagaaagggcctgtcctgcttactgtcatttcaggaaaaatgcagagaaatcagcactacctcctaagcctgccttcctaatggctttccctgatgaaataggag

SEQ ID NO: 253157 - DNA, 218 bp, Homo sapiens
accccacctttagggcctgagagaccaagtgcaaggaggggccgcactggccatttagagacattctcttccattatttctataagtggggacagaagaccagagagctaaagtgaattgtttaatgtcacccacctgtttctgtagaaaacaaccttggagttcagtaatagcacattggagcgtctatactttggaatgctcaggatacactaagt

SEQ ID NO: 253158 - DNA, 484 bp, Homo sapiens
gatcgcttgagtccaggagttctgggctgtagtgcgctatgccgatcgggtgtccgcactaagttcggcatcaatatggtgacctcccgggagcgggggaccaccaggttgcctcggcctcccaaagtgctgggatcacaggcgtgagccaccgcgcccggcctttattttatttttagtacagatggggtttcaccatcttggccaggctggtcttgaactcctgacctcgtgatccacctggctcaccctcaccaaatgctggaattacaggttgagccaccgtgcccagcggaaaacattctttagaaaaaagcagagtgagtttatctggtattttctgtctcatatttttttgttactatctttcggaggagctatcaggaatctgaagaaaataaaaatatccttttaaattttttcttacttcaacttgacaatgtttcttatctattttcctgatgaaatgtatggaaatattgat

SEQ ID NO: 253159 - DNA, 208 bp, Homo sapiens
tgcgataggacccaagatcctttccattatggctagatgctctctgttgtcatgggtctggaagacaagaaagcagaaatatttttaccggggtcgcctggattgggatgagaacacatcagctgggcgctatgttcgtgagaactgcaaaccgctgcgggtcagacagaaaagaataaactacctttgaagagcttacattttaatg

SEQ ID NO: 253160 - DNA, 894 bp, Homo sapiens
cgataggaaaatctgaagaaagactgggccatagctttcatacagttaaggtactttagacattgaaggtctgtaaatcattaaactattctggtagtagtagtcaaaatacacatgtataacaggcagaccccaaatgttaacatatttgacaggcctgtaagttaattgctttttaatgtcagtcaaatggattccactttggtttcttggccaggcttctatgggcccattaaaaccccatgaagctgaaaacatgaaacttaatatttgtaaaacatgtaaacagaatagcctttttctgccttaccgtgtggttaagaaattaggactaggatatttcagtttggtatctttctcagaatccaattagagtaagaatttattttattatcttttcaatattgttaataatctagtaacacatttttcacttaagagttttattttcataccaaatcaaaagaaaaaaaaattctatattgctttatgtttagagatgtgcatttggtcagacagtctaacttagtgtattcgtttggtcaggctgccataacaaaatgcctcataccacagagcgggaggcttaaacaacagagactggaagtccgaggttaaggtgttggcagttttggtttcttctgaggcctctcttcttttcttgcagatggccgccttctcactgtgtcctcacgtggtcacccctcagtccatgtgtcgtctgtgtcttaatctctaattataagggcaccagtcatattggattagggcccatccatttgacttcatttcttcttaattacctcttaaaaggccgtaagtccaaatccggtcacattctgaggtcctgagagttaggacttcagtatacaaattttggagagacgcaattca

SEQ ID NO: 253161 - DNA, 767 bp, Homo sapiens
ccaataatttcgccaggagctggccctgcccaaaccctctgcctcactaccaggagaaggtgctaaagctggccttgctgcccagcgcgcccctgagccaggacctcataagggatttccaaaccctgataaaggacagaactgccttacccctccaccatctctccaaggcacaagcaagcaaatccccagcaaggaagaggaagagaagacctggacacttctagaagggcttccagaggggacgatcgtgatacccagagccccaggctccagtgttctcaatcaatgctccttcagcaagaggccctggggtagcaaaaggactctggcttctgcagaacagcctctccaccatcctcccagcctcaagccacctctgtaccccaggctattggagattcaactgaaaaaaaaaaaaaaaaaaaaaaaaaaaaaaaaaaaaaaaaaaaaaaaaaaaaaaaacaaagaaaaaaaaaaaaaaaagaaaaaacaaaaaaacaaaaaaaaaaaaaagagagagagggggggggggcgcccgagcgcccaacctgtaccaggggagagcgaaaccacaccacgcaacaaagtatgaataaaagaagaggaggcaaaaagaaggggggacacagaaacaacaacagagggcgggggccgcgccccacaaacaagcgcgggacggaggagacaaaagacggaaaggaggaactaagaaaaaaacgcacaacacagcggggcgggaagcacagagaggggagaccagaact

SEQ ID NO: 253162 - DNA, 612 bp, Homo sapiens
caaggtaagttcttttctggcttgggctaatgggaagttgaatatgggatggaaagtctgtcttgtatcatgactccattgagctgccctataaaggagcagaggagggagaaaaggtctatattattgagtaatacggcaaatactcttttggaatatgtggatatcaactaagatttagaattgcaacggagggccacggtgccagtgaccagcagggcaaaattaggaaccaacaaagaaaaaatattttgtctctctcccaacttcttttccataatagaaatgtatagaaatagttaaaatggataggaagaattcagcatgtgcaaccctaaggaattctttctggtatttgtaatattcttaactcaacttcagcctcagtggaacaaaatgttgagtctttttggaagtctagctgttaagtgattctaagacatttgtaccaggcagaagtttttctctgttgggcacgttacgttttcttttttagtgtatatgtgtgcttcaaatgcataactctgggatcttccaaggagatcccctggtgcaggggtgaggtgagcactgcagtgtgtggttcctggcacctggtttctgctctcttgt

SEQ ID NO: 253163 - DNA, 461 bp, Homo sapiens
atctctgggtcttaactgatagctgcaaacactccatcatttaggtaaagtgtatattatgtccctttaaattcatttccttgtgtttgtctaaattgaaaatcatctgacacttttccacatgctcataaagcttcatgggtttttcctgaagtttaaccatgcttgctaccattatattatgtggaaaagcctaatatcctcctaaagtaggaaacttgacttccaagtcatatatcaatcattcagtcagttggcccagcccagctttccctctaatgatgagtctgtttgttccatcagccaaggccattaagcctgtaggtgttgagctgcagctctgcacaggtcctgtgctcagtgctgtgagggcctccctgccagctactgcacccttgcctccagagtgaattttctgctctaattgggcagattgtattactcctctgtactcacagaat

SEQ ID NO: 253164 - DNA, 441 bp, Homo sapiens
cactgaatggtaagagtcagaccaggcagcatcacccactggctgtgtgtccttacataggttgttaaacttcttgaaggctcattgtaccccagggctgttgggggtaatccctgagatacaaattacaaaccccctccagtcagtcagtcagtcagtcaacaaacagtaccacccaatggcaagagtcaggccaggcagcatcgcccactgcctgtgtctccttacataggtggttaaacttcttaaaagctcattgtaccccagggctgttgggggtgatccctgggattagtaaggtctcataatgggatgctgctgagctcctcacagaggaaaggaattacagggagaaggaggtgagcattcttggagagctcctacaataggcatggcatgtttgtgaggcctccctgccaagaagagagcgcatactccatg

SEQ ID NO: 253165 - DNA, 2659 bp, Homo sapiens
ccctgagaggccgtgctcgggctcgcctgctcagctcactccgaaagcctctgctcagacctgcacccagtcacagcagcacagatgtgcaggaggagaccatttccacggaccctccgactcctaggaggcagtcccttagggactggccctaacaacaaatgaggagaagccaagttctctgctttctgcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtaagtccctgcagtgaaaaccgagacggtcttttgcctgccacagccccgggcagactctgctctcaccgtggtgccgacatcccaagttttcagactcaccaggacccagtgacagcatctgggtcctcagagctgcatgcggactgtccccagttcagagcattggacagagctgggaactgacagccctgatcaatagtcccaagaggaaggccagccctcctcctcctcggaatcctgggtttctaggaggcagaaaggttttctgagaaacaaggcttttggaaggaaggtggtgcctggctgcatccagaaagtgagagctaaatggagaggctgaacaaaggacgcatgtggagcgcatggggagggaaggctggggtgcagggctccgggcctgctcttctgcgtccaccccggatcctgcttttgtccagatgggcctcggagcaccagtcacttactccaagaagtcgtttcctgtggccaataatgaagatgacgcactcggaagcttgtgggctctgaggagggggtaaggatgcaggggccatgcattcatcccagcacaggcagcgcatggctccggaagcagacacaggccaggcctgggccaggagtctgccaggagccaggagcgcctacacctccctggaggcccacacttctctccccagaagctcacacgcagcgtctgaggtgcagggcccaggtgtgctggggtgacaaagccccgagctgtggtgatgggagggaggaagcgccggtttatgtctgttctttgggctgatttgctgtctctgtctttgtctctaatgtcctttgcaccactgaccttgaggagccttttgttcctcctgtcccagtttggtttccatgggaacctgagtggcagcgtcatcactttgctgaggtgaaatgcccctggatgccatgaatacctaggggaaaacctgccagagaagaataaaccatccaagagacggcgctgcagggcctcacagtctgcttccatttcctctcaggtttcagatcccttagttttgggtgcccaagttcacggagggtgccggggaatagaagctctgtcagtctcgtctggatcttggtcctcagcaactgtctggatcctgacaggtgtgtgataattacttagtgaattcatgggtgtgggccgtgatagaattaagtgatttgatgtcctctcgataaatccaggtaacgacatagggttttttgagtttgaccctctcctgaaatttgccatctgacaaaatgacatcatggcagagttgtaaactgctgtggatgtattttatttaatttctcaaattaaaataaaaggtaacggtacacttaagagtggtcactacagccaagctaattgacacccactgaactttctggaatgggccataggatgctggacaataggacagatttggaatgagcagtcttccattccaactttagtttctgcaaagctgttgagagcatggagccaggctgcggggtctgggttcaaatcctgactctaccacttaggagctgtgtgtacatgggcaggacaactggcctgcctgagtctcagtgtaggtgtctgtaaaatggaatgataatagcttccatctcacagattcactgtgtgggtaaaatgatagatatgaaatgctaagaacagcacctgtacgtagtatgtcctacatatcttactgttatcattagcatattttgtttattccaagatacattttttttggcccatttgatatctatgaaatctaaagattttttttcctgtcttgggagatagaataatgatgtgccttacaatggattgtgttttagattcactgaaattcattattgttgtttttatccctggtctgtaacatgatatttggtaaataacaaggactccatacgttttgcaaagagtaaattctctccctccctactgaggccttggtctaggtctctccaggcctttccttcctggagccacagtgcttagagacaggccactggggtcagcatttgagctcagctatgatcagaaaaaagcaccgttgaggttgcagtgagccgagatcacgccactgcactccagcctgggcgacagagagagactccatctcaaaacaaaaacaaacaaacaaacagaaagcaccgtcgagaaatggctccagcgctgactagcggccacctcatttccccccttgaccactgggccagttgggtggctaggttgcctcattttgcatccttctgtatccccaaatctgaaataaaagctggaaaaaaa

SEQ ID NO: 253166 - DNA, 2627 bp, Homo sapiens
ccagatccaagtacaactgaaaccctaacagtagaaatcatcattgctggcccagcgctgccaccactgcttctgttcatagcctgttttgtttgtttttagtcccttagggactggccctaacaacaaatgaggagaagccaagttctctgctttctgcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtaagtccctgcagtgaaaaccgagacggtcttttgcctgccacagccccgggcagactctgctctcaccgtggtgccgacatcccaagttttcagactcaccaggacccagtgacagcatctgggtcctcagagctgcatgcggactgtccccagttcagagcattggacagagctgggaactgacagccctgatcaatagtcccaagaggaaggccagccctcctcctcctcggaatcctgggtttctaggaggcagaaaggttttctgagaaacaaggcttttggaaggaaggtggtgcctggctgcatccagaaagtgagagctaaatggagaggctgaacaaaggacgcatgtggagcgcatggggagggaaggctggggtgcagggctccgggcctgctcttctgcgtccaccccggatcctgcttttgtccagatgggcctcggagcaccagtcacttactccaagaagtcgtttcctgtggccaataatgaagatgacgcactcggaagcttgtgggctctgaggagggggtaaggatgcaggggccatgcattcatcccagcacaggcagcgcatggctccggaagcagacacaggccaggcctgggccaggagtctgccaggagccaggagcgcctacacctccctggaggcccacacttctctccccagaagctcacacgcagcgtctgaggtgcagggcccaggtgtgctggggtgacaaagccccgagctgtggtgatgggagggaggaagcgccggtttatgtctgttctttgggctgatttgctgtctctgtctttgtctctaatgtcctttgcaccactgaccttgaggagccttttgttcctcctgtcccagtttggtttccatgggaacctgagtggcagcgtcatcactttgctgaggtgaaatgcccctggatgccatgaatacctaggggaaaacctgccagagaagaataaaccatccaagagacggcgctgcagggcctcacagtctgcttccatttcctctcaggtttcagatcccttagttttgggtgcccaagttcacggagggtgccggggaatagaagctctgtcagtctcgtctggatcttggtcctcagcaactgtctggatcctgacaggtgtgtgataattacttagtgaattcatgggtgtgggccgtgatagaattaagtgatttgatgtcctctcgataaatccaggtaacgacatagggttttttgagtttgaccctctcctgaaatttgccatctgacaaaatgacatcatggcagagttgtaaactgctgtggatgtattttatttaatttctcaaattaaaataaaaggtaacggtacacttaagagtggtcactacagccaagctaattgacacccactgaactttctggaatgggccataggatgctggacaataggacagatttggaatgagcagtcttccattccaactttagtttctgcaaagctgttgagagcatggagccaggctgcggggtctgggttcaaatcctgactctaccacttaggagctgtgtgtacatgggcaggacaactggcctgcctgagtctcagtgtaggtgtctgtaaaatggaatgataatagcttccatctcacagattcactgtgtgggtaaaatgatagatatgaaatgctaagaacagcacctgtacgtagtatgtcctacatatcttactgttatcattagcatattttgtttattccaagatacattttttttggcccatttgatatctatgaaatctaaagattttttttcctgtcttgggagatagaataatgatgtgccttacaatggattgtgttttagattcactgaaattcattattgttgtttttatccctggtctgtaacatgatatttggtaaataacaaggactccatacgttttgcaaagagtaaattctctccctccctactgaggccttggtctaggtctctccaggcctttccttcctggagccacagtgcttagagacaggccactggggtcagcatttgagctcagctatgatcagaaaaaagcaccgttgaggttgcagtgagccgagatcacgccactgcactccagcctgggcgacagagagagactccatctcaaaacaaaaacaaacaaacaaacagaaagcaccgtcgagaaatggctccagcgctgactagcggccacctcatttccccccttgaccactgggccagttgggtggctaggttgcctcattttgcatccttctgtatccccaaatctgaaataaaagctggaaaaaaa

SEQ ID NO: 253167 - DNA, 430 bp, Homo sapiens
caacacctcttttgccttgttaaagtcattttggataattgctctttagttcgtcctgtgtgcacagaacacctaaaaatgaaaagattcatttaggcaatgatgtgggaaaagaatgtgtttaacttcatgtcttaacaacctatggcaactccacttctcctttaaaaggaaaaataccttacttacttttgaggagtaacatttctcaaaactttttttttctccctcacacatcaggatttggtgggggctggagggttctgacactttaattacagtgaaaacacttcaagtatactgaaaaagaaaggttcttggctgggcacggtggctcacacctgtaatctcagcacttggaggggccaaggctgtgaatccctgggcaacatggtgaaaccccatctacaaaaaatactaaaaaacattt

SEQ ID NO: 253168 - DNA, 562 bp, Homo sapiens
aagcagttaatacagactcatatttcattcattaagtcaacaaaaattaacttagtccctacaatgaacgaggtatcccctcatatgctcaagtgcctgacactccagaagcttcacaagaccgaggtggagacactggagtgttttaagtggagaaatgacacactccgactcacaggagcagggccactgtgaaaagaacagttacgttgcaggtcatgggacagtgctagtgtcacaattcatgagtgacagtatggtgggaactaaggggagaggagggcctgaaggatgagaaggatggagggaagggctggagaagcaggaggtgaggaaaaggagcagaggaaagaatttgaaagcagcagaattcttaggtttaaaaacattgttttatggattttaatacatcaatctacagagcctagcagggtgtccttggcagttgtcttttaatacctcatgtgggtctgccttaaaactattttttatgttaatcaggttgaaaaattactaagtgtacctatcaaatatacactacacttagaagtggatacttcct

SEQ ID NO: 253169 - DNA, 339 bp, Homo sapiens
gtttcattttccttttctggggtccagtgctcccagcatgtgtcttgcttgctgaatatacttcaagcaagagaaaacagtcctaagcctcctccaccggaccgagcgcttctgtgttcactctgctctctatgcagccttcacagccagaggcagatggggacctgtctctcagcacagaataagcccatagcaggggctcaagtcacatggaatctgttcttactcagccttcattgagcgtcctcaagaaaatcaagaaatggtgccctcagttctccagcagagggagggagggaaagaggagattttctcaaaatattgcacctccatcccctg

SEQ ID NO: 253170 - DNA, 399 bp, Homo sapiens
acatgttgactgttagtattatttcagcatcctccttgagcagcttggctttgctctgggacaatgcaccagcctgggatgctcagagatgcaggcacggaggttgtgcagcctctccgcacactgcgcatgcgcggctgccggttcaagtcgcggtccaggaccgcaaggaggcgggcaagcgaaactgagaaaaacccacccacggtccagggactgggggctcgggcgaacccacccagggacctcctgaccaaggccatttgtctgcaacctgatggctagaagtgataccaccctgagcatcttcaatcccctttccccactctacagccccttgtactgtccctccttcctcattcacacccctgatccaaactcaagcactgaatttgtccc

SEQ ID NO: 253171 - DNA, 549 bp, Homo sapiens
gtctcactctgttgcctaggctggagtgcagtggtgcaatcacagctcactacaatctccatctcccaggctcaagtgatcctcctccctcagcctcctgagtagctgggactacaggcatgtaccaccatgcccagctaattttgtaaaaaatttttattagagaagaggtctcgccacaatccctgggctggtcttgaactcttgagctgaagtgattctcctgcttcagcctcccaaaatgctgggattacaggtgtgagccactgcacctggcctttgtttactttcactgctgaataagaaacccatttacaatgccaaaccatgataacaaaattgatcctgttatggcaaatgtcattgccctggcctacagactattcattgcaaactacatttaataataaacatttgcagaaccaccaagaatggaaaaactatgagtgccatttcccattcaaaggtctacaggaaactgaatgggagacccacacagtgtaggagggtctccgctgttgaacttggtggagtgtatacttagcatat

SEQ ID NO: 253172 - DNA, 432 bp, Homo sapiens
agaaaagcagactttgactcaacagaagaagaaattggatcataacgcaatctactgcatggtgatgaagaagattaagaatgattccataacggtcagtacagtatttcacattcactgaccttttgtgtaatttgatatgctccttcaggaagtcagccatgctaaaccatcattcaagaatgagtgtgaaatcaagacatttcagcaatgcaattctaaggaagtttaccatctggagacccattgaaaatccacagaggtgtgggacacaagaaacaatcgtgagcaggcaagtgggaaatttagttaatttacttttcaaaagcttacattatataaaaagtaaaataaaatctctacataataaaaaaaacaacttaaaaatggagagaagtccaacaagggtctcactctgttgcccaggctgga

SEQ ID NO: 253173 - DNA, 259 bp, Homo sapiens
cgagtagctgtgactacaggcgttcaccaccactcctggctaatgtttttggcttttagtagagaccaggtctcactacattgtccaggctagtcttgaactcctgacctcaagtgattctcgagcctcagcctcccaaagtgctgggattacaggcatgagccattgtaacagactgtactatttttcacatcccacatttcccttgaagttcctaaagatactaaggggcctcagccgtatttcttagtttatctat

SEQ ID NO: 253174 - DNA, 513 bp, Homo sapiens
tctggctattggctttgtttttccacatgtaatcttgctttttgtggcctggggattggctgtgtgatcagcattgaaatgggttgttgcagtttgaagtctggaaggggtatgtccctgggttctaattctttccctctaggtttctgtactcagctcagagtctagaatggtagcttttaggattggaaaagaccaaagttacctaattcaactctttcatttttttttcagtggaaaaactaatacccagaaaagggaagagagttaacccaaaaattacatctagtgaattgtctgattagctttacaattgaggcattgtagagctctttgaggcattagtcttggttgtctgagtgcctggctattaaaggctgtctttgcctgttccctctttctgttagctgcctggaagtgcagggttgcttcacttttagcaccttgactctgtacctgacatggtgcttcaacaggatattgctttgttaccacaggccctttgaacttgga

SEQ ID NO: 253175 - DNA, 886 bp, Homo sapiens
gatcccttgttcactagaaacaaggagccccctgtcaccttcttttaaaacagatctttctgtctctgtcttcatttctctattcatcccccttcattcaatcctgtagcaactggcagtgacaagtggtgcccaggacagggacatgagcaaagaaggtctgctggagcagagaaagtgaaactgaccagatgagcaagaaaccttgggacaagtctgctggcagctaatataagcacataccaaggttaccagcactcggggaagcaaggacggaagaagaaaagaggatgctctttctccctcatgtaccccaggtatctgctagaaagagaagagaactagggacacctgccaccctcttcctaggttctgtggatggaaagagaccaaatactttagcatccaatactcagctgtacaagtggatatcccagaatgaccttcttggtcatccaaaaactaaatcttttatgactcatggtgaaaccagtggcatctatgaggcaatctaccatgggatccctatggtgggcattcctttgtttgcagatcaacctgataacattgctcacatgaaggccctcaatgtggacatcaggaccatgtcaagtacagatttgctcaatgcactgaagacagtcattaatgaccctgtctacaaagagaatgctatgaagttatcaataattcgccatgatttgccaattaagcccctggatcaagcagcttctggattgagtttgtcatgcagcacaaaggagccaagcaccttcgggttgcagcccacgacctcacctggttccaataccacaacttgcatgtgattaggttcctgctggcctatgtgtcaactgtgatcttcatcatcacaagatgttgcctg

SEQ ID NO: 253176 - DNA, 253 bp, Homo sapiens
ttttttttaactctttaatgaaatggaaaaatgataacctgaaaagtgacaatatcaggacataatatattataaccttcaaaaaataactgtatagggggaataaaaacctagaaggaaacatactaaagtgttaatgatgatttttctccaagtggtagaactataggaaaataattactgtgttcatttaaaacacagattatgtaaagcaagtattaataatcagaaattttatatatagattatattt

SEQ ID NO: 253177 - DNA, 221 bp, Homo sapiens
ccttgccccaagttatcacggagcccagagaaaccaggcctgggctgtgcttcctccataaagcagctgacatgtttccaactgttaatacttctcctaccgaggttctgaaaggggtctgttctcagcctttggaaacatcttcagaaagataaggatgattgtggttgttgaaaataaacacgcccccccccccccgcccccgtagttctaaagaagaa

SEQ ID NO: 253178 - DNA, 697 bp, Homo sapiens
tgcattttgtgttattgtactagaatgaaataatcttaatctgaaaagttttgatggttaaactctttaatatttttgtattcctgactattttcttcatttagctaagtttacactgaagtccttaattacccttctccttttatgataaaaataacatccttcattatctataattttccagtggcttccacatgccaaaaacgtcaactacacaatttttctcttatagtcagaacactggcttgtggaaatgaagcacttcattcgaaatttcaccagtaaatgttgttgatgtgtgatctctagcttacagaatagatggaactgcattcttacatttaaacaattatcctctgattaaataaattcaaatacatctaaggaatagaataattatcagttttaaatattagttagacaagtttaacaagatgcccaatgcgttgcagtacataatcctttttgtgaagtttttttttttttttttttaaagacgaattcttgctcttgtcatccaggctggagtgtaatggcgcgatcttggctcactctgcctcccagattcaaacgattctcctgcctcggcctcccgaacagctgggattacaggcgcccaccaccatgcctggctttttttccgacttctcagtatccaacgttatttgcactgtagcccagttctgccacgctttct

SEQ ID NO: 253179 - DNA, 496 bp, Homo sapiens
tatgccatcccccacatactcaagggagggagggaaaagaatgggctgggagctaccccggggtggggaaggggaagcggccaatgcattccattcccacggcattcagtgtgcagttgcagttgccaaccacccctggaaatgcagacttgcctcaccagccccttggaaaacatgccaggtcgcaggcagccccttgaggccaggtctctagtaaagcttgcctctggatggctgcagatggaaaggacttggttcttagcacccaggaagaatctctctcaattgattatttacttattaaggcaacgaggatccaagcagacatggattcatgcagggcttgtgccagcctgcagcctccagctctctccaggaaccagacctctctcatcccgcttctggaacagcgctgctacagatgcaataaacatttacggtgcatctactatgtgccagacactcgcaccagattaatctcattacatctccataa

SEQ ID NO: 253180 - DNA, 485 bp, Homo sapiens
ttaaattgaatttaaaaatgtgagtttactttgggttttcattttgactggctgaatctttaaatgttcggtgtattatttatactttgtagctttgctataacataactgatctataatagagaatttggtatatgttctatctatgactacattcaaagggttacgtaactataatatctttctaatatttctaccatttttcttacacatttacccaagaatttttctcaaacaactacctaagaatattcatcatgaatgcttggtgtatagtttatgatttgtagagttgctctgatatgaccaaccccttataatacagaatttggtgtaaggtaagttccaggattcaattcaagggatgttacaaacataacatcattctagaacttcttaatattgttcttaagcatttccccaaggatattagtataatgaaatgccagtaaatttataacaataaagcatctaaataatgaaac

SEQ ID NO: 253181 - DNA, 408 bp, Homo sapiens
tgtcgttgttgctagtgtttatctccacactcccacccagttttcttcttgggattccacttattcgacagctaattatggagtccctcctccctctcactctgttctagaccctggagttcagcagtaaacctgacatgttggccctgccctcggagcttgctccctgcccctgcctttccccagggctgtctcaccctctctatgcttcccctgtgctgcccacaccggaccccacctgtgggcattctaggctccgatgaagtagggaaaagacactccccatggctctggatttatgatgtaagccaaacgtggatactgagccagacacggagcagtgactttccattttcctacgacacctcaataccaatgttttattaaattgaaaggactaaaaacaac

SEQ ID NO: 253182 - DNA, 3984 bp, Homo sapiens
  misc_feature (59)..(59): n is a, c, g, or t
  misc_feature (62)..(62): n is a, c, g, or t
  misc_feature (291)..(291): n is a, c, g, or t
  misc_feature (437)..(437): n is a, c, g, or t
  misc_feature (2248)..(2249): n is a, c, g, or t
ggaaaaggcgccttgggagcgggcgctcggcggggcctcctcgggccccgggcgcgcgnggngagtgggagcgagcgcgccaggaccacgcaggcgccctgctccggctggccctcggccggcgcgcggcgcgggagcagcccgcagcccgcctcccgcgcccccggcagccccctggcagcccgcagccgcccgtccggagcagcccctcggcagcccgcgcaggccgccggcccgggagagcgcgcggcggcggcggcggcgggacggccccgagcgcgccctcccgcntgcggccactcgcagccggcgctggccgggccggcgcgccccgcaggcggctagagcagcggcctcggcctcggcgcgggcttgccccgggccgtagcccgcgagaggcggcgcgggcggccgagggcactgaacggcgtcgcggnacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatgggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccggaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcnnaatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggcttggactaagtgatctccaaggtcctttccaactctaaaattctgcaatttgttaacatttcattttgtttaggttgaggacatacattcaaactaattttatcacaaggaaaacgtcaatacccacttccttgacagagttactctttcagaagctaaataaagtatataacttattagatgttatatagatacagggggactttgaatttcacatcttaaagcagttgagctactttgaatttaagcagtcgtactaatcttaaattgcatagcatttgttttgatcgaatttactgctcaagtatggaataatttttaatgtcttaatgattggtgctgctaacttgcgtgatttcagaagactgtacgaattgggggattggtttttaccctagacttcactcttaaaaagcaagctgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgctt

SEQ ID NO: 253183 - DNA, 5810 bp, Homo sapiens
  misc_feature (59)..(59): n is a, c, g, or t
  misc_feature (62)..(62): n is a, c, g, or t
  misc_feature (291)..(291): n is a, c, g, or t
  misc_feature (437)..(437): n is a, c, g, or t
ggaaaaggcgccttgggagcgggcgctcggcggggcctcctcgggccccgggcgcgcgnggngagtgggagcgagcgcgccaggaccacgcaggcgccctgctccggctggccctcggccggcgcgcggcgcgggagcagcccgcagcccgcctcccgcgcccccggcagccccctggcagcccgcagccgcccgtccggagcagcccctcggcagcccgcgcaggccgccggcccgggagagcgcgcggcggcggcggcggcgggacggccccgagcgcgccctcccgcntgcggccactcgcagccggcgctggccgggccggcgcgccccgcaggcggctagagcagcggcctcggcctcggcgcgggcttgccccgggccgtagcccgcgagaggcggcgcgggcggccgagggcactgaacggcgtcgcggnacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatgggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccggaagtccataattaccagcctcaatatcatcctaatatccatcccagccagccccggtggcatcctcactctccaaatgtcagctacccgctcccttccccagtgcttagcagctcggaccggttgccttttggcattgaggagaatgggggcacaccgttcctcaccgcagcttcaggaaggcatcaccaccagcaccagcatcagcatcagcaccagcaccactcaaactacagcctctcactgaccctggagaacaaagaggggcctctgaggtccccaaactccagcagcaagtcccttacaaaactgagtccaggaacacctgccttgttcagtgaagccgctgcccatctaaagaagctggaactggaaactgtgaaggctgctggaccctggcctcctctgcacatcaacataaacaaggctgaagaaaagaaagtctcggagaaaactcttcagactccacttttgccttcccctgttgcggatcatgtgaagtgtaacattctgaaagcccagttggaaaatgcttcccgagtgaacatccagggtggaaaggaggaatcaccgtttgtaaatatcaataagaaatccagtcttcaggacgctagtgtaagaagtcctattcctattcgtgtggaaactgcccagccagctgtggaaaagccggaaatcaagcctccccgagtgaggaagttaacaagacagtatagttttgatgaagacgacctccctccagacctggccgaggcagtgggagtgaccacatctacaaccacaaacaccacaacggctgccacacaagtctccgtgccgctgccgtcccccaaggtccagaatgtcagctcgcctcacaagtcagaaggcaaaggcctgctgtcccctggggccaagagcccctctgaccgaggaggtgcctttaccctggagccgggtgatcttctgatggatttcacagaagccactcctctggcagagcccgccagcaacccccactgtgcccactctcgctgttctcctccactctctctccccatgaaggaagagaccactggagtttgcatgtaccctccaatcaaaacgaggctgataaaaacattcccggttgatacaatgaccccgtttcctgatactttcaccacagggccacagtttactgcagacttcagagacagtaaattacagtgctgtcctggcccgacttccccgctgatcccagcagcgaccctgaggcctttgacagagaccgtctccacagtgcagaccatttacaccaccccggaaacctgtttctctggcagccagtgcagagacactccggcaggaactggagagagagaagatgatgaaaagactgttgatgaccagactgtgaaattctccccttgtcacctggaagatggcatggtgccttctgtccatcttctttcttcgggctttgtgtgctcactctagcacagcatacaagtgtgtgctttgttcgcccaggtctccatggttagttgaagccaatttctggcttgacttttatgggaaaagttattttatgtctcctaagcattagagtttttctattactctatgtagttgagacaggatttgataagtctaggaaaagaaagatgggaaaacgggattccttttcagaagtacctgtgtgtatctgttaataaccacaggggttaatatgatgtaggatctttactatcaatttcaaccatttgattttgtatgattgaaacttgcaccgagctttgactgtttgttaaagagtcatttttaatgaaagaataattctttattgctggtttttcatttacactgataaatacacagatcttataaagtctttaacattcatttgtattcagatgtgagtagaagaactaaaaaaagaaagttacatatcactatgactgaaggtacttcagcttaatctgaaatataatttaacttgtgaactccttggatatgatattatttggaataaacagaatttatcattgaacccaaagtaggaaatgatagcttacattgtctaaaaatccttacaaggttaagatgattcaatatcaagaatattcagaaaattatttctaaagttgatcgattcatgtcgtattgatagaatcttgaccagaagaaattttgctctttttatatagtttcaagaaatgtgtttttaaatttttattaatgcacttgaacaactttgcaggaataaagcaaccccctaaccacaaaatatccctctaaattagttccctagctttctcaatgaatacacacatatttttacatagctatgatcgttgtgtacattctcctttgttttacttctcggcctaacacttgtctcctcttgtcaacacagattctgctctcaccaatttaaatgtctttatatccatgtaacatgggtaacctcacttcaccccattattagatatttgagttatatctaatttttcactcttataaatagtgctgctatgaatgtctgtaaaaaaaaaaaactgctccttcttttggattattcccttaggaatatctccaaagagggattacaaggtcaaagagcatgaagtattttatagctcttgttttatattgccagattgctttctagaaagatccaatctttgggttggaaggaccttaaaggtcatctagtttagcctccccaccccctctgaatgcttgaatcccctcgacaatttatgatgccaccagcaatgtataagcatttctgtttaccaatagctctgccagtattgggttttgccatttttatttatttttgctagtttaataggtatgtatagttgttcttgaagagttgttttatttcattaattgctagcaaggctgagcacttttccatgtgatgatttactagttgtatttccttgtgtgtaaaatgttcattcatttcttatgaccacttgttaagaggaactgatctcatatatttgtatcagaactgtatttttatgttatattgtatagtttgctctcctgcccctctccttaaaactgaatggtgccaataatttgatactaatgactacaaaaaaaggtaatgcctcatttactagtattgttgtaaaatgaggaatgtatgtgaatattcagataaccgaggattaaccctttaagtgctgaatctttaaaattttaatatatttttttttgagggaaatctttctaaaatgtattacgcacttccctgccttagtaaacagagtatactggagagtatttaaccttttcttgatgagtcatggtcatgattataaacatcagccccttttataccttggtacggtgcagtgatatcattaagagctatcaatatgtgtagggcttggcttggccttttataggatattatgctgttctcactgatggttttttactgctctctgctctgtcagtggagctatccggggcaattgtagcgtttgggtccttttacccctatgtcccccggctatacttttaaaacagctttagctgttctttatcttgtgcacatgatacaaaatatgttcccgtacaatatggggctgtcacttcttgccaacccagcaccctcttcctcttctaacctgctttctgaggcttctgctcttcacctcctgctcgctgatggaaacctccagggcaaagctgaaggtttcttggggaagccaggaaagccagtatttcctatgtgtcagatctgcttggcttccaagaagggatgcatgggctttttggccagtgtttccaggaggctctgggcttcctgcttcttccccgcttcccccagagttcacagatgttgaagtttctgaaggttgacgtcactggaagtctgaccacaaacaagttggctgttactgtatttgaaacccagtacctttggcagctcacctctaaccagtaaaataagaggattccatggtttctttttttttt

SEQ ID NO: 253184 - DNA, 980 bp, Homo sapiens
ttccttttctcctctgttggaaaccatagaacctgtcaacatactagatgttaaagatgactgtggcctccaactaagggtcagcgaggacacctgcccactgaatgttcattcttatgacccccaaggagaaggcagggtggatcctgatctgtccaagcctaaaaaccttgctcctttacaagagagtcaggagtcttacacaactgggactcccaaagcaacatcttctcaccagggccttggaagcactttgcctagaaggggaaccaggaatgccatagttccgagagaaacttctgttagtaaaacacacaggtcagcagacagggccaaaggaaaggagaaaaagaaaaaggaagcagaggaagaggatgaggaactctccaactttgcttacctcttggcctctaaacttagcctctcaccaagggagcatcccctcagtcctcaccatgcctcaggaggtcagggcagccagagagcatcccacctgctccctgctggagcaaaaggccccagcaaacttccatatcctgttgccaagtctgggaagcgagctctagctggaggtccagcccctactgaaaagacaccccactcaggagctcaacttggggtccccagggagaaacccctagctctgggagtagttcgaccctcacagcctcgtaaaaggcggtgtgacagttttgtcacgggcagaaggaagaaacgacgtcgtagccagtagggagcagcgggaccatctgaccccacttgccagtccctaaaggtgggtgccccagagtagattccacccctgctgcccaccaatggagaatcccaatgttgaatctcatcccaatgttgttttgttgttctgcaaaagtggcaagcatggagagagaggtcagactggctaggctgcagggggaattacctttggaaggagctatatagaaaaaaaatgaataaagtgttttgttggaaaatgctct

SEQ ID NO: 253185 - DNA, 924 bp, Homo sapiens
ttccttttctcctctgttggaaaccatagaacctgtcaacatactagatgttaaagatgactgtggcctccaactaagggtcagcgaggacacctgcccactgaatgttcattcttatgacccccaaggagaaggcagggtggatcctgatctgtccaagcctaaaaaccttgctcctttacaagagagtcaggagtcttacacaactgggactcccaaagcaacatcttctcaccagggccttggaagcactttgcctagaaggggaaccaggaatgccatagttccgagagaaacttctgttagtaaaacacacaggtcagcagacagggccaaaggaaaggagaaaaagaaaaaggaagcagaggaagaggatgaggaactctccaactttgcttacctcttggcctctaaacttagcctctcaccaagggagcatcccctcagtcctcaccatgcctcaggaggtcagggcagccagagagcatcccacctgctccctgctggagcaaaaggccccagcaaacttccatatcctgttgccaagtctgggaagcgagctctagctggaggtccagcccctacctctgggagtagttcgaccctcacagcctcgtaaaaggcggtgtgacagttttgtcacgggcagaaggaagaaacgacgtcgtagccagtagggagcagcgggaccatctgaccccacttgccagtccctaaaggtgggtgccccagagtagattccacccctgctgcccaccaatggagaatcccaatgttgaatctcatcccaatgttgttttgttgttctgcaaaagtggcaagcatggagagagaggtcagactggctaggctgcagggggaattacctttggaaggagctatatagaaaaaaaatgaataaagtgttttgttggaaaatgctct

SEQ ID NO: 253186 - DNA, 1250 bp, Homo sapiens
  misc_feature (28)..(28): n is a, c, g, or t
aaatgcaggctgtacggtctgggagtanggatctcctactgagccggccgcagaaattgcagccgctcagcttctaccccctcctgcctttccttcctctttccttacttccttcccttccctcggcttcccgctcttgcctcactctcagcggctgccttcgcccctgtctgcagacagcgccgctggatgctcccagctggacttcaaccccactcctctcagtccctctccccactgccttccagacgcgcctcttccccgccccgcgcccctctctcctctcccacccctgcccctctccgcggcgctcaccctcctcagtcccagtttctgaaaggactcagctgagaaaggacaactgggttccgctttccttaaccctacaccctttagctggatgctgtcagaggcgatggagaaacgcaaaggctactagacgcaacaatagaattaccatattgtttttcctggtttgaaaggaccagatggaaagaaactgggcaagccaatgaaagtctctggggatcatgggaattgagtgtctatgaaaaccatattccagacaagaatatagtctaaggacacagcaagaggcaacattttggaagcagagggcaactctcactggaaaccaaatctcctggcaccttgatcttggattttacagcctccagaactgatagctgggaggcattacatagtcatgtgcgaggtcaaaactgagtcaccaccacaaccaagttccagctggcaagaagaggaaaaataacacagaggagttatgaccagtgttgtaaggatctggcctagaaatggcatgcatctcttccactaatatcctattggtaaaaatgtagtcacatgggcacaccacctatctgcatggaaggctgggaaatgttgatcggtagggcagccatatgtgtaggaaggagaaaacagaatttggtggatacctagtagtctctgccatacccttgaccagaaatttttcttctaaagaatttaattctaaaagttatagacattcccaaagatatacctgcaagcatcacagctttgtgtataattgcaaaagttgaaatcaacatgaatgcccaaaatagtgaattatttaaacagattattacccatattatgaagaaatactctgcaactcttaaaaataaatgtaatgtgccaggcgcaatgggatatgcctgcaggcccagctacacgggaggccaaggcaggaggatcacttgaaa

SEQ ID NO: 253187 - DNA, 1007 bp, Homo sapiens
  misc_feature (28)..(28): n is a, c, g, or t
aaatgcaggctgtacggtctgggagtanggatctcctactgagccggccgcagaaattgcagccgctcagcttctaccccctcctgcctttccttcctctttccttacttccttcccttccctcggcttcccgctcttgcctcactctcagcggctgccttcgcccctgtctgcagacagcgccgctggatgctcccagctggacttcaaccccactcctctcagtccgctcaccctcctcagtcccagtttctgaaaggactcagctgagaaaggacaactgggttccgctttccttaaccctacaccctttagctggatgctgtcagaggcgatggagaaacgcaaaggctactagacgcaacaatagaattaccatattgtttttcctggtttgaaaggaccagatggaaagaaactgggcaagccaatgaaagtctctggggatcatgggaattgagtgtctatgaaaaccatattccagacaagaatatagtctaaggtttatgggactccccagtactctccatgtagagtctaatgtagaatccaggagtgcacagaaaagtcactggatgacacagcaagaggcaacattttggaagcagagggcaactctcactggaaaccaaatctcctggcaccttgatcttggattttacagcctccagaactttctcacacttccttttgaaagctattaaaaatctatggcagaaaaatggtcaaggaataggaactacaacttcataaatgaggaaccagaaaaggtaaaaaaaaaaaaaaaaactgaacagataatcaaatttcacagtaattcgttttcaaataaaaaatatacagattaaaatatgatttccccattgttgactagaatgcataaaaatggggccaagcatggtggctcatgcctgcaatcccagcacgttgggggtccaaggtgggagaatcacttgagcccaggagttcaagaccagcctgggcaatatgagcaagaaacataaatt

SEQ ID NO: 253188 - DNA, 1325 bp, Homo sapiens
  misc_feature (28)..(28): n is a, c, g, or t
aaatgcaggctgtacggtctgggagtanggatctcctactgagccggccgcagaaattgcagccgctcagcttctaccccctcctgcctttccttcctctttccttacttccttcccttccctcggcttcccgctcttgcctcactctcagcggctgccttcgcccctgtctgcagacagcgccgctggatgctcccagctggacttcaaccccactcctctcagtccctctccccactgccttccagacgcgcctcttccccgccccgcgcccctctctcctctcccacccctgcccctctccgcggcgctcaccctcctcagtcccagtttctgaaaggactcagctgagaaaggacaactgggttccgctttccttaaccctacaccctttagctggatgctgtcagaggcgatggagaaacgcaaaggctactagacgcaacaatagaattaccatattgtttttcctggtttgaaaggaccagatggaaagaaactgggcaagccaatgaaagtctctggggatcatgggaattgagtgtctatgaaaaccatattccagacaagaatatagtctaaggtttatgggactccccagtactctccatgtagagtctaatgtagaatccaggagtgcacagaaaagtcactggatgacacagcaagaggcaacattttggaagcagagggcaactctcactggaaaccaaatctcctggcaccttgatcttggattttacagcctccagaactgatagctgggaggcattacatagtcatgtgcgaggtcaaaactgagtcaccaccacaaccaagttccagctggcaagaagaggaaaaataacacagaggagttatgaccagtgttgtaaggatctggcctagaaatggcatgcatctcttccactaatatcctattggtaaaaatgtagtcacatgggcacaccacctatctgcatggaaggctgggaaatgttgatcggtagggcagccatatgtgtaggaaggagaaaacagaatttggtggatacctagtagtctctgccatacccttgaccagaaatttttcttctaaagaatttaattctaaaagttatagacattcccaaagatatacctgcaagcatcacagctttgtgtataattgcaaaagttgaaatcaacatgaatgcccaaaatagtgaattatttaaacagattattacccatattatgaagaaatactctgcaactcttaaaaataaatgtaatgtgccaggcgcaatgggatatgcctgcaggcccagctacacgggaggccaaggcaggaggatcacttgaaa

SEQ ID NO: 253189 - DNA, 1013 bp, Homo sapiens
  misc_feature (28)..(28): n is a, c, g, or t
aaatgcaggctgtacggtctgggagtanggatctcctactgagccggccgcagaaattgcagccgctcagcttctaccccctcctgcctttccttcctctttccttacttccttcccttccctcggcttcccgctcttgcctcactctcagcggctgccttcgcccctgtctgcagacagcgccgctggatgctcccagctggacttcaaccccactcctctcagtccctctccccactgccttccagacgcgcctcttccccgccccgcgcccctctctcctctcccacccctgcccctctccgcggcgctcaccctcctcagtcccagtttctgaaaggactcagctgagaaaggacaactgggttccgctttccttaaccctacaccctttagctggatgctgtcagaggcgatggagaaacgcaaaggctactagacgcaacaatagaattaccatattgtttttcctggtttgaaaggaccagatggaaagaaactgggcaagccaatgaaagtctctggggatcatgggaattgagtgtctatgaaaaccatattccagacaagaatatagtctaaggacacagcaagaggcaacattttggaagcagagggcaactctcactggaaaccaaatctcctggcaccttgatcttggattttacagcctccagaactttctcacacttccttttgaaagctattaaaaatctatggcagaaaaatggtcaaggaataggaactacaacttcataaatgaggaaccagaaaaggtaaaaaaaaaaaaaaaaactgaacagataatcaaatttcacagtaattcgttttcaaataaaaaatatacagattaaaatatgatttccccattgttgactagaatgcataaaaatggggccaagcatggtggctcatgcctgcaatcccagcacgttgggggtccaaggtgggagaatcacttgagcccaggagttcaagaccagcctgggcaatatgagcaagaaacataaatt

SEQ ID NO: 253190 - DNA, 572 bp, Homo sapiens
gttggttgtgtgctaagatgagaaaggctgggagagtgacctggtttgggaagaaaaaagtaaagttttaatttagggcatgttatgattgagatgcctgtgagccacatgaagctattaaatgtgcagtgagatatatgaatctgaagacagactcaccagactataaatggtgtattagtttcacatatgctgtaacaaattaccacaaaattagggtctttaaaacaacacaaattggccaggcgcggtggctcacgcctgtaatcctagcactttgggaggccgaggcgggcggatcacaaggtgaggagatcgagaccatcctggctaacatggtgaaaccccatctcaagaaaaaagaaaaatactgtgaggcaaaacaaatcattcatggttagtcaatttatatttattttacaaagaacagtaaatgttccatctggcagtactaaaatgcctcgtacttaccagtaactcaaaggttatactacctaaactgagcgcaagctggccatatgagtaaactgaaaaatagaacaatgttacctaaggccaggtttatagacaag

SEQ ID NO: 253191 - DNA, 493 bp, Homo sapiens
tgagttggagtctcgctctgttgcccaggctggagtgcagtagctcgatctcggctcactgcaagctccgtctcccgggttcacgccattctcctgcctcagcctcctgattagctgggactacaggcgcacaccaccatgcccggctaattttctgtatttttgtggagacggggtttcaccgtgttagccaggatggtctcaatctcctgatctcgtgatccgcccgcctcggcctcccaaagtgctgggattacaggcgtgagccaccgtgcccggcccactcaggatcatttttatctataaggctcacatgcgaaaaggatatgttttaggcaaatgctttataataaacaactctgagaattttctaggacctgagctttcatgaacactgatggtgataatttgtgatgacttggcagacacagagatttgacatttccataaaatcaaatctgagctttattgtggtaagaactgacattgtggg

SEQ ID NO: 253192 - DNA, 501 bp, Homo sapiens
gaacacagctgtaaaccacacagagaagatccagtctggacctcaaggggttcccattttagcttgaaggaaatgaggaaacaacaaaaaaagtaaactgaattttatcagataaggcaaaaactatgccaaaaaacccccaaacaaacaccaaagcaggatgatgataggttgaccagcttttcctagtttgcccagggctgccctggtgttagcacagaaaatcttgtgtcccaggtaagccctcagtcctaggcaaactgggttgattggccatcttagtaatgggaaagagagcagctaaatgagaatttattttggatgagtggtcagggaaggcctctctggggaggtgatacttgagttgagataagagcaatgcggggacccagagctcacactggtaatcccagcactttgggaggctgtagtgggaggatcgcttgagctcaggagtttgagaccagcctgggcagcttggagaaaccttgtctctaccga

SEQ ID NO: 253193 - DNA, 579 bp, Homo sapiens
ccacacgtactcttaagctccaggtacatcaaaatagatggaaaatagtagctggctcagagctgttgtgaagattaagattatgcacatagtattaacaagtgcctaatagatagtaagcagtaaataaatggcagtttctggtgatttcatagtcttcatcccgacatatagtaggcacccaaatgtttagatgagtaaatgacttacgcactagatcctttctaacttctgtttaagtcttaaatttagttattttgacatttaatcgcatattattttgtatgtgctattaatgactggtagcgaggtgttttttcattataacagactatatgtttctcaagggccttaaattccactgatttttaatatcctttacagcaaactaacatgctatgcacatagtatagtaatttcttcagttcttacagactgttgaaagtacaccaccttttttccaagtgaattcacatacagttggctattcttcctgtaacttgatgatgtgagtaatcattatttcatatgaatcctgattaggttaggatgcttaagcttagacatacctgtctagta

SEQ ID NO: 253194 - DNA, 403 bp, Homo sapiens
ctttcattgcagggattgcaaggacacctgctgtatttaaaatgctgcattttcttggcataccatttaagacaaattacaaaaacctataactgaagcctgtttttccaaaaggtctccagctgcctgaacattaaggagctgtgccagtaaggaggacaagacctggtaactggttaaaagaagctaacagagctcatgataaggcttgccagcctagaggacaaactgccagttgtctatagaacagacaggacttgtgggagcatagtgtgttaagtggaggcccctgagcttagaaaaaggggctttcctattaggcaggaaccaagagaagcacaaagagatcatagtttataaatatgcaacagacacctctgtttggaaggaggcacaacactta

SEQ ID NO: 253195 - DNA, 660 bp, Homo sapiens
caattacctaaaaatgtagtttaatatcaggcagaaaacatttcctcttatcggtcttttctagaatttaccatgttctttgtgcacattaatatgtgacttccattggcagctactctaatcttggtccacagaaaactgacagtgcatccagatgcggccctgaacaatccctgccgcccaacaccactgacaccataggaccctcaccccgtctccatccatgtctgtgtgtgagcccttcccaggaccatgcctactgcaacctcttctcatgttcatgtcattgggtcacgagagatggaatctaggtgagatgagagggactgagggaaggcatgggtgagtgtgagcaaacctgtcacgcaggatgcttcagactcagagaagtttcccaactccaaggcccagcatttctgaaaggaaggagacagaacaatccacagagaatatcatctcacctgaggaagagccatccctgactcctttgctttcctcttcctcttctgagtttcttcttcacatacccagagtctttagaagtcaatcatgaatgttagaaatatgttgtttattgctcagagtcaacataccccctccctgtaaaacaacgacacatacaaaggagacctcaccctgggaaatatggtccactctgct

SEQ ID NO: 253196 - DNA, 498 bp, Homo sapiens
tcacagttcaagggaacaagagatggattcacacgtgtcagccgctgcgtactgttggtgctcacttatgggaacgccattctgacctaggtcatattatacattttaggttcagagagtccttgaataactgggagcagactggtaaacagagattaacaagcttctttcccagtaaaggtgatgtactgggtgggattatattgagtaagtaacagacattaagtgtttggagctaacctggcaaactattataacacagaatggaagacagaaaaaaacaggcagttgaaataattttataattaaatctgttaatgcaattaatactgatcgaccatagtgggggtctgggcaatgagtgtccacaaagagcagctgggggcttactccggaggctgaggcaggagaatggcgtgaacctgggaggcggagcttgtagcgagccgagatcgcaccactgcactccagcctgggcgacagagcaagactccgtct

SEQ ID NO: 253197 - DNA, 439 bp, Homo sapiens
tatactgattttatggtttcaacatttctatgaagataatgcccatgtccctactctagccctgacttccttcctaaactccagtcctcattacaaactacgatatattcaaaaccaattcattttcctcttctaccaatcacattccttccataactgctatataataatttattgaacacttacaacattaccaggtattatgtattatcaaattaatcttgtacaaaatcatctccatagtttctcttttccctcattttacaaattggggaaatctgaggaattaagtaaaccttaccaaggttacaaaacccagcgcaaaataatccagaggatttgagtttggttaagaacaatgtcagtgaactcaggtctgactccaatgtcatcaacttttccacaaccaaactcaaaagcttactgttcaccttttgct

SEQ ID NO: 253198 - DNA, 618 bp, Homo sapiens
agtcagtgaattccagagagaagcaactcagccacactccccaggcagagcccgagagggacgcccacgcacagggaggcagagcccagcacctccgcagccagcaccacctgtgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttg

SEQ ID NO: 253199 - DNA, 378 bp, Homo sapiens
tgttttgttttgttttgtttttttgtagcatgtactgacctggaaaacctcatgctaagtgaaagaaggcagttacaaaggaccacatatttttgataccatttatataacatgtctagaacaggcaaatctagagagatggaaagtaggttagtggttggctagtactagagtaagcaagcagggattggagggtattggctaaggaatacagggtttctttctgtggtgcttttcttaaaaagttctaaaattgattgttgtgttgtttgcacaatgctgtgaatatcctaaaagctactgaatgatacactttaaatgggtgaattatatggtaggtagattatgtctcaataaaactgttaaaaaacacaaaag

SEQ ID NO: 253200 - DNA, 369 bp, Homo sapiens
  misc_feature (137)..(137): n is a, c, g, or t
  misc_feature (294)..(294): n is a, c, g, or t
ctactgccctgtatctctcctggtgtccatccacccagggccaggcatgttatctgaatcatgactgtgctaatattttgtaagttggtttttgaagattttctcagagccagagtcaagtggaaatggtagaatanttatgactggagttctgttagtgacggagtctcatatgctattgagttctctacaaagacaaaattaaggtcatgctgagcaatcaggtattctgggagtttctcccttacttgacttggaaacacttctccactggctcttccccaccactgtganagtccctcgcagtcccacatgcactcctggtccagacatgtggctgccgctctgggctttttccacagcatggcc

SEQ ID NO: 253201 - DNA, 473 bp, Homo sapiens
cctgttgcccagttccaaagtcacttccacattttagggtatccttataacagcaccctatgtctgtggtaccaatttactgtattagtctgttttcatgctgttatgaagaactactcaagactgggtaatttataaagaaaagtttaattgactcatagtttgacatggctgggcatgcctcaggaaacttacaatcatggccgaaggcacctcttcacagggtggcagcagaaacaatgagttttgagtgaaggaagaagccccttataaaaccatcagatcttgtgagaactcactatcacgagaacagcgtggagaaaaccactcctatgattcaatcatgtccatctggtcccgcccttgacacatgaggattatgggaattacaagattacacattaatcttaaattacacattaataagtgtgtaatgaaacatcccctttttttatttgagttcatttcaatag

SEQ ID NO: 253202 - DNA, 2431 bp, Homo sapiens
atttctaattgtacagactttgcagtgtgcagagtcaaatctctcatatcctgtaactttgctgcatgctccttagttttttctttatctacacatatatctggtcagtttgatacatttttttcttttttggtcttctcagctattagaaacagacatgtttgtagaaaagaactcttaccatttgttgcgtctgggacttgtgtggagggtttttgttttggtctgggttggtttgctttttctatttaaaacttagattgtgtgtacacccacacagaaacttcatccagctaccaggctattcctttgtagagtggtgatcaaacaaaaatatgcatctggtgattctttcatttgatttgaaaactgatttcagaaacacattattttcttcttttacctggcagattatttctgagcaagctgaagaatggaggactcagcctacttataaagtaccaaactgttaaggtcacagaaaattatttctggaaggtacattagaagttgttctagcccaactctcttattttacagatggaaaacctggggcccaaaagagggcctggcttagcctaagctgtacaatgacttagtggtagaaaatgaactagaacatttctgaattcccagtccagcattctttccactaagctgatggctgtcttccaggtgcaggagtgcaggttggtacttattacaggactctgctggctgcagtggctctttctggtgctgtggaaagtaccctcttctttgctcagtctgattccatttatgggaagcagtggtggagtttgtacataagatttacagtaaagtctgctgctgtcccaagtttcttaacccttttaaagtcatcttccttccatttctgatttcctagtacatctattatttatttcaatgtaaacaaattccaaataatggaaatttgtctctactacagcttattcaagtttgaactttgagtatatatgctaatgtttacagactggtgagatcaggaaaattgaactgctgttatttcaaaagtgaaagctactctgggacttctaggtcagggtggcagagtgaatactcctgaatcttattcctctcattcaaaaacagagaaattatgcataaatatttttaaaggttttaaaaaatacatagttattcttaaaaataagaaagaaaagtctctttgggccagtaatagaaaagccactatgatggcaggggatcggggggtgctatgaatggatatgggcaattgggaccaggtttttttgcaatgatcctgtctgtgcatgaacccaggacccaagagcacaatacaaataggagctgggctaatctaacttatcccagcagtgtcacagccaggaataagctgcttgttcctgaccagaagtaaagaagaattggcagtcacaagcaagcgcaggaaaccactcaagataggacttggacccaaaatacttttgggctaaaaattcagaactgggctacctaggaggaaagaagacccagagctaccaacttaaggtctggttcaaggttggcacattatcagatttaagctgaggcaacttaaaactgccctatagatacaggtacttacattttttagttatcataaaaattgagcccccaaaacattacaaagaacccagtaaaacctaagatcatgaaaaagcagtcaagagaacccaacaaatgagagaatttatacctgagaaaagaagaacaatctggtgagagtttaaaaataagttaaaattctcaatatatgtacagaagaagttagattttacagaatgaagaacagataatgaaacaagaagagaaagctgtgagaaagaagcgtttagacatcttgaagtgaaaaatattataaatacaatattgaagtaaaagaacagttagactgcacatactttctatagcttaagagaaaattacagaattaggaaatagaactgagaaaatctttcagaatgcagtttagagagagttagaagaaaatgaaagagaaagatggacatgaaagatgacctgaggagctctaacatacatctgctaggagttgcaaaggagaaaaaagaatgaataaaaaagtggcaataataataacaataactgcagctaagaattttttcagaaatgaagctgagtcttcaaaatagaaaatgctgccatatgtaacacaggatagataaatccacaactacatacatgataataaaatcgtaggaaattaatgataaagagaaaatctgaaattctgaatacaagtataagaaaaaattctgaataatggaatggtagtcaaattggcagtaggctttggcaacagtagataccagaaaactgactagtatcttcaaagtgctgtagaaaaataactgtgagcttccagtttcatacagtggtttatata

SEQ ID NO: 253203 - DNA, 640 bp, Homo sapiens
cccccttagcctacatggcagcaaataccactgtgccagttatatctggactctagggtagtcttggccaactccaagactggccaactccaagacttgtccactgtgtgcagagtattttaagtatgttatctcatacaatccataaaaacaaccctatagtgttgggtattgctatttcttttatacacatgagaaaatggaggcagtaagaggaagaggaacttgttcaaagtcacacaactgttaggcagaaatgaggtcattcaaatccttaatcttctcctccagaccacacagcctcccaggaagagatgtgggcacctcctgttcttgccaggcaggaaaccgctccttatcaatgtctacggggtctgctctcacacccaggaaggactgtgacaagcatggactaacctgcggctccactcagcctgctgtcagcaccctcctgttcagcaggatgcaacatctgatgttctgccaggaggctgtagagctgcacatagaagtagccagtgtttcttcccattccaaaatggaaatatcactcagccttttttaaaattgacttcctatgttcattttgattgtaggtgatgcagcaagcctcagggctggggattttcaaaatcttgtt

SEQ ID NO: 253204 - DNA, 693 bp, Homo sapiens
ttcacttttcattttactgatgtctgtatttgaatatttataagtatttatcaaaatataattgcataatttagaaaatctttttttagacctatagagtatattattctctggattacacttctgatgacatggcttcctaaaatatatttttttttattctattttttaaaagattggatttcattctaaatgtaacagaacaggcttatagcagaggagtgacataatctgaattatgatctgaagaagtttgttttgatgactgtgagaagtggtttgtgggagaccaagatccagaagcagagacaatgttaaggagaccactgcagttgttgaaggaaaagatgacggcattaaccctgaggatgcccaaaaataaaatagagaagatggcctttatcattgctacccacaatatctagcatagcaaatggcatgtagtaagcctcctataaagaggtattcgggtaagaaagttaggaagagaggccagccatccagaaggctgggatggagattaccgcttttctaattggagctggagaagcgaaacatgtttcttgaagatgcttgtataatgtccatttatgaaagcagtttcctaatctcctaataaataaaagactcatataaccactaccacaacaaatttggaagcagggacaacaaaaattatttcaaaacaagctt

SEQ ID NO: 253205 - DNA, 324 bp, Homo sapiens
tctttagtagttatacatgcttaaaatatttattttggctggacacaatggctcattcctctaatcctaacactttgggaggccaaggtggtgaaaggattgcttgggttcaggagtttgaggtcagccagggcaacacagtgagaccccatctttacaaaaaataaaaaattagctgggtgtggtggttcagctctgaaaatgattgatttttttcctatatttcagtatagtaaagtaactgcctaaggggttcttcctgacttgtaataaggagagtttagtagatacgaggcctgcaacaccacatgggagatggagttt

SEQ ID NO: 253206 - DNA, 477 bp, Homo sapiens
tagcaatgtctactaaagaaaccaactggcttcttcctgttcgcccacctttcctttgtttattgatatttccaccagaggaaggaccaggcaaaagggagaataaattcactttttaagataatgcttctgagttttagcacagcatcccatttcccgggaagctttattgccaaggcaataaggagaccatgtgagtaggagttaaatgcacagccatttgtgaagtgagactgcttgggttcagatcttgattctgccctttattctatgttgtggaatatattacattgtgctgtgcctcttttaccttatttgtaaaatagagcaagcacccaactcaagcagttgttgcaagaactgcctgctatgctgtttaatacagtatgtggcaaatagcaagtgggtagtaaatgttaataatactgtttggattctcattttacatatgagaaactgaggtttaatgaagttaaa

SEQ ID NO: 253207 - DNA, 610 bp, Homo sapiens
tttcatcgtcttgtatagaatggtaccatccaattcagtacccactagccacatgccacgtgtcacaacccccttcttttcttagtacctttttgtcagaggtcccctctctgttcctccaacttgccaaaattcacctccatctcctttgcagcatttgagaaggaactggccaagaagtgtttttggaattcttagctgaccacccacctccagcctacagaggtggttgaaaagactaagaagagttttttggagaagatagagaattttgttagaaaatgtggtagtgctgggactgtaaccttcttaatcttagtgaggggggctatgagatgcccactaaaaaagccttgacatgagtcacctagagtttgggagacacaaaggactggcaccttatgcataaaaaatattgcttgagtagatggatgaaactcctgtggcagcagaatagagtggcatttgggaagaagaagaattggcactggtgggggtaaaagttataggacttcagccaccagatgtggaacctaaatgaggactgttcgtctgaggtcatttccaaggggatcctattcaacagggcttctgccagggagggaggttg

SEQ ID NO: 253208 - DNA, 389 bp, Homo sapiens
taatttgacttgtaccaggattataaaacatatagaaaatgattccttccgctgtgcatagagtttatcatcgtctttcttctgcttgtcacatccttgctttttagaccatttatcacccatcactctgacttttcagaccctcataatccacatgatacttatccttttgattaaaacaacttaatggccttttcacgaataattaatctgctgtctttactttcagctccaggcttttaactttaatgttgagttatccagcctgtgttgcctttcaaagtttcactccccttagccttttcccctcaaaggtttaatacttctttagaaacttcaatagttgctatacaaaggttttaaaaaatgcttctgagttactctcacat

SEQ ID NO: 253209 - DNA, 441 bp, Homo sapiens
taatcatatcttttagcaaatatagatagaactgcttgaatctgataaaatgcaccaacaaaaaacttacataaacattttgattaaatgttaaaaactttccctctgaaattgagaatagagaagagtgtcctggccaatctgatgagcaagagaaagcaagcataagaatgtgaacacaaggaccaaacctgttcctatttacaggcaacttagtgatgtacacagagaaatcaagcagaagaatgtgaacccaaggaccaaacctgtgcctatttacaggcaacttagtgatgtacacagaaaatccactgggcatggtggctcatgtctataatcccagcactttgggaggctgaggcaggaggatctcttgagcttaggagttcaagaccagcctgggcaacacagggagacccctatctttacagaaaattagga

SEQ ID NO: 253210 - DNA, 624 bp, Homo sapiens
gaacaggcagtccagcctgtcgggggtccctgagccctgctgtgctgcgaccgggctaaagcttgggagcattatcaaaccacagcacaagcactggagactgctcttctacattgtgttaacatatatccatgtccaaaaggcagtgaccattgcaagggaaaaaaaatcgggctgagcttttgcaatactgccgctatcaccactcattgctgtcactttgttgcagaaaaatatctgttctgttgataactggcctcctgagcatcattagaacagcattcctttctcactgttgatgcatttccaagagactgctgtattgacaggtggttctattttagctgctgagatcatggcttcaagttctcagaatctgaatcacagggtacatttgtttcatcacaggtggtactttttgttgactttctttggaaatccaaagccacatgggtcctggtgttcattcccttgtttgtggcttcatctgtctccatctcaccaatttttggcgggtcaggcctagggcccacactgtgttccgtcttcctcatagctgggccgcaagatttggactccagcttctccctctgggcctgacctcaggcaggaggaatttcacgg

SEQ ID NO: 253211 - DNA, 716 bp, Homo sapiens
tggtgtccaaaatatagagatagagatatataggagacagtgttatgaacctacattttaataattgttgctataaaagtaacgagagaaaacgtatttgaagttgaaaattgggacaaataatttcatatgtattaatgcagtaaaaatagcagtacatttgtagactggtgggaatattccagtaaaaagagaaaattagaaatgcataagagaagaaaaaatgctggagcagcttctagcatagcttgaatctcaagtgtaaggactggccttagctagtttattgggatgtatatagtaacagcaaaggagcggagggaatggacacagatgaggagagattatatggatttcaaatttattttcctttttgagcttaaaaataacttaaatccttaaatatgtgactctggagtacttgtaaatgttttcacgcattttccccatgaagagggctgttaaagtaattcactgaggctgggcatattgactcatgcctgtaatcccaggactttgggaggccaaggcaggcagatcacttgggcccagtagttagagagcagcttgggcaacatagggagacccatctctacaaaaaattaaaaattagctgggcatgttggtgtgtgcctgtggtactttaataccaacaaccatattttgaagtaaaataccatcaaaatgacaatccaaatagaaacattaacttagtg

SEQ ID NO: 253212 - DNA, 1767 bp, Homo sapiens
  misc_feature (1557)..(1557): n is a, c, g, or t
  misc_feature (1631)..(1631): n is a, c, g, or t
  misc_feature (1677)..(1677): n is a, c, g, or t
  misc_feature (1764)..(1766): n is a, c, g, or t
gatcatggtaaatgcacagagtgtgctctatgggatagctatgtgaatactcgagaagcaaaacaagtcttgcaaaattattaataatcctttctttcatttctatgaagtcaaggtgttactggagttgcttagaataagcatatccaccctctcaagtagcaaacacccttacactactctaaaagatagtgattttcatgaatcaatagctatttcttctttttatatatcaagagtataactattctttaaaaatatttttttaatcagacaaatgaagatgttctttagaatatgtatgtgagtgaaggtatccaaattggtaataaggggctaggttttaggaatgtagagaaaatggacttgggatattagatctgctaatatcaagacaaaatctgaatccttgttgaagttcaaaataatgactcagatttcaagggtttctttttcttccttctacaaagaaatacagtcacgtactgcataacaaggttttggccaaggacatgctgcctacatgatggtaggcccataagattataacatcatatttttactgtgtcttttctatgtttagatatgttatatacacaaatacttacctttgtgttacaattacctacaatattcagtacagtaacgtggtacaggtttgtagccgagaagcaataggctacatcacattctctaggtttatataaatagaccctgtatcagctatatcatctaggtttgtgtaaatacaccctatgatgttcccacaacaaaatcggcaaatgacgcatttctcaggatgtttccctgttgttaagcaaagtgtgactataacatttttattgagtatttgaacaagcctctccctatcacaatgaattcaatcactcatgaattatttcataaggtgctgtaatatggtataatacattatacatttttctcaggctataattttggtatttaatgaaactaagcagactgccttagtgttgttatgggaacatttatcagatgggaggaagttggcagtaagctgtctgctgccaaatgggaaaggattcattagctctagaagactggcagtcctaagaatcatttaaatacagacataaaaaaatgctcggttggcaattaggattttacacaattctaaaatctctttttaacacatacaggtgagagctttacaatacttggtaaacaattctgaacaaattcaagtaaagttgcaaatttcagaagaatacaggaaaaagaacagatggagttgatgtgtaagagaaaagtcatttgtttccaaaagaacagggaaggccagtgtctacactagcataccataataggagttgcctaaaagcaggcaaagtgatcattttgtcacaggcagacatttgacttggctatatatacattctatagaaaaattttaccttgatagtccacatcgaggttaaaaaaagtgaaataggccgggcgcggtgactcacacctgtaatcccagaactctgtgaggccgaggctggcggatcacctgaggtcaggagttcgaaaccngcctggccaacatggcgaaatcccatctctactaaaaatacaaaaattagccgggcatggtggcatgtgcctgnaatcccagatactggggaggctgagggaggagaaccacttgaaccnaggagggggaggttgtggtgagccaagatggcgccactgcactccagcctgggagacagagcaagactctggccaaaacaaaaaaannna

SEQ ID NO: 253213 - DNA, 392 bp, Homo sapiens
cttcaaagccttggggaaccagaatttatttttgctctgccctcattgaagatgtcttaagaacacaaccaaatacgaggaagcaagatggagaaaaagaagcagcatgctcctttcctttaaagtggtgacttggaatctgtacacgttgcttccacatgtgtacccatgtccataacctagtcacagagacacaactaatagttacctgggaggctgcagtctttagctgtgcagccagtgaccaactaaaattcaaggtttcaattactatagtaagaatggagaatggatattgaaaaccaactccactgctatctcagtgacatcaaatttggaatgtttattagacatccaaatctgcctcatgcaccaccactaaactgaaatca

SEQ ID NO: 253214 - DNA, 337 bp, Homo sapiens
gtgaaagttgtcagaatcaaaatggagtaactggcattaaacaaaccaacaaaaggaactttcacaaagcaccagggaaggccataaagagtgggttctcacgcctcgatgcctgataacaaaaaggactacaaaaaacacaaccttgcacaaaggccaccaccatgttacaggaaaacatacttctgcaagggcatttgaccagccactgcccatcccgccctggactggcatcatccttgttattcatctttgcagccaaagataattatcttaaaacagtgaagtaatcctcctcttgtattttcccattaaaaacctttgtcctcctttaccc

SEQ ID NO: 253215 - DNA, 748 bp, Homo sapiens
gacatctctagcaagctcattgtcttctgccttattaaactttaatgggtaactagtagacagtaacactctgggagggctcaaaccacataaccaaatgtgccaagataatcctgagctcactattgtcagtcctgaagattttcctcagataatctttcatctctttgttcctgagactatatattagaggattacagagtggtgttatcacagaatagaacaagtggatttttatctgagatctacaacttatgaagaatacaaatgatgtatattcttttctactcttcatgtatggactagaggggcttgcacagtagtaagaaaaaaatggctgagacccacaggaacaaagaaacaggacaggagttagatgcagagaagagatttcaacaaaagtttggaaaagatgctaacggtagcatatgagtcacagacagaacattggcacctttgtttaagaaactgaatgttaatgtcacatctgcctttggagattacaaatgaaatggctacctttctactggaaccctgaccagaagcctgccagttagtaagctggcttaagagatcaatctaaaatttacataaggcttttgaaaaaaagaaaaaaactcaagagaattgacatctggtgttaaaaaacaaaaaatcatacaaatgactgatatgtatcattttccttattaaatatggaagaaaggggaggaggatgcagaaatggttggctaaaagctccagagaa

SEQ ID NO: 253216 - DNA, 845 bp, Homo sapiens
aactttagttagtagttggtcccagtcagtaacgctctgggagggctcaggccacatcacgaaatgtgacaggatagccttgaactcatcaattgctgggggcacctcaaactcaactccaaaattgatctaatgaactttgccaaaccacattcccttcttgcatttctgagagaatggattcccattcatctgactacagtgctaccctgaaagcagatccagagactaagattcacctgcaggtgattcatttgcaaggtaagctgtcatcagttggaggtaagcggaagacagtagagagtacagagccctggactgtgactcagaggatgagcaccagatccagtttgctgtgccacagtgtcctgaagattttcctcagataatctttcatctctttgttcctgagactatatattagaggattacagagtggtgttatcacagaatagaacaaggtcacttgatattcttggcttgatgaaaaaaaacaagattctaacgtgacagaacttgttcttctgggcctatcatcttcttgggagctgcagctatttctcttattactatttttgtttttttacattgctattgtcctgggaaacctcttgatagtggtaacagtgcaagcccatgctcatctgctccaatctcctatgtattattttttaggtcatctctctttcattgacctatgcctaagctgtgttactctgccaaagatgttaggggatttcctacagcagggcaagagcatctctttttcaggatgcctggcccagatctacttcctccactttctaggagccagtgagatgtttctgctgacagttatggcctat

SEQ ID NO: 253217 - DNA, 1084 bp, Homo sapiens
aactttagttagtagttggtcccagtcagtaacgctctgggagggctcaggccacatcacgaaatgtgacaggatagccttgaactcatcaattgctgggtaagaaagaattttaatgcaatggcaaacaaccaatcaaacaagcaaacaaaaacaataaacccttccttgaggaccaagaagacattgattagctaacctaagagctccaggtggagacctaggtcctgattgggtttctgaatttgaccactaggcagaaaactagcacccaaaaccagttggaataaaattacccacctacagtggagccaaggcccccagatcctttttgtcaggggcacctcaaactcaactccaaaattgatctaatgaactttgccaaaccacattcccttcttgcatttctgagagaatggattcccattcatctgactacagtgctaccctgaaagcagatccagagactaagattcacctgcaggtgattcatttgcaaggtaagctgtcatcagttggaggtaagcggaagacagtagagagtacagagccctggactgtgactcagaggatgagcaccagatccagtttgctgtgccacagtgtcctgaagattttcctcagataatctttcatctctttgttcctgagactatatattagaggattacagagtggtgttatcacagaatagaacaaggtcacttgatattcttggcttgatgaaaaaaaacaagattctaacgtgacagaacttgttcttctgggcctatcatcttcttgggagctgcagctatttctcttattactatttttgtttttttacattgctattgtcctgggaaacctcttgatagtggtaacagtgcaagcccatgctcatctgctccaatctcctatgtattattttttaggtcatctctctttcattgacctatgcctaagctgtgttactctgccaaagatgttaggggatttcctacagcagggcaagagcatctctttttcaggatgcctggcccagatctacttcctccactttctaggagccagtgagatgtttctgctgacagttatggcctat

SEQ ID NO: 253218 - DNA, 1268 bp, Homo sapiens
aactttagttagtagttggtcccagtcagtaacgctctgggagggctcaggccacatcacgaaatgtgacaggatagccttgaactcatcaattgctgggtaagaaagaattttaatgcaatggcaaacaaccaatcaaacaagcaaacaaaaacaataaacccttccttgaggaccaagaagacattgattagctaacctaagagctccaggtggagacctaggtcctgattgggtttctgaatttgaccactaggcagaaaactagcacccaaaaccagttggaataaaattacccacctacagtggagccaaggcccccagatcctttttgtcaggggcacctcaaactcaactccaaaattgatctaatgaactttgccaaaccacattcccttcttgcatttctgagagaatggattcccattcatctgactacagtgctaccctgaaagcagatccagagactaagattcacctgcaggtgattcatttgcaaggtaagctgtcatcagttggaggtaagcggaagacagtagagagtacagagccctggactgtgactcagaggatgagcaccagatccagtttgctgtgccacagtgtcctgaagattttcctcagataatctttcatctctttgttcctgagactatatattagaggattacagagtggtgttatcacagaatagaacaagtggatttttatctgagatctacaacttatgaagaatacaaatgatgtatattcttttctactcttcatgtatggactagaggggcttgcacagtagtaagaaaaaaatggctgagacccacaggaacaaagaaacaggacaggagttagatgcagagaagagatttcaacaaaagtttggaaaagatgctaacggtagcatatgagtcacagacagaacattggcacctttgtttaagaaactgaatgttaatgtcacatctgcctttggagattacaaatgaaatggctacctttctactggaaccctgaccagaagcctgccagttagtaagctggcttaagagatcaatctaaaatttacataaggcttttgaaaaaaagaaaaaagaacccaaaggcacagattgacgttataagtcctgatttttgacttgacttctcatcacctggaagtgaataaagcagtagacttctctaacattttgtaacacagcatgaaaaaatatagagtacaaaagatatatatatataatatgataaaatgatgagttacgtttctaaatctt

SEQ ID NO: 253219 - DNA, 1309 bp, Homo sapiens
aactttagttagtagttggtcccagtcagtaacgctctgggagggctcaggccacatcacgaaatgtgacaggatagccttgaactcatcaattgctgggtaagaaagaattttaatgcaatggcaaacaaccaatcaaacaagcaaacaaaaacaataaacccttccttgaggaccaagaagacattgattagctaacctaagagctccaggtggagacctaggtcctgattgggtttctgaatttgaccactaggcagaaaactagcacccaaaaccagttggaataaaattacccacctacagtggagccaaggcccccagatcctttttgtcaggggcacctcaaactcaactccaaaattgatctaatgaactttgccaaaccacattcccttcttgcatttctgagagaatggattcccattcatctgactacagtgctaccctgaaagcagatccagagactaagattcacctgcaggtgattcatttgcaaggtaagctgtcatcagttggaggtaagcggaagacagtagagagtacagagccctggactgtgactcagaggatgagcaccagatccagtttgctgtgccacagtgtcctgaagattttcctcagataatctttcatctctttgttcctgagactatatattagaggattacagagtggtgttatcacagaatagaacaagtggatttttatctgagatctacaacttatgaagaatacaaatgatgtatattcttttctactcttcatgtatggactagaggggcttgcacagtagtaagaaaaaaatggctgagacccacaggaacaaagaaacaggacaggagttagatgcagagaagagatttcaacaaaagtttggaaaagatgctaacggtagcatatgagtcacagacagaacattggcacctttgtttaagaaactgaatgttaatgtcacatctgcctttggagattacaaatgaaatggctacctttctactggaaccctgaccagaagcctgccagttagtaagctggcttaagagatcaatctaaaatttacataaggcttttgaaaaaaagaaaaaagtaagtctttaaaaaagccaaaaggaaactggtggaattagaggtaattcggggcgggggggggggaactgtaaaaaactgtatcttctcatcaatgaaagaaaatatttgtaatcttgaaataagaatatgatgtactgaaaaaatatagaaaaattatttttggaaggtaaaatcaaaaagaacaataaacaaaattaatatggcattaaaagaaata

SEQ ID NO: 253220 - DNA, 391 bp, Homo sapiens
tgatatctgtcacatgtgttaccaattgctttagctcagtaatacaaaaaggacgtctgcattctttttaaaaagttgggttacatatacacgttctgattagcatagacatagaattttacatacgtattattcacttcaacagaaaatctaattcactgttgaaacattcttaaataagaccacagtaatgcagattgtggtgagtggtgtttaagatgttaatggctcattattatagcagttcttaaataaaacaataaatttgtagacaaatattcatgtataataaagttacatttgataaatgaaaattctcttatttatattttattaacatcttttccagtcctgaagattttcctcagataatctttcatctctttgttcc

SEQ ID NO: 253221 - DNA, 466 bp, Homo sapiens
aaagagtaaattgaagaaatggaaactgcaaattacaccaagcccctgaaatgctcatagacttctttgtggagaggaagataatttcttttgatggatgcattgcacagctcttcttcttacactttgctggggcttcggagatgttcttgctcacagtgatggcctttgacctctacactgctatctgccgacccctccactatgctaccatcatgaatcaacgtctctgctgtatcctggtggctctctcctggagggggggcttcattcattctatcatacaggaacccaaaggcacagattgacgttataagtcctgatttttgacttgacttctcatcacctggaagtgaataaagcagtagacttctctaacattttgtaacacagcatgaaaaaatatagagtacaaaagatatatatatataatatgataaaatgatgagttacgtttctaaatctt

SEQ ID NO: 253222 - DNA, 349 bp, Homo sapiens
ttactgcattttccaggaataaataaccttgtcccaaaaacaaacatatttaaagacatttccttctgtggacactgattccatgctatctgttttccaaggaagtggtgagcccgtttctgagaacacctggtatcaatggctgtcccttccaaaccaagcaaaaagtgatttcttgtcggtgtggatttggttttgttattaattttaaaacatacctttgaagacttagatctctgaaactactagatctctagaagtgtaattgtgaaaaaagtttgcttgcatcatcaacaacatgaaaaactctttctaaataaaatttgttttgaagttaaaaaaaagaata

SEQ ID NO: 253223 - DNA, 500 bp, Homo sapiens
gtgagtgccctccccatgaagctggagccactctggaccagactgctgtctgattctcttctgcagtgtcctaggaaccagcaaggtgcctggcacacagtaggtgcacaatcaatttttgagaaatgtatgcatcaatgccgtttactaacaatgactttggaaaatcactttttctcttcaaacttcaatactctcaactgaaaagcactgagcgtaatccctaccctttaaagctattgcatacaataagtacatacaaaatcactttgtctggccaggcacagtggctcatgcctgtaatcccaggactttgggaggccgaggcgggcagatcacttgaggccaggagtttgagaacagcctggcaacatggtgaaacctcctgtacaaacattacaaaaattagctgggcgtggtggcacacacctgtagtcccagctacttggaagcctgaggtgagaggattgcttgagcccaggaggtcaaggctgcagtga

SEQ ID NO: 253224 - DNA, 339 bp, Homo sapiens
tattttacatacattttacatgcactgggctagccattttctagactacacagatatataccagacagtatttccattgagaaacttactatagagttggggaaataaagaattgtcaaatgaaaagataagttatggtaatgaattcaaacaactttacaagaagaaatgctacaaggctaaacgtagctagttgccaaatggatgctccagtctgtaacacatgatagtggcacacatggaagcatgtaagagaaagctccaggcagtaatgaattgggagagtgggatttaagctgaaccttgttgaaaggaaggtagaatttagaagcaaaaaaa

SEQ ID NO: 253225 - DNA, 359 bp, Homo sapiens
cagcagaagtacactaaagcaccaagaccatctttaaaggttgagatgggtttaaaatggctattcacacacccatctgctcctctcaaaaattatctcacattcaatttcacaaagagcatttggaagacactggccatgtaacagagaaactgaaagctagagtcattattccattgctttccaaattccaaaaatagcacaaagtcatgtccagaagggcatgtgctccggaccttagtcaaacatctactttcaaagtttccataaagactctgaaaaggagggaatcctgttataaacacagtgtaaataataatatggcagtaccatttaattctattctgctggtgaagaaa

SEQ ID NO: 253226 - DNA, 873 bp, Homo sapiens
cctgtctcagcctcccgagtaactcggactacaggcatgtaccaccacgcccagctaatttttgtagttttagtagagacaggtcttcaccatgttggccatgctggtctcaaacttctgacctcaagcaatccacctgccttggcctcccaaagtgctgggattacaggcttgagccactgtgcctggcctcttgtcactttttaactgtgaccctaggcacatttcttaacctctctgaggctgtttccttatatgtagaagggggttgataacacctgctttgagaagctatttcacgtgttaggtaacataaaatgcatagttcaaagccttgcctatattaggtgcttaagaaatgttaatgtctttacatgtgtatctcctccattttagtgctccttaaatctgatttcagctggagttgccatactttgctgtagactttttattgtaaaaataatataaccatctgtacaaagtttagaaaatggaggaagaatttgctcatagtacagccactttgtgtgtgtgtgtgtgtgtgtgtgtgtgtgtgtgtgtgtgttttaacatgtttgtttctctgtaatagcattgaacacagaaatgcctctgcttctggacacgtttgttctgacagaccaacactgctttagcctacagttgtctctaccctgtttcactaatcactgccatctgctttgtgccttcctgtgggctgtagcttttttatgtctttgtcattttaatggtgtctcaggaaagtggtcagccaaccatcttgaaccagacatccatgaccattacttttaattgctgtgtaatatttcacagtaggttaaccattgtttacttatttccttattgttgtac

SEQ ID NO: 253227 - DNA, 572 bp, Homo sapiens
aattggtatctgattggcatagggaatgaagctgacctgcacacagttcactttcatggccatagctttgaatacaagaattagggagtgtatcaatctgatgtttatgaccttcctcctggggtctatcgaactgtaaaaatgtatcgaagagatgttggaacctggttattttattgccatgtttttgagcacattggtgctggaatggaaagcacttacactgtacttgaaagaaaagggctgatggagcagaacctctgaagcagacaaaggagagtcagcatgaacagtttctcagaatcttctctcaatatcaggactacatttgtcaacaaaaccaaaaactgattagccaccgatataatttttacctacaacatcctattaatgtcaataatatcattattgatacaattctaataatcactacccttattcctatcagtgttcatgtacattcttagtaaaagggactttggtgcgctgtccatgaaataaatcccccattgctaacattctttctttggaaaagtagattttgcatttcaaagaatataaagtcaaattgg

SEQ ID NO: 253228 - DNA, 409 bp, Homo sapiens
aattggtatctgattggcatagggaatgaagctgacctgcacacagttcactttcatggccatagctttgaatacaagggctgatggagcagaacctctgaagcagacaaaggagagtcagcatgaacagtttctcagaatcttctctcaatatcaggactacatttgtcaacaaaaccaaaaactgattagccaccgatataatttttacctacaacatcctattaatgtcaataatatcattattgatacaattctaataatcactacccttattcctatcagtgttcatgtacattcttagtaaaagggactttggtgcgctgtccatgaaataaatcccccattgctaacattctttctttggaaaagtagattttgcatttcaaagaatataaagtcaaattgg

SEQ ID NO: 253229 - DNA, 431 bp, Homo sapiens
cttgtttctcataattaggaacttctttggatttgatcaagtcagatagttcagatttaatcaagtagggtggagttgatcaaacccaatgggaaaaagaccaaaacaaaaacaaaaacagaaataacaaccaaaaaaaaagttaagtaaaacaaatgattgcccaacccatatgattactgaggtctctaatgataaggataaattaagaccagctggttgtcaatcttaactttagaaaaggcaaaccccaattcagttacttacttagggatgggtctcaggctgaagatggctctttaccatcctagaagcagaaaaaaaaccctcatcttccctgttgaaagcaagctcaaactccgtaaaggagttacctgactccattgtcacagaaaacttgcctaccttgtattggaagcaagtaaaactcc

SEQ ID NO: 253230 - DNA, 393 bp, Homo sapiens
gagagttgtccagagtcatacaagctcttaaccagcagagccaggatttcaaaccctagaagaatggctttggagtccaagttcataattgctctgcttttatacctctgcaacgaagtatagtgacatctacctaccaaagaagttaccttacaatgacacatttttccagatacttcgttgtcagtgatacaaatgatttgagagatagggggagacattttggggtaggacttctccttcttcagtaagacactacttcttcccctcccctcctaggacagcaggtcccctcatccgttgtactcattgaagcaatgttgcagcctctcttaggattaccatttccctagtgaacagaacagaaatgtcatacatggttatggcctgggc

SEQ ID NO: 253231 - DNA, 341 bp, Homo sapiens
gccagggcgggctctaggccgtggaatctggggccttaaagccccttcgtctccccagcacccactctctgggggcaggtgggcccggtgacagtaaccttcagggagccctgaagaccatggaggactactgaccaacaacctctgaccttcacccctctggatgggggacgaatcactaggcaaaggggaacaatgggaaggagacaaaatggctgcctttacagctgcagcaagatgtggaaacactggttccctaggcacctccattgtcttcccgccttgggagcatgaaataaataaagtgtgaaggggaacatgaggaagactgatccaagtca

SEQ ID NO: 253232 - DNA, 342 bp, Homo sapiens
gctagctactacatgatgcttcctacacgtgctctactaggcagtgtgttatttaatcttcatagcagtccactttttggatgaggaaactgaggttgaagatttgccaaggtgacgcaaggtaacagttggggctcaaagtcagtgccttgtcacctcaaaactggagcctttaatccctatgttaacaaccctctaggtatttttgatttggtgtaaggcactgtggtaactggcttgatttggaatcttaattgtcagaagtcaagataacctcggccctgtcactggttaatactctatggtgtgtatgccaagaatgtaatatccctgtggagttgg

SEQ ID NO: 253233 - DNA, 466 bp, Homo sapiens
gtgcaaaaacaattcaatggacaaaaaagagccttttcgacaaatatcatgttggagtaattgaatatccataggcaacaacaaaaaaaatgaacccagacctaagtctcacattttatacaaaattaactgaaaatggaatatagacttaaaagtaaaacgtaaactataatacttttagaaaacaacataaaagagaaaatttgggggatctaaggagagaggcaaagttcttgataccagaagcatgatccataaaaagaaaaatggatagagtggacttcatcaaaattaaacacttctgctctgtgaaaggcccagaaaagagaaatgaaaagacatgctactgactgggaggaaatatttgcaaatcacacatccaacaaaggactagtatctagaaaaaaatacacacacacacacacagaggcacacacacacattatttaaaagccctcaaaactca

SEQ ID NO: 253234 - DNA, 424 bp, Homo sapiens
tttctcaactcttattttcagagctttgtgggaaagccgtggatagttgggacccaaaggtcgttttcagtttcaggatcctgtggccaaagagaggagataaaaatgcttggggccattttaccttcaacatcttccaaactcctgttcatgttgctgttttgacctcctcccatgaatcatgaatgttcttaaggcatctagaatggtgaatcctttccagcaggtttttaaaaattttctcccagatccatcagaggaatcattgtctaaggcagctgtagccttatgaaatgtcttaaataataagacttgaaagttaattatggaagttaacttgaaagttaataagacttgaatgttgtgttaatggctattttaatattttaatggacttaaaatagtaaaccatgcagtaaacaga

SEQ ID NO: 253235 - DNA, 513 bp, Homo sapiens
gattatatagcaagtaaggctgaggtgctacaaaagaattcctatggaattgtcattgattggtcccctaaggggatttttaaaccaaattgcacaagaaggccctcttgtaaagcaaatttaacaaactgatggaatcgctggcaatgtaatcatacacaatacattcagatggaagctgatgcccctatcatatggaatcctgctggcattatcgcccctagtccaaaaatgatatctcctgccataggacaggaacattcagaattatgaaaattagctgtagctcaaagtccaattaaaatttgggagggtaaatatgaaaagtacagtggggagggaggtaaggataaatatgctctttcttttctttccaacaggacgttttggattcaaagttgcattcgaccaccttttatgttagcaataggaaatgttactattgatataaatacacactctgttacctgcccagaatgtcgcctatttacctgcattaactcaacttttgat

SEQ ID NO: 253236 - DNA, 545 bp, Homo sapiens
tcttcatttctataccttcttttatctgaggagcttaagccattttgtagaggcattaagtattgcctcagtcttaatatgtgagacaaggtgtgaggaatatagagattcataaaataatccccatcttcaaggaactcacagtcaggaagaacagagcctgcaacacaaataattgcaatatagtagaagtgccaataggagctctatgaagggcgtgaaacaggaaaggctacatagaggagatggcagacactctgtggattgtgacctgttggtgggccatgaaatcaatttgggggtttgagagcatcattcttttaataaaacagaagagaatcatctgcaataaggaacccatggatgaataccatctggtcctggtgatttactgcacagagtccctcaagttgctccatacctttctcctgagagactgaagaatctctgtcaaggccgttctctgctttgccataaaatgtgtccttggaacaagaatttccccattgtcttcttcaataaatactgattcaaagtattcaaaa

SEQ ID NO: 253237 - DNA, 350 bp, Homo sapiens
tttccgttcctctgtgtcgaagaggatgtggttacttacttactcttatttctctagacactctgtggattgtgacctgttggtgggccatgaaatcaatttgggggtttgagagcatcattcttttaataaaacagaagagaatcatctgcaataaggaacccatggatgaataccatctggtcctggtgatttactgcacagagtccctcaagttgctccatacctttctcctgagagactgaagaatctctgtcaaggccgttctctgctttgccataaaatgtgtccttggaacaagaatttccccattgtcttcttcaataaatactgattcaaagtattcaaaa

SEQ ID NO: 253238 - DNA, 496 bp, Homo sapiens
tatatttttaaagacactttcatttctaagtttcaaaatatttttgcaccaaaaacattgctcttattaggccaccttttctaaggaagtttttattcattttatggaaattcagaattttgtctacaagactaatgacaacaattgtatatttatatataatcgcctttttgtatatgtcttagtctcttcaggctgctataacaaaattccttcgactgtgtaatttataaacaatagaaatgtattgctgacagttctagatgccaggaaatccaaagtcaagacaccagcaaaattcgtgtcacaaatggtgcctcttgctgcatcttcatatggtgtaaagggcaaaatggctcccacaaacctcctttataagggcactaatcccattcatgagggtggagccatcatgaccgaatcacttcctaaagtccccacctcttcattctatcacattggggattaaatttcaacatatgaattttagggagac

SEQ ID NO: 253239 - DNA, 274 bp, Homo sapiens
ggtcgtgaagtcagtacttctaccttttgttctgaacacttgtagtggtaaacaatgcacttagtcatctatgaacattgtatgccttggtttttatcttttcattcaagtgattttataatagctatttaccaaattggaatatatttatatttcaagtgttttctaacttttcaattaaccttttttaattgtatgagatttatatagttataatcatacatagttactcttgtataattttacaataacattaaaatgaaattaaaaattc

SEQ ID NO: 253240 - DNA, 515 bp, Homo sapiens
atttagagatttctcaaagaacttagaacttccactggaattttgataaggattgcattgaatttggtctctctttgggtaccatgaacactttaacaatagtaatccataagcatgtggtatttttccatatatttgcttccattcaaatttttgaacactttgaagtttacataaatctttcttttcttttcattcctctttctttctgtctcttactttctttgttcttccttccttctttccttccttccttcctcttcttcttacttctagtggcaataagaacatattctagctttaatctggtgatttatatttagtgaatttttaaaaattgagaataatgattgaactgtaattggaaatagacctaaagcagagagaaacctttcctctttgtttttctctttttttttcctgttctccactgcttcttaattgatcgatttgcttttctagtcataaggaagttgtttattataaaattaaattgatattgtcatttctggaga

SEQ ID NO: 253241 - DNA, 317 bp, Homo sapiens
ggctacacacctgttacaatcactagaagtaaaaagactggccataccaactgctaatgagcaagtgaagaaactggaaccctcgtacactgctgatgggaatataaaatggtacaactactccagaaaacagtttggaaatttcttaaaaagttaaacataaacctaccacaggtcctggtcattccatttctaggtattaatgtaagagaaatgaaatgacacacccacacaaacactggtacatgaatattgatggcagcattatttgtaacagccccaaactgaaaacaacctgactgttcatcagcagggaa

SEQ ID NO: 253242 - DNA, 387 bp, Homo sapiens
  misc_feature (380)..(380): n is a, c, g, or t
cttttttttctctctctcttttttttaaattgagacagggtttcggtctgttgcccaggctgaggctggtggtgcaatcatagctcactgcaacctcgacctcctggggttgcagcatgggccaccgtgactggcctgaaatagttttcttagcatttaattttaagttcgagaccagcctgggcaacatggagaaactccacctctacaaaaaaatacaaaaattagctgggcttggtggcatgtgcctgtggtccccagctactagggaggctgaggtgggaggatcacctgagcccagcaggtggagtgcagtggtctgtcttggctcatacaggcagccttgagcccagagctcgagctgccgtgagccgtgattntaaaatt

SEQ ID NO: 253243 - DNA, 603 bp, Homo sapiens
ggcgggccgaccacttaaggccaggagttcgagaacggcctgggctacgtggtgaaaccccatctctactaaaaataatttatattcctgccagcagtgtattgagataatcatgtactttatgctactagaaaaaaagtcacatgaaattttaacacagaatgttcgacatttaatacttttgtaacataaatgtttttttatacttgtttgctgattgatttgcttctctttcctaaagatttgtggaactcagtagtattagtgttaatttgtaggtatgggtccagaagcaattcagagaggacctgaatatacctaaactgttccctgaagagtcagcagtagccattgggtagttcacttggaaatgatattcctctcctccaagttgggggtgtgtatttattggtcacagaacacacagtcatacagagcaagagagaatgactctggaatcagactgcctgaattcaaatcccacattctctacttactccgtgagcaatcctgagcaagttacttgtctcattctgggagtctgaggcaggcgaatcacttgagatcaggggttcaagaccagcctgggcaacatggtgaaac

SEQ ID NO: 253244 - DNA, 484 bp, Homo sapiens
cttttgaatctttaacatgtgaaaatatctttgctggatgcagtggtgcatgcttgtaattccagctacttggaaggctgaggtgggaggattgcttgaggccaggagttcaagaccagcctgggaaacagggcaagaccttgtctcgtctcttgaaagaacaacaacaagaaactttaaggcatgcttagatttccttgataattttactacatacagagttaaaaatggaaactactatccttgaaattttgaagacattgctccgttgtcttctaacatattttggatatgatttaattttttctttttctccctggaacattttagaatcttaagattttaaagtgtcacaacttctgtcatgtacttcggtgtagatccttttaaaattatgctgggtattttgctttctccatttagtctggagaccattgtccatcagtctgagatatttcctaagttttcaaaaaaaaattcttct

SEQ ID NO: 253245 - DNA, 371 bp, Homo sapiens
ccagcatttgaaactgcagtcatttttaaactgagtatgtttttatttttaaactaaatgtactatgctgtttgcatttcctaaaaatatccagaaactctggtagtttgttgttcagtgctcccctggagaattcatgtgaaggtctaaatattttatactgttgattttattaaaatgtgaagatccattttgtgaccgtgtaaatggaatgtcagtgtttcccttcgaagttcacattcccttgcctgtgttctgcatattccttttccttgctcagaattcttatataggtaaggaagaccttccaaggtttcttttgccacgcttgcttctccaaacactacaataaaatcattttgatgaagtaa

SEQ ID NO: 253246 - DNA, 239 bp, Homo sapiens
accatctgatcgcaagcctctaatttttccagaatgtctgccgtctccatttgggaccactgagctgccaacagtgcctcagagaaagattcagcaagaatggaaactactagtacattttctcattatgccactcctaaatttagtacattttctcattataccactcctaaaaacagaataattagtaatgaaatagttcataaaaaactatcccaggatattattttgagatgtgc

SEQ ID NO: 253247 - DNA, 394 bp, Homo sapiens
aagccacgtcattctgcttttgggcttcatgatctttgccatccttacatgtcacttgttctgaaacttggccatctcacttgtcgttgagctgaaacttggcatggtgatgattgattgggaagtggtttctctctgcttggcaggactcagctgtgtacatcctggcccagtcgaaggctttggctcctgcaaggtaaagaggtgccatctttcaaaactggagaacagccagagattcagaaatagaaatatgttatggagaaagtcgacttcttatcactttcctttcctctcttatgtggaggacctcatttctctctgtttgcagggaggcacaaacaccagttttattcattcattccttagtcatttaagaatacatactgaaaaa

SEQ ID NO: 253248 - DNA, 408 bp, Homo sapiens
catctttctaatctctgtcttcttgcttttttcttctctgctgtcattgtttcgcatgggttgtctaccacgtaatcttcaggaatctcatttttaggattcccagaggcaggctcacctggcccttggggacgtgactttgattaaaaaaacatcagggattagttgaatctgctacttctcagttgttggattgtggctaagttacttaggttctctgcgctcacttttcttatctttgttctttttttttttttcaacatcatattagaagtccttctttatctttaaatggggctgacaatactctgtacctcactggattattatgaagaccgcctaaaactaatttatataaagggcccagcacatattaagcattgaataaatggctgttacttcttctgc

SEQ ID NO: 253249 - DNA, 393 bp, Homo sapiens
gttctcagtgtgtgtcttgtgtcatttctgtgatgcttgcacatcgtcagggggtacctaccactggaacctcctcttttaacaaatgaggaaactgaggcacacagcggttaagggacttacgccaggtcacacagcagtagagctgggctggggcagggggcagctcctcaagtggaacctggagagcccacggggcaaatggcggaggctggaggggctggcaagggagggactgcaaagggcctcacaggggctagacgagggccctgggcaccagtgattatggtgcccccccatgtggattgaagattaaacctcgaagcaagtgtataatgcccccaaaaatcacatttggaagtcatcacttcaataaaaatttctatattaaat

SEQ ID NO: 253250 - DNA, 513 bp, Homo sapiens
cagacgggatttcagcatgttgatcaggctggtctcgaactcctgacctcatgatctgcctgccttggcctcccaaagtgctgggattacagcctgagccaatgtgtccgtcctggatactcttatttcttaaagacaagatctaaattatataaacatttatgtaatatggaatgatttggcataaactattgatgtcggactttttgttccttagttcagctaaatctgagttcttgtctcatgaccaagaaaaattaggaacatggactcattgaaagtttttcttttaacagttggcctcagaagtgggatctgaagtagggcttccagcaacccccaagtgatgaaatgaagaaagatttttagtgattcactaactgaggacaatcaaactcttcatgatctagaacccaaagtttgagtcttctggaaatgtcatcagaaaaaaacatccccttgccactcacacttcagcaaaactttcatacttcaaaccttggatccgcatct

SEQ ID NO: 253251 - DNA, 425 bp, Homo sapiens
taggctttggagtcatgcagatctgggtttgaatccagccctgccacctatcatttccatgacctttagaaggtgatgatattgacacttcataagattttgtcatgctttgccttttcacaccgctccatgccacctcacactttatggctacagattctatccctctggccacagaagtgggcccaagataggtcagttagtgtttattacctctggtcacggtgattggttcagagatggacacagtatctaatctgggccaatcagattccttctctgagattttatctttttctatctggagctagaagggaagaactttttttcttttggatgatgaggctataagcaagtaatttcaagggtgcctgcagccattgtttcagtgtcatgtgaacagagaataaagcaattgaaaaata

SEQ ID NO: 253252 - DNA, 403 bp, Homo sapiens
aggtttagataaacttgtagatgctttatttatttgaattgtcaggaaaaaagatatggttgtatggttgagaagtttattctttactttttggagttcagggaaaactcacatcatgtggtgacacagaatatttgactaaatggaccaacatcttgactcagagtgaaaattcttaggaataacaacagtcttttaaaaagtatctttcctttcttttccaatataagggaaaaggaaactttagtcgggtaggtggtaggaaaaattaccctatgtgaaagcttggtgttcatgttgaaaactatataaatgccaactagaaaagggaaaattgaagggggcaaaaggtgaagctcagaaacctagtcgtaattttgcataaagtctagattaaacaacc

SEQ ID NO: 253253 - DNA, 558 bp, Homo sapiens
ctcgaactcctgacctcaagctatccacccacctcaaccccccaaagtgctgggattacaggtgtgagccaccgtgccctgggttattttctgtaactaacccccttctctgcaaattatattgaagatattttatcctagtctgaattttaacttgggttgtagtgcctttggtttgatagaaaagtttagtgttcatggaactgaacattttttattaattgtgttttatatcatgcataggaaggtccttcaaccctaatattttttaaaaggtagtaatttccagtacccttatagttttgtgctttgtgtataaatttactatcgatctaaagtgtatcattatatatgatgtgaagtttttttccaagtagttagtgatattgcaatactcatttcccatagaaacatggggatctttttggattcaatgctctgttccattcatttgtctgttcctttgctgtacactttccattaccatagttttattattagaggggccctagggtccttctcactacgtaatttggcattgccactaaaatatattgt

SEQ ID NO: 253254 - DNA, 573 bp, Homo sapiens
aactaaagggttcagaaacagcatcagagacttcagatctaaagcagaaattcctccttcctctgagtcacacagatatctagctagctttttttagattcctttcagtttgagaagtctgttactttgtatagcaactgattctattgttaaacagctttaatatttaggtgtacttttatattgagccaacttatcatgatttctactaattggtcttatttctgatgttaagggtcacagagtatttttattttttctatcactataacttttccactttccaggactgctgcatgctaaaaactcttagttttgttcacttttcaccatatgacataattctaaggtcaacactgaaaaacttcctagggttactctggtttttttaattaagattttttaaagtgccaatcagaaaaacataatattaaaactggtgtcaatttataaaaaatgttctgatgtattgttttgtacaattatctaaacagaagcatgatggactctaatatttattgagcacatgtcacgttcaaggcattttcacatatattacttaatttttatagc

SEQ ID NO: 253255 - DNA, 298 bp, Homo sapiens
agcaactgtgtaaagatcatgtggattgattgttcattttactaacttcttaaagggattgagtggaaaaattatacattgcactgttcattgtactaaatctgctttttgataaaagcagaatgtggaatttagaaatgtaattttaattacttgttggaacagattttcttattaggagagaacacctttgaaatcagagagtgaatctaattctctaaaaaagtttaattttacagtcttttggaaatatattggaaactttgttcattagatctctttataaatcaacttacca

SEQ ID NO: 253256 - DNA, 459 bp, Homo sapiens
  misc_feature (403)..(403): n is a, c, g, or t
  misc_feature (410)..(411): n is a, c, g, or t
  misc_feature (413)..(414): n is a, c, g, or t
  misc_feature (427)..(427): n is a, c, g, or t
  misc_feature (433)..(433): n is a, c, g, or t
  misc_feature (436)..(436): n is a, c, g, or t
  misc_feature (443)..(444): n is a, c, g, or t
gctgtggtgtggattccctgctggggaacgtgggagatgaggctgttagggcggcctggggccatttcgtgttaggtgttgaatgctggggaaagaagggcaggtcaggctgtgggaggcttccctgctccccgcctcccctagactcagggcagttggtaccccagttagaatacaaaaacagagtcagtcagtgttatacatgaaacaattctgtaacatttgtgttattgtgatttttattaaatagaggtttggggcccaagggcctttgtgttggtgaggcagtagataatacccccaaatgtcccttctgattggtaatttattttatttatttattttattttattattttttgaggcagcatctccctctgtcgccaggctggagtgcagtgatngcaccanngnnctccagcctgggngacagngcnagactcnntctcaaaaaaaaaaa

SEQ ID NO: 253257 - DNA, 422 bp, Homo sapiens
  misc_feature (366)..(366): n is a, c, g, or t
  misc_feature (373)..(374): n is a, c, g, or t
  misc_feature (376)..(377): n is a, c, g, or t
  misc_feature (390)..(390): n is a, c, g, or t
  misc_feature (396)..(396): n is a, c, g, or t
  misc_feature (399)..(399): n is a, c, g, or t
  misc_feature (406)..(407): n is a, c, g, or t
gctgtggtgtggattccctgctggggaacgtgggagatgaggctgttagggcggcctggggccatttcgtgttaggtgttgaatgctggggaaagaagggcaggtcaggctgtgggaggcttccctgctccccgcctcccctagactcagggcagttggtaccccagttagaatacaaaaacagagtcagtcagtgttatacatgaaacaattctgtaacatttgtgttattgtgatttttattaaatagaggtttggggcccaagggcctttgtgttggtgaggcagtagataatacccccaaatgtcccttctgattggtaatttattttatttatttattttattttattattttttgagatngcaccanngnnctccagcctgggngacagngcnagactcnntctcaaaaaaaaaaa

SEQ ID NO: 253258 - DNA, 469 bp, Homo sapiens
gcagaggacagaaaatcgtgtttcgccacctgctggcgggtaagacctgagcgtgcgccagcgcaggaggaagccgttgggggcctgtgagagaagttagggagcagtgggtgtggggagaggcgaggcgggaacacttagggacacagcaggagcttcttaggtgagcagaaagtaaaaccagagtctccgcagggctccgtggctcacgcaaataatcctaccactttgtggagggggtggcgctcgactgagcctgggagttcaagaccagcctgggcaaggtagcagaaaccgtttttttttctgtaagaaattaggcggccgtggtggcgtgcgcctgtggtcccaccagctcaggatgctgacgtggaaggatcaacccaggaggcggagtttacagtgaaccgagatcgagccactgcactccagcctgggcaacaaaatgagactctgtctcaaaaaaaaa

SEQ ID NO: 253259 - DNA, 210 bp, Homo sapiens
  misc_feature (157)..(157): n is a, c, g, or t
cattatgcccagctaacattttcaagaataaattatttaacacagtccaggaaaaaattagttaatacctggttctgtcaggccacccagctactcgggaggctgaggcaggagaatcacttgagcccgggaggcagaggttgcagtgagccaagantctgccactgcactacagcctgggcgacaagagcaagacttcatctcaaaaaa

SEQ ID NO: 253260 - DNA, 476 bp, Homo sapiens
tatttcattcaagtctaatattttttcttattttggtaaatattaaggattaattgattgattttgccagtgaattttagaccttcattctaatagataaaaattgtatttagttaattacaggcacagtgtcttgctctgtcacccaggctggagtgcagtggtcatagctcactgcagcctcaaactcttgggcacaaccagtcctcctgtctcagcctcccaagtagctaggaccacaggtacacaccatcaagccctggctaatttttttttttttttttaatagagatggggtcttactatgtttcccaggctggtctcgaactcctgagctcaagtgatcctcccagctactctggagactgaggcaggagaatagcttgaacccaagaggcggaggttgcagtgagccaggattgcgccgctgcattccagcctggcgacagagcgagatccgtctcaaaaaaaaaaaa

SEQ ID NO: 253261 - DNA, 905 bp, Homo sapiens
gctatacggcccaggctggtcttgcagtcttggcatcaagtcatcctcccaaaccattggaattacagggttaagccatcacacccagctaaaggtggctcaacagcaaagaatttctttgcctgtctcatttctgggaccacatttgttctacctttcagagagtgaaggccagagctgttatttaccacattgacagaacaaatcaaaataaatggatcatatgaataaacaaatgaactaatgacaagcaaagagacgagccacacagagaaatggaccagaacattaaaaagtcctgtctctacccttggagaataccaacacctaacttatccctcagatgagtccccgaatccggcttgcctctggctcagagcagagcaggctgtgtgctgatgacacaccatgccatcagtcaagttacttgcaacagagccaagctgtcagcccagggtccccagcacattcttagaaaaagttaaatatgtgagctctccataggctgtcttgaggaactggtgtttgtgagctccagaaagccccacatactgcaaggtagataaggaacagtccgtttgagcctatcggcaggaacgctgcctgcagtggagaatgaattctgacgtcagagccctgtctgaattctggggtttgccactgggctccaggaatcagctgcagggaatccccacaaatatccactgtgtaggaggaaacttgctgtctggtttatgggacagaattctaactacatttaaaaaactaacccagttttgcaaagctggtcctctgggcagtatataacaatgacagcattaatagccaatagaacagtggctcccaagggaaggaaaaaagaaagaaaagagacggagacagagattaatggccaaattccacct

SEQ ID NO: 253262 - DNA, 500 bp, Homo sapiens
ggaaggtgcacattgatgccactttgagaagaagtggactgtggtggatttgtaatgtatcagttttgccaagctgaatgcacatttcccagatttgccatctttagatagctctaggttagcctgggcaacaggagacacttggaagatagaattcgagtggctgttacacgcttttgtatactgggaagggcgttgttacagctcaggcatgatcttcatcttccctgacccttggactggtgggtgttttgcttcttgatctaacattaaggttagaagttgcaggattccagcagggttttgtcacatccaatctggtttaagttcccatattattaggaaagctttagggtgcttcaggaaaacgctttttaaaaaatcaaatttggaaaatatcaaatggaattacaggcaataagcataacccagtggaaacatgaatcaaaccctctagagcagggttgtctaaattttggcttccttgggccacactggga

SEQ ID NO: 253263 - DNA, 456 bp, Homo sapiens
aagaaaaccctaaaattcagtacaaatataaaaagaaacataaatatatctcaaattgataacataaaaacagattaagaccaaggacagtggctcacgcctgtaatcccagtgctttgggaggccgaggcaggtggatcacttgagcccaggctggtctcaaactcctgggccgaagtgatccacccacctcagcctccaaagcagctgggattgcaggtgcacaccatggtgtcggcctaagactcgtgctgattaaatgattcagaaccacactgggtgggccagggacacagctatgtcataactcaggaagacaaggcacatacctacctgacctaagggctttaggcgctgatgaaagtggagttcagtagacagcccttttcaagccctacgagaaactggggtttctggaggagaaggaaggtgatgaaggatctgttctcgtgagcc

SEQ ID NO: 253264 - DNA, 440 bp, Homo sapiens
aatacagaagaggtatgctgtggaatccgggagacttcagtttcaaacaaaccaactataaaatggcattttttgacaaaaggggaaatgataagggactagatagtaggtattataactattattttattggatatgataatgatatctgttaaagacacacactgagatatgtgtcagttaaatgataagatgtctagaacttgttttcaaatactccagaaaaaaaatcaaacaaacacaaatcaacaaaaagtaggagaaaagaagagacgagccaagatagccaaaatcttgctaagtgatgaggctggtcccagctgtaccagaagtgcaccatcagagagctgcccgcccagcccctgcacaggctgcacagccccacatgcgacaggctggagcatctcagctcagtgtgtgccgcgctggccgatgtgcag

SEQ ID NO: 253265 - DNA, 687 bp, Homo sapiens
tcttgctatgttgcccagggtggagtgcagtggctattcacaggaatgatcttagtgtactacagtctcaaataccaggcctcaagcgatcttcctgcctaagcctcccaagtggctgggaccacaggtgcatgccaccacacccagctatttaatttttaatgtagtttttccttctgtctctgggaagtacatttccaccttttaaggcatatctttctttctgtgcttgtgttttgagtccaatttttcagcctcttttgagattttgtttactcatgcagtggtagcctctttcctacaaccctgcctttccctcttcactgccttcatttgtaagctacagtgcatgggcattagagtctggacctcagctgaacccaggctttcccacttacaagatttttggcagcggacaggttactttattcttctgaaccttgatttccttgcacataaaatggggataagggagggcaattgtgtcaattaagtaaaaaacatgttaacttcctgacatataatatgcacctaatgatagctataaacattataaaaacaatcagatttcgcttatctgaaaaaagcattaacagaaatgaagacaacgccaacattctcttagctctgttctccctgattattaatgctttgctgcctatcaattatgttcatgggcaaaattct

SEQ ID NO: 253266 - DNA, 401 bp, Homo sapiens
caacccacagaggtcattgcaacatatctctgagcccctaatttacgtagtttgactcctgcctgggccctcccttcagtgatttttgtgacatattttttgactcagcacctaggtaatgtgactcttctccactgcttggactctgtcacagaaggtattgtgatgtatcactgggcctgacacctaggtgaaggtactgtcttctcctgcctgggccctgcataaattgtatattttgacatgtcactgggttcaacacatgggtgattcaactctctcacatggaccttgagcatggggttattaggacatttatttttgttcatctcagtgatatgactcctttcctccctgaaccctgtcaaaaagaaagattgtgacatatcacttaaaccaaa

SEQ ID NO: 253267 - DNA, 431 bp, Homo sapiens
cgtgtaaaatgtgcttctttattaccaactttgctacttattagcaagatagcctttgacaagttttttttttttaaacttttcaaaatcctggctgcctcttctgtagtatgatacgtaagtcctcactgtgtctaaatgcccccaactcttgcggtcttcccagctctaagatctgtaattcttgggttcaagttgtaaattgcaataattggaaatgttgtaaatatgtggccaatgattcagttggcacttaggtgaatcagaaggagatgcaagataaggtgtgtgtcctatagctgtaatgtgaatggaggaatcctacatattttccctcaaaaatactggtagtatcatactgacactaatagtagatggaaggatgagactgaaaataatacaggaaagacagtgtccagggaattaaaaac

SEQ ID NO: 253268 - DNA, 338 bp, Homo sapiens
atctcaaccagaagtctaccatcatattccaccaactaagagcctttcagacccagctctggcatatatggccctttctgcagatggatgtgctggttttatttagcttttccctattgatgtttcatttgttcttcagggatggaggtgaaggagatatggaagcagaaaaaaagaatcaagataatctggccatatgcaagttgggagggggtggggaatggtcttcctactgaaaaatggaataagtatacagcagatatttaaactgattataatatttaaaacatgttgtagtttactgtactctgtgaggctcgtatctcacattttataag

SEQ ID NO: 253269 - DNA, 1332 bp, Homo sapiens
cacccccgattgcaatagcacagggcatttggactgggggaatgatctgggccccgtgagattcctgcagctgggtggtggtgggttcccagccagctccggcatcactagccagctgttacagcactcttgccctgagtaggaagtcgaatgaaagttattacaaagacaactgccaatcactgggcctgcagacccaggcccccacaggaaagtgggtggtccacacccaagtggggcacacagagagggagaggggcagaaagtgtccacaggcttccaacaagatagttgaagacaaccccacacagccacgtggatgggggagaggccactggccagagttctcaaggcgttccaatagcctccttccagactcccaaaacagtcagaggctctctgggtcaccaggcaagtacctacctcttttttgcagacttctgtctttcactgagcacttgcaggaaccagagagcccgtggagggtgcggaacaaaaatgaggactgggtaccagaaggcgctccgtgatcctaagcaagcccgctccctccttggtcctcaccacatcagtaaaatgaggggatggggtatccgatgctttgagctcttgctcagatgcacaggatgacatatttattttccatcataggctggccctggaccccagtccaaggttaaagagaattcacaggaaactcccttcccctagggaagagcagtggtggtggtcccactaataggatgaggcagggagaggggatgcatgggtcacccagaggtggccctccaatgtgtgtgtgtgtgtgtgtgtgtgtgtgcgcgcatgcacgtgtgtgttgtgtgtgtcatgtgcgggaagggaaaggaaggatagaagatcatggtggccatggaggaagtaagctcactcttctgcttttgacagaaagcagatatagctattgggatttatggggcaaacagaccattcctggggttccctaaccccacaagtgtctttattcctaattccttgcccctgctttccactgcattcttccatttagaaacaggccatgcaaggtttaaggcagggaagggtggccctagtgacctagtgcctggccttctggcatgtgggataaatcaccacgattcttcaaaggagagagaaaggagcagggagggtcttcaggcctctgatgctctcttccccaaccccccttttaaaaagaggagggggccgagtgtggtggctcacacctgtaatcccagctgagtcagaggatcatttgagaccagaagtttgacaccagcctgagtaacacagcaagacccgaccactacaata

SEQ ID NO: 253270 - DNA, 921 bp, Homo sapiens
gtgtcaagtcagggtggtcggtagccttgcgcccgcaggagagatatggcctgaagcctgctgcacgtgcgtgccacacgcgtgtggggccacctctgcacatcctgaggtgacccttttgggggggtcgtgatggtcagtgcacgtgtgccggcagggctggtcagggttcatcgcctgcccaggagcctgagcctgaggcagggaggtgctggtgaccgttcccccaaggtggctcacccacagcaccgggaatggaccaggtcgtccctgcccctcagtaagcctggggactggcagaccgtctcttttctggggacacgtatccagccacacatgggctgaccccctcccagtctctgcacccgacacagtttgatcccttctcaggccaatcctgaggctcagggctggcacactgtctctatcccaaggcaagcacaggtgggcacactgcccttgtccttggtccactgtgggactggtcctgtctgtctccagcgcccagcatggcctccacacacctctgcctccagggctggctgggcctgccctcagagtccctgccacgccagccgttggctgcaggcatatcacagataggggatgctgcccagggctccgagtagaccaaaagattcctgcccacagcccaggaagagcaggcaggcaacggcgattccccgggaagggaagggccccggagtggggtgctcagaaccctgggccactgtgctgttaaccaccacctcccggcaatggctggcctcagcgaggccccagggcctccccgcagcctcgcagtgtgcatgtccctggccctctcccatcaccaggctgtggtgggtgtgtggggaggctgtggtacacaacgcaggtaaaataatatgagaacatgcacccagcaccaggggactcaga

SEQ ID NO: 253271 - DNA, 370 bp, Homo sapiens
ttctagggcctttcaggaactccagacagaaaaagggccagttttcaaaagtgaaagactgtcccaaacccactttcaactttccacattccagaaacatttgaagtcaagcagacctacgtttgaagctgcacttgagccatttattaccttgctaccttagtgacactgctcaacttccacaccgatccattctcatctgaaatatgacactaccacttaacctgtggagctactgctgggatctgaaagtgtacctggtatacagcaaatgtgcagtacaattaactatcatgcatgagatttccctaaacttccctccaccactgctaccaataaaattacttctccagaaagcttccctttaatt

SEQ ID NO: 253272 - DNA, 512 bp, Homo sapiens
aatagtccagtcagtcagagctggtgaagtagacttgctgtagaaggtgtgaaggcccagtcctccctccacgtttctccacccttgaaaggtcgtgtgcatgtctgttcacccatgaaagaagaggaagacaccaaatggatggcattgatttcattttaagggctggagatcaagacctacccattgtgatgaataaatccaggctctcagcaatgcagggagaaaaagttttgtctatcaacactgcagcaaccaggtaattctgtgcacagaccaagcacaggcaccagccctggagttcatgtcctcatcaaaggatggaaagaagcaaagctcaaatcagcttgggaaggaccttacctagtgctcctgaccactgtaaccatcatccagacagcagagaaaggatggactcattatacccgagtcaaagtgttgccacctccacagtcatgggccattgttccaggggaaagccctaccaaattaaagctaagaaaaacttatca

SEQ ID NO: 253273 - DNA, 326 bp, Homo sapiens
tgatgggcggatgtcgagggcttggactcaacagtgcctcatcctcgacttcatgccctggatccagctctgcttcattaatctttcccttctagaaatgcttcctcatgcactacttttccaacctcactgcagcaacatgacctctccacttgatgcgcttgttaaaacatacacagaaatagaaaaaagaacccaatgaacttctatcacctaaagtcaacaattttcaacacatggccacccttgtttcatccatatctccctttcatttccccaaccccagacaccatatcgtttcatccataaatatttataaatgcatc

SEQ ID NO: 253274 - DNA, 444 bp, Homo sapiens
gtttttcatggcagcatgtgacaagatgatgctgaaaaatttatatggaaattcaaaggatcaagaatagctgaaacatcactgaagaagaacaaagtgggctgaactcgctctactagatatcaagatttataagcaactacagtatttaggacagtgtagtatcggcactgggagagaaaaaaaaaaaaaaaaactaaaaggaaaaagagcccagagactgacttttgtgtatgtggacagtttgtttatgatgaaagtaccactgctatgcactgtgggaaaatgtcctcaaagaatgacactagggcaactgggtatccccatgtaaaaacaattaaccctaatctcacatcacacacaaaaatcaactccatttggggtatatacttaaatggaaggtaaaactattaatataaagtttatagagaatattgtttattg

SEQ ID NO: 253275 - DNA, 362 bp, Homo sapiens
actgcttggtgtctctgggattgccagccatgggaggaaggagaggcagcaggcagcagggtgcagttggtgcatcatccaggccatcagagagactggtcctgttgctaatgacagtcacagcagctggcgtttactgagccctggctgtgtgctgccactatgctgatataattcttattgcaacactgttgggggtgttttattatgcctactctccagatgataaaactgaagcccagaggttgtgtgtcttatccaaggtcacctgtttagtaagaggctcagccagcatgctaacccaggagggtaacccactgtgcttttcagttcccattaaatctaacactagacaaccactt

SEQ ID NO: 253276 - DNA, 367 bp, Homo sapiens
aattattacatagtaaatcaatattttaaaatattaatccacttgtgtttcacgcagttatacttcccaactgtaggcacaatcttctctgtaaggctacaagcaatgttaatgatcatcttcatctaatcctagctcactatccacacaaaataagacttatgaacactggaataattattccatttaacagttctctgatttaaaaaaaggctttctaattacaagttactgaagaataaaagttacatttttattgatgttagatattaacaatagagattttgaattgtaaatggtgtccatatatttcagtttgtaaaaggcctcaggagcactgaatgccaataaatatcttactgattgt

SEQ ID NO: 253277 - DNA, 429 bp, Homo sapiens
tctcaaaaaatatatatatataaatattatatttggctggagaggtagtttaagagtgccaagtttgtggggaatttggtgctctgattttaaatagggttatcaagaatattcactaaaagttgacacttcaacaaagttctgaaggaagagagggaagaagccatggaaatatctagggtgaaaagcattccaggaagaaggaaaaggcaagtgcaaaaaacctgaggcaggaacaacaaggaagccagtgtggcaagagtggagtgaaagtgaaggagagaagtaagagaaggtatcagagaggaaatggggggccagattgtctatggacttgtaggtcatggtaagcaaggacttagacttttattctgattgagatgaaaacccgttggagagttttaagcagaagaatggcgtgatctgata

SEQ ID NO: 253278 - DNA, 480 bp, Homo sapiens
ccatacactaaaattataagatcataagaatattaattatattctaccaatgcaatacaagcattgaaatggatggcatctgatcctgcttcatgtgattcttcatttagctctggactctttacatcattaaggctttttctttgcaggaatttaaaagcaaccctatgaatataacatttgtcaaaaagagcaagtgccaagccagttgagaataaccttacaatgtgtacaaggattccagttctgctgctatataaaccagcctcaaatagtctgagtctgtgatatcactgggtcacccccatcacttcagtagaaggcctgccactgcctgacatgtgaaagagagcatccaggataagccacctgtcaaactgtcaactttatgcagatatacaagtgacaggtttgagatcagcccagcccagtcaacagagaaatatcccagtagaatcattatataattaaataacatta

SEQ ID NO: 253279 - DNA, 655 bp, Homo sapiens
taaaggcagtaagataaatggtgaactgcttgctgttactttttctgcttatatttaccccagggaaaacctgttttaaaagaaggaaccaagctgctgcttctacatgttgctgagaaatctgctgggttaaatatccaatttcactgcaccattgaaatggatggcatctgatcctgcttcatgtgattcttcatttagctctggactctttacatcattaaggctttttctttgcaggaatttaaaagcaaccctatgaatataacatttgtcaaaaagagcaagtgccaagccagttgagaataaccttacaatgtgtacaaggattccagacggagtctcgctctgtcacccaagctggagtgcagtggcacgatctcggctcactgcaacctccgcatcccgggttcacaccattctcctgcctcatccttctgagtagctgggactacaggcgcccgccaccacgaccggctaattttttgtatttttagtagaaacggagtttcaccgtgttagccaggatggtctcgatcgcctgacctcgtgatccacccgtctcggcctcccaaagtggtgggattacaagcgtgagccacttcgcccggccatagtgtgatcatatgattttttttaataaaatatttttcat

SEQ ID NO: 253280 - DNA, 661 bp, Homo sapiens
  misc_feature (619)..(619): n is a, c, g, or t
  misc_feature (622)..(623): n is a, c, g, or t
  misc_feature (651)..(651): n is a, c, g, or t
  misc_feature (654)..(655): n is a, c, g, or t
taaaggcagtaagataaatggtgaactgcttgctgttactttttctgcttatatttaccccagggaaaacctgttttaaaagaaggaaccaagctgctgcttctacatgttgctgagaaatctgctgggttaaatatccaatttcactgcaccattgaaatggatggcatctgatcctgcttcatgtgattcttcatttagctctggactctttacatcattaaggtaccctgaatatattcagtatggctttttctttgcaggaatttaaaagcaaccctatgaatataacatttgtcaaaaagagcaagtgccaagccagttgagaataaccttacaatgtgtacaaggattccagcttatgcaacatgaaaatggcaaggatgaagacctttatgatgatccatttccatttaatgaatagaagaagtgttatcaattctgttgatggaccccttaatctcttctactgattatcttctacttgaaccagtgccaaattaatgttgcaagctttgtcttgaaatataaacatgcactaaccagtggaaaagcttgcctaagtgattgttgtcataatgacacggattcaatgaataattctattcatggaatttcntcnncttaataaggaaagagtaaacaaaacancannataaaa

SEQ ID NO: 253281 - DNA, 783 bp, Homo sapiens
  misc_feature (741)..(741): n is a, c, g, or t
  misc_feature (744)..(745): n is a, c, g, or t
  misc_feature (773)..(773): n is a, c, g, or t
  misc_feature (776)..(777): n is a, c, g, or t
taaaggcagtaagataaatggtgaactgcttgctgttactttttctgcttatatttaccccagggaaaacctgttttaaaagaaggaaccaagctgctgcttctacatgttgctgagaaatctgctgggttaaatatccaatttcactgcaccattgaaatggatggcatctgatcctgcttcatgtgattcttcatttagctctggactctttacatcattaaggtaccctgaatatattcagtatggctttttctttgcaggaatttaaaagcaaccctatgaatataacatttgtcaaaaagagcaagtgccaagccagttgagaataaccttacaatgtgtacaaggattccaggaagaagtgttatcaattctgttgatggaccccttaatctcttctactgattatcttctacttgaaccagtgccaaattaatgttgcaagctttgtcttgaaatattttcttctgagcatcagccagagatcactgattggttcacaggaataagcagggttactctaaactgcttgaaaaggaaacctcaaaaacaactgatgaaactagaatttaataacaagtgtaccataattcttgaaacataatttttctctctctagtctttcatttttaccaaagacaaatcatgaaacatgcactaaccagtggaaaagcttgcctaagtgattgttgtcataatgacacggattcaatgaataattctattcatggaatttcntcnncttaataaggaaagagtaaacaaaacancannataaaa

SEQ ID NO: 253282 - DNA, 848 bp, Homo sapiens
ggcaccaccttggcttcctgggctgggggaatcttccctcacatccccttcagcatgaacggcctcggctttcccggtgggtaaaacagtttaatcactgaagccgaagcacagggttgattgtacacgctccccgccagccacaggggctgacaactgcctgccccgtgaaactccagtggagacgtttcagctccacaccattcagtatgggagacgccagccccacggggctacggtgcaagcagataactgaatttcgaagtgtaggttgtgtttaatttgaatctgtttatatttcggtagccccatggggcgggtggccacagtttcagtgcagatgtaaatccggaagcctccagcacctgcagctcatagacagctctcgcccaccttctcccaggaccaagccagtcccgtccagtccagtgtctgagcagagtcagaatccacaccacccgccgcctgggctcagaaagttctgctttaagtcattatttctccactgtacgatggggaatgcggtgtgtgggggccatttacccaccaacacagcagctgtgaggcacacacggctattgaaaattcatggaaattgctgggtgtggtggctcatgcctgtaatcccagcactttgggaggccgaggcaggaggattgcttgagtgcaggagttccagaccagcctgggcaacatagcgaaaccacatctctacaaaaaaatcctccaaaattaaaaaaattagcccgagcatgttgttgcatgcctgtggttccagctatcaagtgatccttctgccttgggtttccgagtagctgcaattacaggtgcacaccaccacacctggc

SEQ ID NO: 253283 - DNA, 395 bp, Homo sapiens
accttgggtggtggcactggagatgtttgcagcagcagtttttgaccccattttctgggtcaaacatcccaaggaaggagaggccttaaagtcaaaggagcatctcaggattgagagtcaaggaaaatttgatctttgttatgataatgttccctccaatctacagttctcaaactttctggtctcaaaccttcttaatgttgaaaattgtcttcatgggtatttccatcagtatttgttatattttaaaactgagaaaaatttaggccagggatggtggctcgcacctataatcccagcactttgggaggctgaggctggaggattgctgtagctcaggatcacagaggaggtgtgatggcacctctgcgcaagagaatgtggtcctgtctcca

SEQ ID NO: 253284 - DNA, 630 bp, Homo sapiens
aagccctgacaattttgtgagccgatttcttaaaatctctctctccctgtctctttttcatatatgtgtgtttgttataataaagaataatctggttttgtcccaggtgcctagcataaaacatcagaagcctttagaattttgtgttaggggtgtctctcatataacgaggtgaaaaagagaaattacttctcctatgttaggaggcagggataaccttgattctaaaatctaataaggacaatattagaaagaaaaatcataagccaatctctttcatgaacacagatgcaaaagtcctaaacaaaatatcagcaaagttaatccaataatatatgaaaagcatccgccaggcacagtggctcacacctgtaatcccagcactttgggaggccaaggcaggtggatcacttgaggtcaggagttcgagaccagcctgtccaacttgatgaaaccctgtctctactaaaaatacaaaaacttagccgagtatggtggcaggtgccttagtcccagctagtagaaaggctgaggcaggacaatcacttgaatccagcaggcagaggttgcagtgagctgagatcataccactgcactccaacctgggtgacagagtgagactccatctca

SEQ ID NO: 253285 - DNA, 355 bp, Homo sapiens
tatagtgcagaatagtatcgtatagttgtataggacagtacagtgtagtcacagagctgtatagtgcaaaatagtactcatatagttgtatagttgcataatgccgtatactatacagttgtacagtatacttctatcgtgcagaagattttaatatagttgtatagttgtacaatatagttgcatagtacagtatggtatgtagttgtatagtgcagaatagtatagttgtatagtgagctgtgggaaatcactgtgggaaactgcatggaggggacttaggatctctgtgtactatttttgcaacgtcctgtgaatctataatcatttcaaaattaaaagttttaaaaaaatt

SEQ ID NO: 253286 - DNA, 473 bp, Homo sapiens
caaaccacacacaccccaatgcatcaactacatttcttagtcaggtttattgaggcataaatttacccttattaggtgtacagttgtgcaaattcatacagttgtatgaatgttgaaaaacttgtatgctgtggtggtaagaaaccaccagaacacattgacactatccaaaaaatcttttattttgcccctttttagtaaatgctctacctccatccgtagcatctggtaacccctgatctgatttctgtctctatatttgtgcctttttcttgagtggcatagaaatggaatcatataatctgtagccttcccagttttctgccattgtcatgttcttatctaacgtaccaggttttttggctcatctttagaaatttgcctttctaaaagcgaagtctttctaaagcattcactaatttttgtttgtttttgtttttggtttttgagactcttgtctcaaaaagaaaaag

SEQ ID NO: 253287 - DNA, 365 bp, Homo sapiens
gtcccaacagagacagacaaatcagagatcagcagcccttgaaaagtgtccggtgcaacaatgagcaatggggcctgcgacatccccaactcttgctccccaagaaagctgtatccccagtcagtccccctcagcaccggccgaagacacccagtgcctccagccaccatcaccactgaccaaggcactgtctttttcagggaggtatctaatttggtcagtcacaaattcctttttagccttccctagagaaaaacaagtcaccaagaaaaaattcactctatgtagaggaaaagtattttctctcatgttagtacacgcagaacatttaatattccacaatatatacggttttttattcataa

SEQ ID NO: 253288 - DNA, 298 bp, Homo sapiens
gcagcttcagacactgaagacaagtgacaagacgcctgctgacgacccaaaggcatgcatgggttggtttctggtcaggggagccttcagcaggagcacatgttcctgttattccttccatacagaggcatgtgctgctttggtaaatgacacctagtgagtctgtggttggctgtgttggtggctctgcatctggggagcacctgaattaataaagggcctgtgaagctttgtggcacatgctctgtgatgacccagggatgtcagaaactgctcccagcagcaggaggagagttat

SEQ ID NO: 253289 - DNA, 348 bp, Homo sapiens
catatgtatatacctaggaaaccatcactacaatcaaaataatgaagattcatcatccaaaagtttcctcaggtccctgtgatccttccctcctgcccctgtctgccccacctcctacaggcaaccagtgatctgctttttgtcactatagattagtttgcattttctaaaattttatataaatgactgactggcatctttctcagcataattatttttcaaaaagaacatttaaacaaaatagaccatattctgggccattaaacaaggcccaataaatttaaaaggatttaaatcatgcaaagtatgttctctgaccacaatggaattaaatattagaaatcaata

SEQ ID NO: 253290 - DNA, 414 bp, Homo sapiens
cagcttgccatgcactgaggagcgactccacaggaactgctgtgctcacaggtttctgagagaacaaaaagcagagtcctcaggtgaaaagtatatagtttgatatgctcaggacaaagactggcagcctttttctatcctgacaagagcttctggtccagagggaataaagcaatcaggcatctttagaaagtcagtggtaactaaattacactttttgaaacagaaaataaaatacatctcacacaatttttagaagaattaggaacctgagatactaaaacatgcaattaatagaatatattcattagctcagtactcatgctaattcagttgcaaggatcaaggtaggggtgaggaaatgatagaggaagaaatctgaaggggagagaatgggagctcaggcagaagtaa

SEQ ID NO: 253291 - DNA, 418 bp, Homo sapiens
ctttggtgtggggaactcttgatacctgccaacaagaagaaagtctttggtccccacttaactttctcagaaaccacctggcagaggtttaaggataccttattgcaacttcaggaaggtggaagtctaagctctccactcagcctttgcttgtgttcgggtggggtggggactaggtttctgtggttttttgactagagtagaatagcaattgtcaaaaagtcttcttcctaagctacccctttcttggtcttttggctacaaagaacaagcttttttttcttggagtttttcttggggagttgggtggtggggaggtctgagtgatttggtgtttctgcgttgctgagttatttggctccaagtctgagatatatgaaataaaaagaaaatccagagaactcatcatcacattatt

SEQ ID NO: 253292 - DNA, 783 bp, Homo sapiens
ttgaaggtaacctaaagaagaggaagagctgcagctgtgcctctgggccccaaaggctttgatgatgcatagatcttagaggttgtcagaatgctcagccaagcaggtgatcacagccaaggtcacgatgcagtcagcctctcctccactgctcctcctgatgaaacttcatgggaaagctcacggggggagatatttttggatggtgttttccaaacatttttacatactgtaactgatactactttataaagggctttcacattcaaccatgtaggtagttgactatgcctcaaattcagaaaaatgtacagaatgatacttatacattaatgtagatgcaggactgcagagagattctaagcctttgtgctataagagagagaagtcctgttatttaactatatcgttggagtcaaggtggtagatttgctgacctcctgcatcagggttgtcctgtccttggctattcattctgtattcatatcttcatcaaatattttttgaaaacccatttactgtgtgccagatgttgtgtcatagactggaaatacataccacgatgaacaagatcaatatggtccccagctttgtgaagctcacattctagtgtagaatatagacaagtgagcaaacaattgcaatatactgtaaattggagaaattcagaatatagtaaaatactgatattgcctaacccatacctgaaaaaaatgatttgtaaaatttccatacacttgtaccttgatttcctggggataacacttacgtgttcttcattac

SEQ ID NO: 253293 - DNA, 474 bp, Homo sapiens
agccttggaggtcctagaatacaacttctgctccatcctgttggtaaagcaagtcattgtgatcagcacagattcaagaaatgggagattcgactctaactctccatgtaaagagcagcatgttcatgcagggaggaaagaaattgagggcataatcttgaagactatcatattacaccattattccaactaatgaacattatgttttagatgggtagtactagctactcatctctcccccagaaacccaagctaagcatggacatattgaagagaatgtcaacaccattaaaaaaactctagaaaaatcacatgtgatgactgaggttaattcagtctgtcaattacatcaatataattccctcttgtaaccctaaatatggtgaagcagaattgaattctacaaaagtctttcatctgttttcctatggaataattaacaaacccaataaatgtataaatagtatgaagtcc

SEQ ID NO: 253294 - DNA, 570 bp, Homo sapiens
attgaaacggtgtccacactcccatatttaacgcaaccccatttactatagctaaggcttgtgtccatcaacagatgaatggataaagaatatgtgctacatacacaacggagtactattcagccacaaaaaagaatgagatcctgtcatttgcaaacacgtggatggaactggggtcatgatgttaagtgaaataagcatacaaagacaaacatcacatgttctctctcacttgtgggatctaaaaatcagaacaattgagctcatggacacagagtagaacgacggttaccagaggctgggaagggttgtggggggctggcagggaggtagaagtggttaatgggtaccaaaaaaaaaaaaaaaaaaaagaatggataagacctactatctatctgacagcacaatagggtaactgtagtcaatagtaactgcattgtgtattttaaaataacatataagagcgttaactggattgtttgtaactcaagggctaaatgcttgaggggatggacacccattggagaaataaagagggaagtaatgcttccttggaaggtgttagaggca

SEQ ID NO: 253295 - DNA, 424 bp, Homo sapiens
tactggggatgcctatggactcgagctgcttgttaaagaggaactccccactgtgttcagaaatccttcctcatgtcctctctccccaagcttcccatcctctactggctcagtttctagcatttcagtatcttctttcctgctaaagaacttgtccaagtaactagtgtaagtgttttccttctcaacttgttcatccttccttacctcacaaaactgatttatgaaaaaacagtcctccccaccactcacaaactggctgtcccaagaagactggtacaaggcttctaattgagccagatttgccattcctttttcctgtttttcttgggtactacgctttggcatgccaaagcgtagtccccaaagtaatgagcaaaaaagtttcagagtcaagtgtaatgtttacttcctaaacaaagca

SEQ ID NO: 253296 - DNA, 429 bp, Homo sapiens
cggggcctgctcgagtgaggccgggagcggaccgcagcccgctggaggtgccgggggcgaaatgctggcgtctcctcctccgtctcccagaatccttccctggaaaaaaacagcatccaccgtcagtttaactgaggaccgaattaaggcattaggaaagacagtggaagttatttcatttgtttaacttaagggggtaggatcccgggagccagggggattcaggtcattgtcatgttttccactgttaagcgaatagcattatacacagctgcggactgtggcaaaagacattttaaaaactattgaagtctactacacatacagaaaattgtacctattagaaatataaagcttaataagttttcatcaactgtacacctcacataaccagcacccagataaggaaataaccagataacttcttca

SEQ ID NO: 253297 - DNA, 428 bp, Homo sapiens
cgggaggctgagagcattcatgtcctcaattttttacccttccctgtctgcaagccgtttgccatgtaactttggagttcttcccataaaagcacagtatttatttccctactctgcagggcttgctttggcatgcagaatgaagcaaagggtcagtgtgccagttctgagcctaggcctcaaggggcattgagcgtttccagggctctctcttgagcctctgtcatagatatgaaaatgcacccgagccagcctgttggaggtgagagaccagggagcagtgcgcgatctccccagctgcctctgccaagggtggcctagatcagccaacagcccgcagcccctcacacgtgatgtgtccagcccaaatcagcaaagctgcctgactgacccgaagcacagaagtggtaaagtttattattgtatgt

SEQ ID NO: 253298 - DNA, 534 bp, Homo sapiens
agagtgaattctggcaacacactgagtgatgcttgtcaatggccactatcaggaatttaaaacaagatttggaattatgacatctggacaaacacatatgcaaaacctaccttttggtccattctccagggcttcttctgcagcttctggttccagttctttttcggagctgtcagtgtgtgttttggcctgtccattaactgacatcatattacttggtacagttgcattcacttttgatgatgtaggcaaggaagacccagccactactacttcctgttgtttctgtaatgctgcctacaaaccaagagaaagtgaagacacactgaccaggaaggctagcaaataagacatctgccctggagtacatctgataccatgcttttgccctaccaaagtgctatgctcaagaaattactaataaatttttatcagtttttatcctgtctataatgaatattattagtacaatatcaaactgacagctaaaaataataaaaaatcaataaaaattaatgtggacaaaaacctgca

SEQ ID NO: 253299 - DNA, 654 bp, Homo sapiens
attatgttgaaattctaatatctctctcagctcaactaagtaactttgatcataggtgtcatagaaataattagttggataggtggaaagatagattaagagcccaccaagttttatgtctgttattattgaggatccattaaccaccagttttccacgtgaagtgttttcattgtgataaaagcctccatattttttagtgaatgcctgatcattttccaggcacaagacatcactatttccactagaagacagtaaaatatttctgaacaaaagaaagagtggagactcccatgtaatgggttcctatttatttttaaagtaatcgatagttgtttgcaagtaattgcaccgtgtaatctgtaagtaaggtaagactgaaaacacacatctgagtaatcacatggtctaatctgttcaaatggacagattatagatgatcctgagacctctaattttggtaaattgtcattgtgacccttacatggctggctttgtactgtatgttccttgtgaatttcaaaggaagtgtaaacttccttgaactactcaactactataatgattgaagttaagtactgcattttctatagaaatcaatgaagctaatcacacaagcacagctcaacatatcccattcagcagtcttgaaaa

SEQ ID NO: 253300 - DNA, 535 bp, Homo sapiens
atttccctaaaatgtgtaacagattacccagttggcaaatgatgatatatattttttaaacatgaatatttctgttaggccagatggtgatttaacatgaattgtccaacatttgtgtttcttatcaaattgtcttcttttgtctaagccaagctagcaacataatttggaacacactcaggaatcactaaaggacaagagcaaaaaaaattcagacaccaagtggcagacggcatttgctccatatgccatgcaaaggctcctggccagtgctcgcatggcccttgggaagctttctcacccgttgtaagaaagtatctgtgcagtgctgtgcaacccatctacctgctttcctctctctactcccgaaaccctagcttatctaacactttgtactgtggccttcctccatgggggacttgcacttcctcaaagccctggatttctgtgcagaagagcagttttagttcttccttaggcacttccctttcctcctgtccagtgtcatgttcttgtttgttatgggctccaccca

SEQ ID NO: 253301 - DNA, 463 bp, Homo sapiens
aggaaatattttgcaaatcaggaaatgacaccgggcaaggcctctgctctccggggctacggcctcccacaggcacgttcctacatccctctgtgaaccgcccacaggcccccccacaggtgttcctctgtgagctggtcgggcggccggggccggggccgggcttcgctgctccgtgccttccacctccctggcggtgcggggcctcagggtgggcctgggaagctggaaacacctttggaaacagccgcctgaggcagctgtggacagaagaccctgcccagcagccaagggagctggcctctccgctcagcctccccacccccaccaggcccagctgttgttttcacggctccgggaccaggcggatcctcagccaagagcttcccaggagagccctcatcttcaacccctagtggcgaccagagccagcccgggcaggaggggaaggaaggcggccgcg

SEQ ID NO: 253302 - DNA, 460 bp, Homo sapiens
gaatcgccccttccttgcttctcttccgccggccaggcctctgctctccggggctacggcctcccacaggcacgttcctacatccctctgtgaaccgcccacaggcccccccacaggtgttcctctgtgagctggtcgggcggccggggccggggccgggcttcgctgctccgtgccttccacctccctggcggtgcggggcctcagggtgggcctgggaagctggaaacacctttggaaacagccgcctgaggcagctgtggacagaagaccctgcccagcagccaagggagctggcctctccgctcagcctccccacccccaccaggcccagctgttgttttcacggctccgggaccaggcggatcctcagccaagagcttcccaggagagccctcatcttcaacccctagtggcgaccagagccagcccgggcaggaggggaaggaaggcggccgcg

SEQ ID NO: 253303 - DNA, 699 bp, Homo sapiens
acacacactccgggctcccatttgggcaggcagggcctcagccaccgggaaagaacgccaagcagaggtccccacagccaccctgcagctcggctgcacccaaggagttcaggcccctgggccagtggagagctgtggtagagactgcaggaagagggaggctgctcctggccctcaggctgggggaaggggctctgggggaaggggtgtagaggcaccctcagggtgggggcgggcctggggacccagggtcctgaagtggaggggtttcggtcagggacaccatgctgggcaaaagttgggagagattcatggggtccaggtggggtcctgcccctgcaggggctagaagggctgggcaaaggccaactgtatacctggggccttgaggaggggaaccctggctgggggccccacctccccctcatttcatgcccccctcctggcttcccagatggtggccgataagggagctgcttaggatccatggaaggggccaggcaagaacccgggggaagaacccaggggcctcaacgcagggcccgttctgtcctagggggtggggcccctgccttccaacgtggggcctcttctgtcctgggggtggggcccctgccttccaacggagggcctcttctgtcctagggggtgagggggtgagggggtgagggggtggggcccttgccccgggactcgggc

SEQ ID NO: 253304 - DNA, 445 bp, Homo sapiens
caagggagagctgtgtccccgccggcgccccccaccccccctgccggggatcttggcagtggaggtgctggctgcgctccacagacctcagacctcggctgggaccagaaatgcctggtgcttccgcctgggcccggtggggggactttgggtccccagagtgcaagctgtaccacttcgaggggcctcgccaggccccccagcccccagtacacaggggctgccgtggagatgacgctgaaggccgcagccgctggaggacctggggtctgaccggaagctggctgcagaccctgcggaggcacgtccagaggcccagctgttgttttcacggctccgggaccaggcggatcctcagccaagagcttcccaggagagccctcatcttcaacccctagtggcgaccagagccagcccgggcaggaggggaaggaaggcggccgcg

SEQ ID NO: 253305 - DNA, 646 bp, Homo sapiens
aggaaatattttgcaaatcaggaaatgacaccgggcaaggcctctgctctccggggctacggcctcccacaggcacgttcctacatccctctgtgaaccgcccacaggcccccccacaggtgttcctctgtgagctggtcgggcggccggggccggggccgggcttcgctgctccgtgccttccacctccctggcggtgcggggcctcagggtgggcctgggaagctggaaacacctttggaaacagccgcctgaggcagctgtggacagaagaccctgcccagcagccaagggagctggcctctccgctcagcctccccacccccacctggcccggctcctgtctgaccaggaaaggcatcaaagccggactcggatggaggctggaaaaccccgagacttctgctggactcgacccagccacacaccaggctgtgctcaaggccacggaatgagccttgaccctggccccagacggagcccagaccttgctggtcacaggctgagccctgctggcaatatgatgtactagatcccttaaaaggccttccagcaacaaccaacttctggatgaattactatgagcgtacatttttaatagactgttgtgtttccaagaaagtaaatatctccgagtctcccccaa

SEQ ID NO: 253306 - DNA, 348 bp, Homo sapiens
gtatttatggagcatctgctgtatatcctgggcagtgttctgggccacgagaatgaagtcatcaacaggtcgttgtccttataagaaggacaaccctgtggggattctacaactcattcttcagacaaaccttctggaagcctacctacttttattctggtgtttgccctggtagcaatttaactgtcactttaagaagacgcgaatggggttggtgtctctggcttttgagacttcagggcacccctttcttggagagaaagatactcctttatcaggccagagagctgaagacctgttgggcttggggccactccctttaataaagaaacccacatcctatttgct

SEQ ID NO: 253307 - DNA, 346 bp, Homo sapiens
aatcatggcatgacttgcttttggagaagcctctggaaactcaaaatcatgacagaaggcaaagtgagaacaagcacatgttacaagactggagcaggaacaagatgctacacacttttaaacaaccagatctcatgagaactctatgatgagaacagcaccaaaggagcaatctgcccccatcatccaatcacctcctaccaggtcccacctcgaacattggggattacaattcaacaggagatttgagtggagacacaaatccaaaccatatcattctgttcctggttcataccaaatcttatgtccttctcacgttgcaaaatacaattataccttctcaaca

SEQ ID NO: 253308 - DNA, 443 bp, Homo sapiens
catgcatgcatacatgcacatacacgcacaggcataaacctcaacttgactgaaagacatacactcatgccttttcctgggcataaatactatttgcctcagtctctactgatacactacacataaaatttggtactggataaaagattagaacacacacacacagataaaaaaaatcagactcggagatattggaactctcagatgataattttaataattgatatgctaagggatctagtagaaaaagtagacaaaatgcacagaccctggagaatttcagcacagagataacagtcacatgaaaatgctagaaacaaaatacatgatatccaagatgaatctctttgatgggttattgcgccaattggatagcactgaggggggagtaagtaaatctgaaggtaggtcaatagaaattaaccaaactgaaacacacaata

SEQ ID NO: 253309 - DNA, 6453 bp, Homo sapiens
  misc_feature (128)..(128): n is a, c, g, or t
  misc_feature (1102)..(1102): n is a, c, g, or t
  misc_feature (3170)..(3170): n is a, c, g, or t
  misc_feature (3613)..(3613): n is a, c, g, or t
  misc_feature (4208)..(4208): n is a, c, g, or t
  misc_feature (4569)..(4569): n is a, c, g, or t
  misc_feature (5600)..(5601): n is a, c, g, or t
  misc_feature (5614)..(5614): n is a, c, g, or t
  misc_feature (6345)..(6345): n is a, c, g, or t
tgtaaatattccaaatctgattcaatacagtttccctttactgtaccctccactggttgaatttcctgcccttgcaggagaaattttgaaaaggagggaatgaagtttttaaaatcaagcagaatatnttgaattaagtagttttttatttcagagacttctagaggggattagtacagctttgagccacttttctctatctctaaatctaaagttcccaggatactatttctaagatgaggactctgagatcttataagctgcttagtcattccaaagagatgcaatttttcttattgtactagatttactaagacagaaaagtagactgattcattacacaatagaaagaggctgactgcctttggaaggagtacttttccttctaaaatgcttaatccatcctattgtcaggctaaaaattgtgggagatggcatttactgggccaccctgattcttctgtagagtagaacctggaaggttttggtggctaaatgagtacctctaaacaggtgaagatggactgtgtgggtgctaagagaaccccaactgctgaattttgaacatgatgggcatcttttatcactacaagcccttatggttagtaggaaagagataatagaggcatcaactgtcccatatcccaaaggtatcctgctaatgagccatttttaatgcacatgctaagggttgccagttcttattttggagagattttcaacaagaattgcaaccagaggttaaaattagaccttgggttactaaatatttgtacgacatccatccaacaaagcatttatcagtcttcatcaggtgctaggtacagtgccgggtgctgggatattggcaaaaatgataaatatttgtcattaccatcctattgcttgctgaataaagtgggttgcaggtaagtaaacaagataatgtaacagtgagttatgtgttatgataggagaaatacaatgaactataataatacacagaagcgagttgcttaatttttacttgagtcaggtaagaagaggcatttacatgaaagatgaataagcaatagacagaccaagaggagttggggcaggaaagagcattctgagaaaccantgtatacaaaggtccagaggaaaaccataagaacattttgtttggaacatacagcttttgggaagaaagggaagtggctagaaatgaagaaagaaaagtaaatagggtccagatagttagggttttataggcatttgggctttattctagaatggagagtcattaaaagcttttccagcagagaaatgattaaagatgcattttatggtaaggactctggctgcattctggagaaagttggagggaaataatactgggtagagtgggacaaatgaggagactgtcgcacatgttttcatagaagaagatgtttgcctgcatttgacaaatgataacattcttcacagctagtgcttttgtgtttggtgcactagacgttaaagttgtatactcttaatttcgtaaaatccatgtgtttatactgtgctttaactcaatgtttcccatattatatttctttaagaaaccatcctttttttctccttctcataattttataaaatatatattttttgcttcctgaatattctgaaatgtcttgtctgttcttgacacatgtatcttttctacattttgtcactttggtttctttttcaaatatgcctatagagagctcatgttgaaagagaagtaattatgtttctagtgaatagatcttggcatcacaacaggatagtctgagatttcctggaaagagcagtagaaagaaatttagtggttctcagaactggaaaaaaaatagcttaaagataaatagtgttcccagagggaaggaggcttgttgtatagcaatcaatatagtaggattagaaaagaccaacacagttgaaccccaaagtacaaaatgtaattaagggcacaaaagacacataatgcatgtcaagtttaaaagagaagctgagcaattacagagtgaagttcagaacttaaaagtgacagaaagagcaaagggggaaaatgacaaaaacatttcatgtaagactaaaagtgctgcaatcgtatatgtgatacaaaaggtcagtgaacagcctagaaaggtgtctaatggatagcaagggtaatccattgactggaagggtcttgtagacattgatttcaaaaagtaaaattaaatgatttttttttttgcctcagtgctctcaaaaagcaaagtcttgctaaaaagagaaatcaatttaaaatgaaataagtaaaattgttcattggaaatgttgccaatcaataggtggtaaagaaatcaagaaatctgaattctcatacagagccagccagatatgttttcttccaggattaatgctgtcattgtccaaggcaataattcatttttaggcttagaaatcctttctaagaaaatattatgtttttatgtttttgttcccaagtcaccaaattgtagcccattttaatgcttttttggctttctgtgtgtctgggtgtgacacatctgacccatacaggaggatatgtagaagtcctggcaaaagaacttcctaacctattaagcaatctctcctccctccctccctcccttcctttctgtctctctttctctctttctccctttctccctttctaactttctctctctttccttctctctcactttttctctctctctctgtcttcctccctccttcactcccttccttccttctctttttttctttccttttctttttcttttcttttcttttttttttctttttttttgcgacagtgtcttgctctgccaccgaggctggagtgcagtggtgcaatctcggctcactgcagcctctgcctcccagcttcaagcgattctcctgcctcagcttcctgagtagctgggattacaggtgcatgccaccatgcccggctagttttttgcatttttagtagaggcagagtttcaccatgttgcccaggctggtctcgaactcctgacctcaggtgatccgcccacctcagcctcccaaatgctgggattacaggtgtgagccaccgcacccagccttttttcttttctttttgaggaaatggtcaaatgtgcttgttgttatgttaagtagagatttggaagaatgcgcantgtttactctgaaaattgtgggagataaaatttcctaagggaacaccaatagttttttcttaattgcatattaaaggcaatattcaaagaaagggtaaactggatgcagtagtagaggggtttcctgttagcctctcagaaagatttagaaactaagaaattctgactagctgttgtaacagacaaaccctgaaatctcagtggctttagcacaacagacatgtatttcttgttcatatcacagtctaatatgaatgggggatcttccttcattttgcagccacactaagggcctctgcgataagggtagacaaagatggaagtggctgcatagctcatagctgtcttggcctggaaccggccttttccctctgagccagttacatgaccccaacctaactgtgaggtagcctgggaaaagtaggggagtacctgggagtaantaatttgacattaactgtttttgccactagaaggaagttagttactgattctgtgctctatttccattgttcctggggagataaggaccctcaaagatggaggaggtagaagaaggtggtactgtctgtggtggaggggacggaaactgaaatatatcacaggaagtgacgagacccatagaagtgaaactggaaaagctggcctgaagtggtgtgcagaataagggaatggctgtaggttcaccatttccatgtaacctacaaagacaaaggttaactctgggactactaattatgctgctttaaatgtaatcacactgcttcaaatatattacattaaacgtacctttttggatatttttccattaactttaaacattttctaaatatacagaaagattgaaagaatagtacaatatgaacgcttgtatactcattaccttcgttcagcggttattcatgttttgccatatttactttgtatagctatttgtaagtatgtgaacttttttccgaacaccttgaaaatatgttgcagacataatatttaccataatatttcatataactgcaatgccatcatcatatctaaganaattttatattcatattatacccacacacatgataatataaccaatttatattcaatttatattcaaatttccccaattatctaaagatgacatttatctctctcattctctctctttttttcaaacaaagttcacagattgtattcatgttacatttctctagtgtcttttaatctcaaaatccctttatttcttttttatagcatttactttttgaagacatggcaggacagttgtattgtcccacattctggatttgtctgatttcttctgcatgctgtggttctccttgttcttatactctttggatttcttataaactaaaatgggtctaatggcttaattagatttaaattaaanatttttggctaggatattccataagtgatattcttatttcatgttacatcacaacagaaggcatataatgccaggtttttcactaaaatgatgttaaatttgatcactttgttggtatggtcatcaccaaatctcttcattgtgaaggtttatttttcactttacaattagcaactaacttgttggttaataccttagcaccttgtgagtatctcaacaatctttcacctaaatattttaaaatgcattgacgatctttgcctgaaataattatttcattgggaggtataaaaagtgtgatttttctaatttatatcattttttctatatttagtagctgacattgttctgtgaagaataactttgcctcatcaactgggactgaattacatttcttcttaaagaagcaggatatatttataatttaaaaaaattataggcaattttgaatatagagaaaaaccaaaatcatcagctgtaatttcaacagccagtgaactaatgttaaaaatgctatgtactatatctttccattcttttttcaatacagataaggatatatattataaaatttgattcataaatatatctagccttataaagggctggatatataaaatacattattaacactttacaatgttgttaaatatcctttaaaatatttttgctgactacatatcattccataacaacaatgtgacatactttattttcgcattctcttataaccagggaaccatataaccttgtttgcccagagaaatcctgatatatgaccattatcctgaaaaattaataaaataccctcctttactcctcatatcatacaagtttgggaaacaaattgtatggttacctttcctgtaatcacttaatctacaattgacaagtagctgttttgaattttccaatctatttgctcttatgaaaatttttgggtgcattcatgagggtgaattcaccctcatgttgtattagttcattctcacactgctataaagaactacctgcgactgggtaatttatanngaaaagaggtttnattgtcttatagttccataggctgtacaggagacacgtctggggaggcctcagggaacttacaatcatggtgtaagggtgaaggggaagcaagcacatcttcacatggcagcagaagagagagagctaagggggaagtgccacacacttttaaacaaccagatcttgtgagaactcactcactatcatgagaacagcaaagaagagatctgttcccaggatccaatcacctcccacgtggtcctttctcaaacactgcagattataattcaacctgagatgtgggtggaaacatagagccaaaccatgtcacttgtatttctgttaaataagtagaatgtcatcaattggtcttaacagatttatctgatttcaactttgcctactttattcccttggagaagggtttctcaacattgccactattaatattttggcccagaaaattctttgtttttaagagggctgtctgcattgtagtatgatttagcagcaaccttggcctctgtttcttagatgccagtagcattgccactctccggcgtagcaatcaacaacaactccagatattgtcaaatgtcccctgtggggcaaaattgcctcaagcgtgaaccactggtttaggaaaatgtgcaggaataatagcagcaacatccttcacatctagcttatttgtcttaagttgttgtgtttttgttgtaagaattgtttaggctggggatggtggctcangcctgtaatcccaacactttgggaggccgaggcgggtggatcaactgaggtcaggagttcaagactggcctggccaacatggcaaaactccatctctattaaaaatac

SEQ ID NO: 253310 - DNA, 497 bp, Homo sapiens
agaatctctgcagaatgtatgctagctgactagattgtgttctaaaatgcttcatgtgtaagagacatagtctcctgtgaagtgagaagctgatgcagaaaagaaatgccaaggacaaacaaatgcaaatttttctgctgtttttctgatttgtaaacaatgttgtcagaagctgttccttaaatagtttctcatgacacaaaacatgctacagtgctgcttaaacatgtgcactaatttggggctatattttagttatcatggattaagacatatgatttaatggaattatgaatatttgattacagtggcatttaaaattaatctgattatattttacagaactcaatttttctatttaaaaaaggagatctaggatgggtgtggcggcttattcttgtaaccccagcactttgggaggctgaggagagaagattgcttgaggccaagagtgtgagaccagcctggaaaacatactgatatcctgtctctgttta

SEQ ID NO: 253311 - DNA, 453 bp, Homo sapiens
aggcaaagccagaaagccctggcaacccaaaactgaaggatctggggctttcttcctgcaagctctgctcagcgaggggcttgtgctcctacaagctctttgctacataagtcaagccaaacttccatttcccgacatgacatggccaaataagagaaggccaggttaccagagattaaaaataggacgttgctgcagagtcctgggaccggctggcaaatgacacaggaactttgggagcgcatggactcaggccaagcggccgtcctcaccctcggccacctcagggcagggacgaagagtaagcccagcctttgatgatggggattagtcccaaaattctggagttcaccactcctcccgctacactggctttatttcaaatctctgttggtccatgtcaacatcagcgatgggagttgaaagaagtaaaacagtgactcgtgcaaaaaa

SEQ ID NO: 253312 - DNA, 315 bp, Homo sapiens
ggaggcattggatttaatcgaattttccagattaatctcctgaattgtgctttatttataagctttccctgaaatcatgtgtatgtttttatcatattctatggctgtcaagtctgaagtcagcttgttacccctaaaagagtgaattaatccgaagtgttttcttcttggccttacaaagagcggttcacttgtcacaaggcaggacttgttaactcagccagatttgtttcttaagcatctgcagagagatgaccaagataattcattttaaatcaccaaatattaccagacaggaacagtttaaaaggcaaa

SEQ ID NO: 253313 - DNA, 231 bp, Homo sapiens
acacatttagtttttaaaaagtcagtttcacttcatgtcattgaacaagaggtgtaaattaattttatttacttcttaactgttaaattaactattttcaactttctgtatgattaactggaaattacacatacagcaactctgtcacatactaatggttatctcaagaaagagtattagtgcaattctttgaattgcaagccaaattagctgctttattaatgaaacagt

SEQ ID NO: 253314 - DNA, 483 bp, Homo sapiens
tctagttgatgcttttttctcccctgctggttggatgtcatcacctgctcagattctgtaacccacagttggaaaacacagagtagagtggggaggtatcatctgatgcccattttacagatgaggagcttgagtttcagctgggccatattctagctgggtaactggccagttacttaccctccttgtgcctcggtttcctcatctgtagaaggggagtgacaacagtggcaggagtggtgtgcttgtcgccaagcctggcacactgggagcccatggaccagtcattattcccctgatcctcagccaggtgccatcaaattcttaagtgcttattcatggccaaacaagaaagaagggggcaatcaaaaccagccacatcacaccatctccacagctgccatttttagctcggttttgcatagcttcaccaaagctcagtttatgttagggctttgttgccccaagaacattttaaaaaca

SEQ ID NO: 253315 - DNA, 438 bp, Homo sapiens
cattagctatagctggggatagcttgatttttctcctttcataatggacaaatcattatatacagaaatctaaaaaattctgcagacctctttatggcaagaatatgaaatcctgcttgttttgtcttgtcttttatgctactcttctctgacaagcccatcaccataaaaatggctactgaactgggaatattttcaaataaattaacttcagtgtattttgtttatacttatgatttattcaagatattgtactaggaagtgcaaggtgacagtgatatgacatctaaagtagcttaaaatttagcagagaaataaatgtttatacaattaaccatgtctaatgtgataacttctatagtggtgcttggaacaatgtctataataatataatgaagagggcaactgatttttcctagagaaggaatttttaagatt

SEQ ID NO: 253316 - DNA, 656 bp, Homo sapiens
cgacaaagactcctcccctccttatactgtagatatggaagccagccttgcacagtactcagcatattactaaacactgtctatggaagttcctcagagtcgagaaagtgctgtcatctgaaataaggaccagctttcaacagcagtggcaaaaccctaatgaaaatgtcagcacaattggaaatttcactaacttgaaagtaaataccaacagcaaacagccttttaacagtcccattagatcttctgtggatggtgttcagactcttgctcaaactaatggaagaggaaataaagagtgctgggacttaacagacacattctgttaacttcaagaaagtagatttggccagagcaaacatatgtaggattcataaccagagactataaatctgattgtgactttcagaatgagagacttacagagcaaacaataacatctaaaatatatttaaaccaaaagaaaacctctctaatgatctcaatgggaaggaaagagttatcttaaaaaaaaactcggttttactagttagagagctgtcttggctcagaggctaaaagggcagttagaaggaaggacatatatcaagggtaagctacatatgaagaatgatgctcttttggagcatgccaagatcaacacaaaaggattttaa

SEQ ID NO: 253317 - DNA, 388 bp, Homo sapiens
caaccttgtctgtccaaccctgcctgcagtctcagccatgtggctacaccccattcctcctaccagagctcatgtgcctctgtctacactttctggtggccctgggctcttcacagaaattgacattgcgattttcagttcttgtttgcctcttacttgattttaggcttcctgaggacaatttgtgtctaagtcacaatgacacttaacacttggaagatgaggaataaatgttggaaggacaaatgaaccaaatggtgtatgggccaagtgtggtggctcatatctgtaatctcagcactttgggaggccgaggcaggaggatcatttgagctcaggagtttgggaccagcctgggcaatatagtgagacctggtctctactttaa

SEQ ID NO: 253318 - DNA, 370 bp, Homo sapiens
ttttttttgaaagattctgaagatggggaaagatgtacctacttcttaagacataatagcaccactgaacacgtacgaggttttttctgaaaaaatttgctattgtggtaaccactctaagtattctatttcatccccaaaataaccttataaggcaaatgctctttttacctccattttacagatgagaaaactgaaagagaaagattgaacaagtagtccaaggtcacaagctttagaagcagcagaggtggtatgcggtcgtttgtccccaggccaatggttctcaaagcgtgattcccataccagcagcattggcttcacctgtggtgagctctcttgcactccaaacttacgggccgcacaccac

SEQ ID NO: 253319 - DNA, 614 bp, Homo sapiens
ttattttaaccaatggaaaaagtttcccttcataactgaattataacaaggattctactttaggaattgcaaatgatcctttgttgctgtaacttgcaatgccaatatggtagccattagccacatatggctattcaaattagttaaataaaagatttattttttcacactagccatattcaagtgctcagtagccacttgtggctagtggattattgcattggagagtgcacagaaggttctattggatggcactgctccaagaccgcattctgttgagattttaactgtaacatagactaacttcttgttgcttctcagtgacattaaggttggaatgttgccttatacatgtgctataaggcagcttatttgaaatctttatctcacagaaaaagagtttttcttatacaatttcaggtgcacattttgcagcaaaactgcattgctctacgtgattctatacagagcgctcaagaactactggcccaggaacaaatagatgctagaaatcaccctcttgttagtttttggagatttcatggaaaaactcttaagatcccaaattcttaaagtggccagtgttattggtatttcccacagtgctgtatgta

SEQ ID NO: 253320 - DNA, 446 bp, Homo sapiens
  misc_feature (236)..(236): n is a, c, g, or t
gctccagctataaatgtcaagctccttccctctcaggagcccagtgaagacacaccagtgtcatcattctccttgaaaggaaagagggaacagtgaactcctccccaggcctctgtgcctggagcaccagctcctgtggatccacaagtgggctggcagttcaggtgcatgagagatgccagggacactgtgcctctcatcactgatctgatgcagaacttagttcctaagttgcntgtacaagaggctgagcgattatgacccagactcaaggaaggagagcaacctgtaaaagatgaattgcctcatgctctgtaagccatgcactcccattctggcaccagaatcaccctgcagacagcacaggcctgcggcttcctgtgggttatcccgtgtcaccctccaaaaaggtcatccttcactgagctggagttgaaagactggtg

SEQ ID NO: 253321 - DNA, 302 bp, Homo sapiens
aagaagctactgctgctgccattctgcattgggaagctcatcaaacacatcatgggtattataggacttgctacattggtctttgctagcttcaatgcctggaatgcaaacttcgggtcccttgttagtagaaagatgcacagatgcggctctgttgactcagttgtttaaatacatattgtcaaacaaaatatttgcagcactgatgccaagttcctcctgacattcacaataatattgaatttgactcaaccaaacaagtgtgacaatatgtggaataaaatttcatctaggttttatct

SEQ ID NO: 253322 - DNA, 327 bp, Homo sapiens
tcaacttagtttcaacttatggcccaagaaaatagaagtcagaatcaaaatccagcatgcagaacttgttgtaaaacatggcagtacaggacttgctacattggtctttgctagcttcaatgcctggaatgcaaacttcgggtcccttgttagtagaaagatgcacagatgcggctctgttgactcagttgtttaaatacatattgtcaaacaaaatatttgcagcactgatgccaagttcctcctgacattcacaataatattgaatttgactcaaccaaacaagtgtgacaatatgtggaataaaatttcatctaggttttatct

SEQ ID NO: 253323 - DNA, 255 bp, Homo sapiens
tcaacttagtttcaacttatggcccaagaaaatagaagtcagaatcaaaatccagcatgcagaacttgttgtaaaacatggcagtacagacagtatatctctccacattgtgtctgaatttggaggagggaacatgagtaagacgtgcctttcaccttcttccacgattatgaggactgccagccacttggaactactctcaaaaagtaccagaagtaactcatgagtaagttactcaaccaggaaaagcacata

SEQ ID NO: 253324 - DNA, 468 bp, Homo sapiens
tgtttcttctcctctagaagcaaccaaattccaaatgggtgttataaactggatcacgcgtggacacgccctatttccaagaacccttagacagaccccaggaagagccctagctgctgttccccattcaacgtccattttcagcaggaagtagccagaaaaagtcgtcacccaataaccccctaacagcaattaggttgtctccatggggggctggggggaatgtgataggagttactaagaaattattttaggcagatagagaggaaaagcggtccttggaaagttttcatttcttttaaagcagctccagaaaagtttcttgtcaagaaggaaagcccaggcccttagagccaagcaggcaaccttaggtatgcagataccggccattagaaattgggtctacccaacatgatgattcccatggttgtcctcttgcccttgcgctgacatgtgcctggcaacatg

SEQ ID NO: 253325 - DNA, 601 bp, Homo sapiens
tctacttgggtgtcagaactggggctccagatatctagagcaatgtcgttttgttttctatctgctgtgtcagtaccctcctgttagagcatcagcccatgtctcctggtttcaagttacagaatacagattgagcgtccctaacctgaaatccacagtgttccaaaattcaaaatttgagtgctgacatgatgctcaaaggaaatgcttagtgaagcatttcagagttcagattagggatgttcaaccagtaagtatgcagatataccaaaatcggaaaaaatcctaaatccaaaacacttctggtcccaagcacttccgataagggatactcaacctgtagtgaagactgaggcatctgatattataactcacttccttcactgcttcaagtggactttgcatttgtctctcagaatattaaaatgtcatccatttgtatcctgcctgtctgttcaaggctttatcttatgatcacactactaaggttatgcttttgatactacgtatcttttgatctatcagtttcactttcagaaatcaattagacaagtgtataaaagtaagaatacaaggatgttttcagcagtgtttataaagc

SEQ ID NO: 253326 - DNA, 462 bp, Homo sapiens
aaaagtcaaactaggaagaagtgaggagacatttcaataaacgtttgtctgatgtctcggtatgaaaggactttctaaccctcagaacagtgggagaactcaacaaagaaataaccactacatgccagctgcggtagcatctgtaatgagcacacctgtaatcccagcactttgggaggccgaggcaggcagatcacctgagattgggagtttgagaccagcgtgaccaacatggagaaaccccgtctctaccaaaaatgcaaaattagccgggtatggtggcgcatgcctgtaatcccagctactcgggaggctgagtcaggagaattgcttgaatctgggaggcagagattgcagtcagctgagatcacgccattgaactccagccttggcaacaagagcaaaactctgtctcaaaaaacaaacaaacaaaaaaacatatacaaggacatgttgtgtaag

SEQ ID NO: 253327 - DNA, 340 bp, Homo sapiens
agcagaggcaggagagagataaacatagttcaagggcaaggccagacatgcaagagggaaagcttatctgtagtgggtagaggttgagtagaatggcgactgtagagaagcattggattggcgcgtcccttgagacccttgatggagatagctggtggggagggacgaggagaacagagtttataagaaattaagaagaacatcctagttggagggatattgggatttttagagaatgtgttggagcaggacagaggtgttggagccaagataaagtccctaagaaaagaagtaactactgtgcggtacagaaaagtggagacaagaggctttgcagcaa

SEQ ID NO: 253328 - DNA, 508 bp, Homo sapiens
accccataaatccataactataaatcagctgactcctttctaacctttctagccaaagaccaataattgatgtgacttcatttttaggtagccaatgatgatgcacgtactattatttctacatctgctttaaatttgaaatgtattattattttcctggataataccttgaagtatctagagtttcatagcataattatatgttatataaaaacatactgttttggtcttgtcattaggtcaactgttaggccttattacaatgaaagaaaaattgccttttatatactatgcttatccaaattaactgtacttagaatgtctcctataagaaaagctaaaatatcttggtataaatcacacagactgctagatgttagctgcaggcatacgatccttgattaaaatacattaatcctttgggaggccaaggcgggtggatcacctgcagtcaggagttcgagaccagccttgccaacatggcaaaaccccatctctgcaaataata

SEQ ID NO: 253329 - DNA, 693 bp, Homo sapiens
tacaggtgtaagccaccgtgcccggcccagttgtttattaaaatgttatgttaacatgtaattgtttattatttatttatttattttgaaacggagtctcgctctgtcaccaggctggagtacagtggcgtgatcttggctcactgcactctccgccttctgggttcaagcgattctcctgcctcagcctccccagtagctgggactacaggcacacgccaccacgcccagctaatttttgtatttttagtagagtcggggtttcaccatgttggccaggatggtctcgctctcttgacctcgtgtttgcccacctcggccttccaaagtgctgggattacaggcgtgagccactgtgcccggctgtaatcgtttattactatttttaaataagttgacaaatagttttaaattttctgttttaatttctttagagttccttttttaagaaaatctactctacttccttagctgtccatggcagagtaatcaggacttaataaattgctaattgaagatgttacagtgtaacaccaactcatctggccttctgttgtttggttctttctttcatttccaggaagatcacctcttactcagtaaaaagggatgctaggtggacatctgtcatttgcagctccccagaatcttctgagcaccccttccccccttcacatttggatagtctgcaaa

SEQ ID NO: 253330 - DNA, 824 bp, Homo sapiens
cctggctaatttttgtatttttagtagagacagggtttcaccacgttggccaggctggtcttgaactcctgacctcaggtgatacgtctgccttggcctcccaaagtgctgggattacaggcgtgagccactgtgcccggccttgggtttattctttctttatatgtttgtttgtttgtttgttttgagatggagtcttgctcttatcacccagggtggagtgcagtggcacgatctcggctcactgcaacctctgtctcccaggttcaagtgattctcctgcctcagcctcccaagtagttgggattacaggcacccgccaccatgcccggctaatttttgtatttttagtagagacagggtttcaccatgttggccaggctggtctcgaactcctgaccatccacctcagcctctcaaagtactgggattacaggcatgagccaccaagcctggcctattctttatatgtttaaccggagcttccctttccccttccaggaggtcctgctttgtcctttccccttccctgcagccttcaccagctccattactccttatttctgttccctgttcctctggtcctgtttttggaataacttgtccgagaaatttacatataattaattgaagtgggactattggattatcatgtaagatgatccagttttggtttttttttttataaggctgccctgtttctctgtaatatgtctgtctgggttttgtgttggcatcctctgggctgcatttatcttgtttattacccttcattttcaggaagcatggttttggccccgagagcagctgtttgaaggaaaaat

SEQ ID NO: 253331 - DNA, 827 bp, Homo sapiens
cctggctaatttttgtatttttagtagagacagggtttcaccacgttggccaggctggtcttgaactcctgacctcaggtgatacgtctgccttggcctcccaaagtgctgggattacaggcgtgagccactgtgcccggccttgggtttattctttctttatatgtttgtttgtttgtttgttttgagatggagtcttgctcttatcacctgggaggcagaggttgcagtgagtggagatcgcaccattgcactccagcctgggtgacagagcaaaactccgtctcagaaataaaaaagagacgtgatcctgctatgttgcccaagttagactcaagctcctgggctcaagcaatcctcctgcctcagccttctaagtagctgggactacaggagcaaaccactgtgcctggcaggaattactctttaaaaagagtttatgttgcttgtattcatttgagaaaaaatgagttgaagaaatggtaattgttggtcaaagaagccaaaagatttaaataaggtcttgtgtgtgggtatgtgtatgtgcatgtatttattgaagaaaataagtttcaatttgagaattagaaaattggatatttcattttaattatttatttaaagagtagagtgttcttccattattgaatcttcttttatcccaccaaatggcttaacctaatttgcgctgcctattttggttaagaaacagggaaacaccctaaaatctgtgataattttcaaaatacaattttaagaagctttgcgcttacataaatcacaagaaatacagctggaaatcatttcacttttcttgctgtaaattt

SEQ ID NO: 253332 - DNA, 980 bp, Homo sapiens
cttactaaagccattactggtcaatcagatacttttagactttaccacagttataaaagtcagcttgatgtagtaaaaaaacttgtctctctctgactaatatgtatgaatataggagaatcccagtctgaatttactgtttgaaacatagatgaggctcagcgtggtggctcatgcctttagtaatcccagcactttgggaagctgaggcgggcagatcaccttaggtcaagagttcaagaccagcttggccaacatggtgaaatgccgtctctactaaaaatacaaaaattagccaggcatggtggcacatgcctgtaatcccagctgctcgggaggctgaggcaggagaattgcttgaacctgggaggcagaggttgcagtgagtggagatcgcaccattgcactccagcctgggtgacagagcaaaactccgtctcagaaataaaaaagagacgtgatcctgctatgttgcccaagttagactcaagctcctgggctcaagcaatcctcctgcctcagccttctaagtagctgggactacaggagcaaaccactgtgcctggcaggaattactctttaaaaagagtttatgttgcttgtattcatttgagaaaaaatgagttgaagaaatggtaattgttggtcaaagaagccaaaagatttaaataaggtcttgtgtgtgggtatgtgtatgtgcatgtatttattgaagaaaataagtttcaatttgagaattagaaaattggatatttcattttaattatttatttaaagagtagagtgttcttccattattgaatcttcttttatcccaccaaatggcttaacctaatttgcgctgcctattttggttaagaaacagggaaacaccctaaaatctgtgataattttcaaaatacaattttaagaagctttgcgcttacataaatcacaagaaatacagctggaaatcatttcacttttcttgctgtaaattt

SEQ ID NO: 253333 - DNA, 347 bp, Homo sapiens
tgtgttttgagacagggtcttgctctgttgcccaggctggagtgcaatgccacgatcatggcttgcagcagccctgatcaccttggcaatgccccgacctcagccttccgagtagttggaaccacaagtgcatgtcaccacacccagcctgaccaaaatggtgaaaccccatctctacaaaaatgtaaaaattagccgggcatgctggcactcacctgtaatcccatctactcaggaggctgaggcaggagaatctcttgaacttaggaggtggaggttgcagtgagctgagattgcgccactgcattccagcctgggcgacagagcaaggctctgtctgacagaaa

SEQ ID NO: 253334 - DNA, 195 bp, Homo sapiens
ctcaagcaactttgttgaatcaggtgaagttttaaatgccagaaaaacattgtcttaatttttttgtgctactgaagtgtaaccgctatatacaagattatttaattcagggtagcaagattagatgatcaacaaaacctttgttcaaacgtgagctcaatttcctccgatgtgtggcccttctgtcgtcttctc

SEQ ID NO: 253335 - DNA, 635 bp, Homo sapiens
cgcggctgattcatcccaggccaggcgagtggaaaagtaccagccgcgcgcgaggggcgggggcgcgccgaggggcggaaaagtacagacggcggagccgcggggagaacaaagatgatgccaccgctgtgttgcggccgtcgaggccccctactccggcagatttcaacctgctttcactcttcaaaactagccggaggtcggcgagcagctccttttcgggatgtgctttttgtacggccatggaaactggactagcggaaaggctaccttttggccagcaagccaggccccttagaaagaggccccagtggggagcccggcgctcctaaggccgtttgggagtccccagttttccactcgctgacacgttgcttctcttatcccaccaccgccgccccgggcaaaggcactgccttgtctgaatgcgggtctgaggcgctttctgcggagcctggtcctttcccttcaatggtgatgtgtgtggtcttgctgagccaggcaactagggggacccttcgctgtggaaaaattggtgctgcgggaaaggcaagactcactcccttgcaggaaacaaagaccccttaggagagagaaatgttcatggaatgaatgaataaacaagtttgacctac

SEQ ID NO: 253336 - DNA, 313 bp, Homo sapiens
  misc_feature (163)..(163): n is a, c, g, or t
cacctccggctcagcgtgctgcactcagacatccaactggaggagtccatgagctgacctcagagatgccctccgacgctgagtttctttgtcaaaaaacaaactcttcactttcatctcttcaaaatggtattttattctgtcctctggtgtctgtcaatanatctcatctccccagacaggctgccttcagcttcccttcacagccttgccgatcttgccccttcccctgttaatccacacagccatcacttctgaacttaattcctatagcccctgacgttctctgactcatccgtcccttgtgatctac

SEQ ID NO: 253337 - DNA, 5583 bp, Homo sapiens
  misc_feature (5253)..(5253): n is a, c, g, or t
  misc_feature (5283)..(5283): n is a, c, g, or t
  misc_feature (5290)..(5290): n is a, c, g, or t
  misc_feature (5361)..(5361): n is a, c, g, or t
  misc_feature (5371)..(5371): n is a, c, g, or t
  misc_feature (5412)..(5412): n is a, c, g, or t
  misc_feature (5415)..(5415): n is a, c, g, or t
  misc_feature (5432)..(5432): n is a, c, g, or t
  misc_feature (5441)..(5441): n is a, c, g, or t
  misc_feature (5484)..(5484): n is a, c, g, or t
  misc_feature (5505)..(5505): n is a, c, g, or t
  misc_feature (5512)..(5512): n is a, c, g, or t
gttagaagctgctcctctgacctctggaggacccggcactccgaaccccgcgcacctgggaaaggcctgagattccccgctattgggattcacatcacgacgcggcggccccaactcggggaggaattagacacggcggcactgctggtccaacctggaatccctgcacagcattctgacctggggctgcacagcctcatggaaactcctccagagaccccaaaagccacctctgaaagaaggtgatccagcatccccacccctctcctctgcccacccgagccccagagcacacgcgtcccttccattgccctccatctccaaggcattagcagatggtcacccttgctttaggcaggccccagagctccctgcctcaaagtgtccctttcccttttgcctggatttccagggatctctgggctggtctgtggggccccaggcaggcaccaagtaggcccatcttggctctgaggctgagagaggaagtgggctttgttgtgcctgggcatcgtctggattttcccaccctgctcttcttggcaggagagccctcagctggagaagctgcctccgccccacaccagcgtcccctccttcccagctcagcaccatccatctccgtctccctagagcaaggaatgtgctccaggacactgtggggcttgttcccaatccccttctagctcatttcactcgggcttttatagatttgcctccatcccatgggctgctgtctgggttctggctctgaagacacagacagaggtttccccctcctccctgcaattcctcacacttcattttgtcccaacagcatctgaggaggctgcactgtggggagtcaaggcaccctggtgtgggaggcgatgggggttgggtggtggagggtgggtccccttccccatctttccagcccctggccctgctggcctcagctctggcactgcccacagcggctgcattattccccgtgctgcagccatccatcccctcacccgcccttcctgtccacgccccacaagcctcgattattggtgaaattagcaccgggcttcttgttggcggttgctaattaagaccattaataaacgtgattattaatgctgtagcaggcagcagcccaggcatctaatcaccacaccgctggcaagcgctgggctgccggcttccacccggctccatcttgggaaggacctgctccctttccccggccagctcacctcaggccctgccaggggagggtgggtggagacaaaggcaccacggggggttcactgagccttgcagagaaaaggagggacaacctgcactccagggagcccccaaactgggcaggccgaggccaggatgtgtgcctgtaagaggcctatgaacccacctgatgccggtacgcagggtggaccgggtggtgagtgcgaaggctctggagagagcgtgggtgggcgcctgcaccagcagccctgctctctggcagcccacagctcacgtgccctcctgagtccccctttgcccgccgccctgcaaaccaggctgtggagtgtggcccctcctgcgggggtttcacagtggttaggggccatctcagcgagacagtgaggtgctctctgtgagaaagtagaagacacctctgaccagaatgtttccctcagttactgggtgcccaccatgcgtcaggccagagggtactgtcataaacaaaaggcagtctcctcctgggaactgccccatcacattagactacatgaggtctgtccctgaatgtctccctcaccccttccctcacccctttacatggcgtcccacctcacactgcctgtaatgagctgtctgtttatctgttcacaccaacggggctgtgctgtgcgcgatgacaggggctgtgtgtccctgaggacagtggaagcccactctggctttggtgatgaagcctttcctgcccctgtctccaggccaccctccttccacgcccttccctgttcgctgtcccctgcctgacctccagcctcgggctaccagagcaggaggggttgcaaggagccctctggtccagtttgccccacttggaccccgtcagggcaggagagcctgcctgctctcagctgggactcgaggaggtaggatgtggcctgccaggcagggcgggccctgggggcctttccaggagctgtctgctgcccaggcttcccctctagtccagcctggcctctgcacccccttctgccatccacttacaccccaagaagtgatccacggcagctgaggagagcttgggaaggaacctcccccacacacctgcttccccccatttttctccaccccaacttcaatgtcttgactttttcctacagcttttgaaggaagaatccaccaagactttagtctctcccaacccagggaataagaagagaaaaaagtcctgaaaacaaaaacccgacaacaaccttaaagtaggagagattggttggaaggcttttaatcccttaatccctctcagatgggccttgagacgctaatgattttcctaattattccctccgattttcccatcgctctgtaaggaccttcgagaagagcgaaattccgagtgagcgggtgtgggatgaatggcaggcccacctcccccacatcggacccagagtccaggcggctggagaggtgggggaagggccaggagtgccccagctgggggcttgggcttctccgccactgacaccagtgtgcagggcgggcctgggacaatggggcggttgggggctgcctgagagggccaggtgtggggctggggtcccctcagtgtgaatggcccattatcctgccttgaggatgggagttgagggtctctttgtgtcccccaggaaaggcctctctggcgataatcaccctgagagggcggtggaggtggtgaggaggatctttaaagggggccaaacctccccagagaacagttggccattcaggcctccagcccctctcttgtctccagcagcctgggattcagtggcccatctatggggggtggggcgagggctaggccaacacacatggccaagcttgggcttaggccccctccccatcagtgtggcctgccagactgagcccaggggtggcttctccaggaaaccaccccagcctccctctcaacccccacctaatgttgggtgccctggggctttgtctcatttcccctgagacactgagtttctctgggggccagatctgcctgggagcagacattgacctttgaccctgccatgtcctcttttatgaaacatggggattctcattccactcctacaaattccctatgggatgagggcattagccccatttcacagatgacaaactgagcacttagcagacttgtctaaggttacacatcaagttaggggcaaattagattagagctggatccttctttttttgtttgtttgtttgttttttgaaagccctgatactgtaccaggtacaaggcttttgtacaggctgtccctctgaccgaaatgctcacctcccaaacaacccgagggctgattctgcgcctcccttggtctttgcttgaatcacatccttcatggaaggagatgtctgggatttgcttcaaaataacacgggaagtgggggaaaaggaggtgggagtgcagatgaaacaagattggcagatgttgaagctagacgagggataggtggggtctcattatactattctgtttattttatatctatttttaaatttccacaagaaaaagtggaacaaaacctggttttccctaagcaccttattttatttttgaggcagagtctcgctgttgcccaggctgtagtgcagtggtgcgatctcagctcactgcaacctctgcctcctgggttcaagtgactcttgtgcctcagcctcccgagtagctgggattgcaggtgcccaccaccacgcccagctaatttttgtatttttacaaaaaattttcatcgtgttttaccatgttagcgaggctggaggcaccttattttaaattgcaattcaccatccccagcccagccttgcctcgtaccctttccttgtttttctccagatcacttattatggtgtgaaactcttaagtattttacccatttgttttgattcttgccaatgggctacactaggttaaaggtcatggggtcagaggtcttggggttcatttgtgcaggccggttggccagtgccccagcaagaagagcagcgcctggcaccgggatgcctttgatcctgtgagtcaaggtctgggtgacgcggtgtccagaggctcttggcccagttgccaaggaaagggacggcctgtcagttgtgttttgggcctgtcgggtccttcagcacctggagccacagccggagggttccttcccagcactcccagcctgggataagcccctaagtgtcccattatgtaccattcactcttactttgtcggccccatccacagccgctgcgtccttttgtcagaggggcctgggagggcgaggggctattaccacaaggcctcattattcccagccagagtagtaatgaggagtcccttccccagactagtacattttgcagggcccctcccatttaataactataataaaggccaccatttatgagtcctctcctacaccaaacactttacatacattatctcatttaattcccccgacagctctgggaaatagctactatttgtatccccatttttcagatgagaaagctaagacagagactacaatttctttctcctcggctcagctgtacaggcaagggtagggcagggacacaacaatgtcccagtagggacaactgaggttcggagaggggacgtggcctggggaagagcacactgcagattaacaacagggcagcgagatccccttcactgtgtgcggggaagggcaagtggaagctctcagttctccaggtgacgtctcactcctatcccccagctgcagtaggggagtggccatcactgtctcacccctcacgggcaggtgcttcagtgacttactcatgtgtacacaactagtgagaatccaggtgctctgtccacgataccaactgggggacggcaggtgagaagggaatcatcctgagaggctcctgaaggatgaggctgagtgtgggccaccatgagtgggcccagctggcccagcaggaggcaggggtagagtgatggaaggggaaggcaaagagaagggactgaaatgccactggttcctctttttttttttttttttgngatggagttttgctcttgtcggccaggctngagtgcngtggcgctgtctcggctcactgcaacttccacctcccgggttcaagcgatcctgcctcagcctcctgagtngctgggattncaggcgcctgccaccatgcctggctaatttttgtatttttngtngagacgagggttcaccncgttggccnggctggtctcgaactcctgaacttaggtgattctcctgcctcngcctctcaaagtgttgggatnacaggcntgagccactgtgcccagccagaggttctcttatgctctggcctttggggtcaaacactgtccttccagcct

SEQ ID NO: 253338 - DNA, 583 bp, Homo sapiens
taatttttgtgagtacatagtatgtgtatatatttgtgtagtacatgagatgttttgatgcatgcatgcaatgtgtaataatcacatcatggagaatagggtatccatcctctgaagcatttatcttttgagttacaagcaatccaattatactcttttagttattttataatatacaattattattgactatagtcgcattgttgtgaaatcaaatagtgtcttattcattctttctaactatttttgtacacattaaccatccccacctcccctccagaccccagtacccttcccagactctggtaaccatccttctactctctacgtccatgaattcaattgttttgatttttggatcccacaagtaagtgagaatatgcgatgtttgtgcttctgtgcctggcttatttcacttaacataatgatcttcattgtctagggtgacacccagagttcttgatctcatggccaaggaaatcaaggacgtggacataccaaatatgaggtttagagcagaaatgtaataggagaaagagaacagttgtttggtacagagaagggtcctggaaaaagggttgcc

SEQ ID NO: 253339 - DNA, 685 bp, Homo sapiens
cagcagactggctgaaagaagcctctctcggtatttatagagcttgcatcgccatggtacccaggcgcttaaattaaactctagcccaactgcttggagatgcatggaatgaaatgcactttacctgtccactgtacatggtctcacacctcattctcagaacttcaccactgcaaagataagcaaatggagtgaattttacaaatcacctggcaagaagggtatagggttgggtttatacaacaacctgtctcaacagggtggctgggcagagtagtagaatacatgggcagaaaaagcaatccagatctgaaacttggctctgcatcttggtcagtgtgtgactgtcggcatgagactgcatctctctgagcctcagtttcctcacctgtaaaatgagatcaccaacaagaaaaatgagagcaacaatgctgcctcactattgacttgtgacaactatatgaaatgatacaagtgaagtgctttgctcagcttctgaaatgcagaagctcttttaaatataggtctccttccctgttcagctgttattcatttattccacaagaacttttttgtctgcctattgtctgccagacaagtattgagacataagggtgatttctggtcccgtggagcttacagtttagtaaagtaacatgtaataaacaagtcaacacatgaaaaa

SEQ ID NO: 253340 - DNA, 374 bp, Homo sapiens
atatgatgagctggctcaatttttctattcgtacagaaattcgtaatctatcagtttttctagctttgccttgtaaattcacaagccagtttcgctcatctttttcttaatacagcttggtagaatctctcaaacccattttccttcttaacctgtcacctttttctagtgctcagtttaattcctggtcatcacctttaaatgtaaatggctgtgtttatttgacacagaccatttgccagttaactttaaatatctctctttgataattgttttgtatatatctacttgattgcaaacaaatgtgttggtttcaaaacaggtatgggtagccccatttatatgccaaaaatgaacgtattactagaaaattg

SEQ ID NO: 253341 - DNA, 466 bp, Homo sapiens
gagacagagtctcgctgtttcatccaggctggagtgcagtggtgtgatctcggctcactgcaacctcgcctcccaggttcaagcaattctcctgcctcagcttcccaagtagctgggattacaggcgcatgccaccacacccggctaatttttgtatttttagtagagacagggtttcaccatgttggccaggctggtcttgaactcctgacctcaggtaatccgcccacctcggcctcccaaagtgctgggattacaggcaagagacaccatgcccagcctctcttttcttataatcaacttcttgtcattcatccttggctgagtgtccccttctcagagatactccccaccccccaacccttctgtccctgtctgtcactccactgtttggctgtaggcggcaggaacttaccttgagtctcaaatgagacttaggactatggagtgaggcacagattgcagt

SEQ ID NO: 253342 - DNA, 456 bp, Homo sapiens
caagaaaagatattatataatccctgccttcaaacagctgtatagtcaagtttgcaaaataagacaagagtagggacattagttctccaggcactcaaaagaaatatcatttctagcttgggttgtcaggcaaggcttcaaaagaggtcatgaactatgaattggtctagataaattattaggattggaaagaaagtaggaaaaggcatttgatatcaggaaataataaaattcttcattttaacacttacctgaatttgtgggctgaaaaatttaattttaggaaaaatgctgtatgttaactataactaagaactttattttctgaccagatagtgtgcctcacgccacatcagtacaatttgttcaccttagcccagctatctgctgaaaagatatcacacaactggaagcccctggccttccttctcagaagccaactaaaatgtgcattgc

SEQ ID NO: 253343 - DNA, 423 bp, Homo sapiens
tccttcacaagattacgtaacttacaggcgtgttgctggcttcagtagaagtttcatctccctcaatcctgtacacttttccatacattacatactcaaactggtcagccctatggagcaatactgtagaaaatctgatgaagacaggactttttctacagttttgcttcaacacagctgaacagtttataatgaaattattggcaaagagacaaaatcggccatataataccagggtattggcaaggaagtggcactctctcattacggacaatgtatatacccagttttcaagatttggtctatataagccagtgtttctcaacttgcataagaaccacttgttaacacatagtcttgggccacccaagacctactgaagtgggatatgtaacgatgggattcataaaatctatagttaca

SEQ ID NO: 253344 - DNA, 213 bp, Homo sapiens
tcttcattccttccttctttccttccttctttccttccttccctccttccttccttccctcctcccttctttctttacttccttccccttttcctcttgcctttcttttctcttttttctttctttctctctctctttcttatttcatcctttccttctttcctctgtctcatcctctttgtctcttctctctcccttccttttttcttcctt

SEQ ID NO: 253345 - DNA, 428 bp, Homo sapiens
gccttgtttcagcaggttacaacctatgtttcatttttacttgggtacaattccttttctatagaaaataggtcagatctcatatttttccttagtttctataaaactatcaatagctccaataaattgacctctctggggagaaagaaagcctggcttagggtttggaactacatcttacactggttatctgaatgtcctaatattgatttgattaactcccaaaccaatattaaagtaaaactctgtgcccgaaagatagaggaacaggggaaaaaaggagttggtgcctgggattttacggtggctgcgacagggcgtgtggagacatttgtgggaaacttttctctttttttgagcagagtggataaccctttatttcactatagacagactggatttatcctgcttttacctttagaattcaa

SEQ ID NO: 253346 - DNA, 392 bp, Homo sapiens
cggttcatcagaacatgtgtctacatagcaacatcacttggcatttaaaatataaatcatttacaaatgtcatttaatttagatagaacggtgggaatatgagttggggtaaaatgagggtggaggaaggacagagggagaaaataacagcccctttccaaaagtgtctggggttgagggtttccaaacattagatgcaaagtaatgccagaggaagcatgtgggatgataatcacagtgatctttttatttttttcccaaaaagattttttttttttttgagacggggtctcactctgtcgcccaggctggagagcagtggcacgatctccgctcactgcaagctccgcctcctgggttcacgccattctcctgcctcagcctcctgagta

SEQ ID NO: 253347 - DNA, 1831 bp, Homo sapiens
ggaaacagcatctgaaagtattcattttgattgtttttataaccagttactttttttcaggcagcgaggaaggaatacatagagggggaaaggtcagtgttgatactaatagggtgaccacaattaatcctagccacttcatgaacacacaaggcctttggccaactgcggccaagcattgctgtatgtatttggcaggttatttggcaggaaaagttactcaaaactaaaatcttttcaagtgtatttttaccatgttatttattattattatgtaaaagatcacttttagtgtatttgcactaattattgtataaaagcattaaagtagcctctgatttttttcaagtaaaaatgtaagaaaactagattttttttctcctaagtgagaaacaaaaaacatgctatgtgactccccacaaaagccctgtaggtttaatttaatttagcaattccctctctacttttctaccaggttcctgttaccaatgcaattatttcgtggccttttgcctgaattattctaagctgcttctccagaggaaatgagtcagaagaaataggcttgatgtgcatttctgcctttggagacttctcttgatatggtgtaaatccgtaaggtttcattaatgccttgtctgcatattttttcaatctgcttttgataacaaggtctgtttctagggtacttcaaatttaaaaccgtagggtatgtgtaaaatatcaccactagaaaatggagagatgcaaatgggttcccccttctgtagtccctcctaatgtcagaatctggggttagggttctaagtgatggtagcactcaggagagggtcacaagaggcaatgacatgggactgcatcctgaaagatgactgcttagacgtgcggcgagaatggccggaaaacggaggatggcgcttgacgttgatctaggaaaggaagacagtcattgggacttttgctaactttgtccctagagagtgaattctgcttttgctggtcctaaaaactgtagagtaattctacaatccagttaaatttgtaaatctaatgcctgattcagtctgagatttatgactcagccggttgatccagcttaggtctagactcatttcacttttgttatgacaagatacgacaatgtagggcacaccctttaccccccagggtcatcctgatgtcagtcatttcaggctaggccagtgtcagagcagtccctgaagcagaagtggatggaaagaggtgaatgatttctaatattcaacattcattaatttaacatcaactatgttaagggtaatgatatagcagttaaccaagaccaacatggtgtctgcttggttgatgcttgaaataaggtgacctggccccagccacccgggtggccaggagctgaaagggctgtaacaagtaggcagtgaatagtcttcaaacttgttacttgcatacctccctacaaattttggaaaaaccatgagactctgattgattttttaaaagaatatctaaaatcattatgtttaaatagcctcaaaagaagcattttattatgtattgtaaatattggcattttaaaatgttattcggtcttttaaatgtatccagtgaaatgttggtacaatagagttttgatagctaccattttccatttttaaaaatactttaacacgctttgtaacagttggaaatattgtttgattccttttgctccctgaactccattcttcttcttctgaagaattttatcctaaaatgaatttattttttgcttaacagtcttattggttaccttattaaatattactcagtatattatagatgtaagtgtttt

SEQ ID NO: 253348 - DNA, 370 bp, Homo sapiens
ctgtaagtgagcccagtgttttgtttgtctttaatggaaacaaaagtcaaacctccttcttttagtagttcccaatttaagcactagacctttttgcagcctcctatcctcaagactcaaggatcctgtctcttctcactttctcccatttcctatcttataaacttttgtcatcttggttgctctttccccaatttcttcatctactttgtagaatcaagaactccaggtaggtgatgaaaaggttctaaaattgattgtggcaatggttgtacaactctgtgaatatacttttaaaagtttgaactgtacactttaaaatgggtaaattgttatgtgaattatatctcaataaagttaccttttaaga

SEQ ID NO: 253349 - DNA, 909 bp, Homo sapiens
cctctctggagggtggggatagaccactttcctgggaagagtccactgaacattcttctcttgccttaaactctgggctgcctaatggtgaaacttctagcggaggacagcccaggttggcagagccagacatataccaagagaagctgtcccaagtgagagatgttaggtctaaggatctgggcagcagtactgacttggggacttccttgcctttggattcctgggtgaatatcacaaggttctgtgattctcagcttaagcatggggcacctaggccaggaatgaagtcctcccctcatgattcccatacgtgtgtaacctatccagagagaaatcacatccttttgcatccacattggaaccaagacacagagcaggagacctcagaattggagtctctgtatcaggccagtcttcaggcttctcaagctggctgttctggatgggggcagcaggataccgcctggcacccacttagccaaacaggctctgcagatggcatggggaggaggttgcactcagcccatgatcctggtctctcaaagacttcaacagcagaaatggagcatggtctccatgaagccagaacagtgcgtacttctcaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatgg

SEQ ID NO: 253350 - DNA, 529 bp, Homo sapiens
agaggcatggtgatatggggctatcagaagaaaataaggtctatgattgggcttcttttgaattagaggagattgttacatggccactatcttaccaatacatctaattcaggtgtctattactactgagtcttcccctactctttcccataccctgaggatactgtctgtgggaaaaccataagtctggtattatgtgtctgcctgtatgtgtctgtgtgtttgaaggctacaccttgccgaggcctcagcagggagtgtggggaggatgagcagtacagtgcagagaatttacgtcgcatctcacgcagtctcagtggcaccgttgtctcagagagggaggaagctccggtttcttcccacagttttgattcatcaaacgtgaggaagcctttggaaaccgggcaccgttgttccagctcctcttccctccctgtcatccatgacccttctgtgtttctcctcggtccccaactctaccttccccaaccacagttcctgtccccagatgtcctgatgcccaccatgg

SEQ ID NO: 253351 - DNA, 1004 bp, Homo sapiens
aaagccttttctttttacagttcctatctaagacatgaaagaacacatactggggagaaaccgtatgaatgtaaacagtgttctaaagcctttcctttttacagttcctatctaagacatgaaagaacacatactggggagaaaccatataaatgtaagcagtgttctaaagccttccctgattccagttcttgtctaatacatgaaagaactcacactggagagaaaccctatacatgtaaacaatgtgggaaagccttcagtgtttccggttcccttcaaagacatgaaaccactcacagtgcagagaaaccctatgcatgtcagcaatgtgggaaagcgtttcatcatctgggaagctttcaaagacacatgataaggcacactggaaatggacctcataaatgtaagatatgtgggaaaggctttgattgtcctagttcactgcaaagtcatgaaagaactcacactggagagaaaccctatgaatgcaagaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaagccttaagtagtttcagtttctttccagtacagtcatcccttgatacctgctgggtattggttccagcactccgtgagccatgtccagtcccttttataaaatgacatgtttgtatgtaacttacccacatcctcttgtatagtctcaattatgtctagattacttaaaatacctcatgcattataaaagctatgcaaatagttgttctattgtattgtttagggaatcatgataaggaaaagagtctatgtattttcagtatagatgcagtaattgtgagcctatcaacatagtgtagtcagccagaacattaaagtttctttgtttcaactctca

SEQ ID NO: 253352 - DNA, 1258 bp, Homo sapiens
aaagccttttctttttacagttcctatctaagacatgaaagaacacatactggggagaaaccgtatgaatgtaaacagtgttctaaagcctttcctttttacagttcctatctaagacatgaaagaacacatactggggagaaaccatataaatgtaagcagtgttctaaagccttccctgattccagttcttgtctaatacatgaaagaactcacactggagagaaaccctatacatgtaaacaatgtgggaaagccttcagtgtttccggttcccttcaaagacatgaaaccactcacagtgcagagaaaccctatgcatgtcagcaatgtgggaaagcgtttcatcatctgggaagctttcaaagacacatgataaggcacactggaaatggacctcataaatgtaagatatgtgggaaaggctttgattgtcctagttcactgcaaagtcatgaaagaactcacactggagagaaaccctatgaatgcaagcattgtgggaaagcattatctcatcgctcaagctttcgaagtcatatgataatgcacactggagatggacctcataaatgcaaggtatgtgggaaagcctttgtttatcccagtgtatttcaaagacatgaaaggactcacactgcagagaaaccctataaatgtaaacaatgtggcaaagcctaccgtatttccagttcccttcgaaggcatgaaacaactcatactggagagaaaccctataaatgcaaacgtaggaaagcctgtattgatttctgttcctttcaaaatcacaaaacaactcacactggagagaagccatatgagtgtaaggaatgtgggaaagcattcagtcgtttcagatacctttctcgacataaaaggactcacacaggagagaaaccttatgagtgtaaaacatgtaggaaagccttcggtcattatgataacttaaaggtacatgaaagaattcactctggagagaagccgtatgaatgtaaggaatgtgggaaagcattctcttggctcacttgctttctacgacatgaaagaattcacatgagagagaaatcctatgaatgtccacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccatatgaat

SEQ ID NO: 253353 - DNA, 383 bp, Homo sapiens
ccaggtcagacccctcctgcgaggccaggggctgtggccattgggagtttgtccccacggacccctcctcccccagagggcacgccagtcttgaagcaacatgagcagcccggagccccccacagagccccccgagcccgacaaccccacctggtcgactcagcccacgtatagcaaccttggtcagatccgtgcccacctgctgccctccaaggcctgccgcctccggacccctgggtccctctccaccaacccagagcccctgcccccacccctgcccaagaagatcctaacccggacccagtcactgcccacccgcaggaccctccatcccagctccatccaagtacagccgcctcggagaccctttctggggtcccaca

SEQ ID NO: 253354 - DNA, 449 bp, Homo sapiens
cttctataatgccatcctgtcagtacatattttagtccatgctgaatccaggaccctgagaaaccttatagcctagaatttgattctatatatagtcaagaatatacacaacatacctctgcattggatcttctggggttttcttaattttggatgaaaagctctcagcatattaattccagaatatacactgaatcacatcaagccaatccttgtatattaaggctgttgtatgtagcatggagtctaattaatttagaattgtagaatttattattttgtttcctgatggcattttggagcgattttaggctacatactgttgctcatcatttttttaaaaataagattctatcaacattagatgatgccattttagataaacagtatatactctgattactttatcttctgtcactgcatgaataactataggagcccagaagacc

SEQ ID NO: 253355 - DNA, 644 bp, Homo sapiens
gagcttcaaaataggcccttttttcttattcaaaactacatatataaaagtgtgaatacaacataagagagcatttttgcctgtggccttggcagggaagaccaagctggtagtttcccaatcagggtgcaggtggccgggtacgctgactcgaagatggctggctgggcacagtccccgtgagttgcctttctgccaccctgcacctctcctttctcctggattgtaaaaccagatgcacgagaactgcagagtgtatgaaaaatgcagcagaggatgaagagggaaaaatcccatggaatccctccttttcacttgtcataagcatttcccatatggtcaaaaatccttcctaaagatgtcttgttttttgtttttccatgttgatgaaggtcacatgggagcccgacaccatttggaggagattcagagaagtatgaacagcacaaagcacttggccgccccccatgggcgtcttcccaggactccctttctatgacactaacgcatcatcctgcatcccacgttccctgtgcctcatgtcatctgtacatcatgtgtctactccccatggtcatgtcatagtgttgtgtactgggcacggttgaatactcccatcacatgatgggggaggtagttgatcc

SEQ ID NO: 253356 - DNA, 561 bp, Homo sapiens
cagcggaccaatggcggccgcccgcggcgcgcagcgtgcggggatggggtccgcccgcggcgttgggcgcgctcgccagcccaggggtcgccatgaccgagcggcccaggcccgagcgaagcccgcgcgcggtcacatgggagcccgacaccatttggaggagattcagagaagcccctgattgctgattctgtccgcctgccacaccggctctgtccggagccactgggactcgggatccagtccacacacacccctcagaggggcactgtggccagagaaatgcttccacggcccaaagcccctgcctcccccagacgcccccagaccccaaccccgagtgagcaggacgcagaccctgggccagcaagccccagggacaccgaagcccagcgtctgcgcttccggcagttccagtaccacgtggcgagcgggccgcacctggcgctgggccagctctggacgctgtgccgccagtggctgaggcccgaggcgcgctccaaggagcagatgctggagctgctggtgctggagcagttcctgggcgcgctgcccagcaag

SEQ ID NO: 253357 - DNA, 624 bp, Homo sapiens
cagcggaccaatggcggccgcccgcggcgcgcagcgtgcggggatggggtccgcccgcggcgttgggcgcgctcgccagcccaggggtcgccatgaccgagcggcccaggcccgagcgaagcccgcgcgcgacctcagcccaggaccctggaggatgctgaggggctacagcccccctccctagagtctccagggtcacatgggagcccgacaccatttggaggagattcagagaagcccctgattgctgattctgtccgcctgccacaccggctctgtccggagccactgggactcgggatccagtccacacacacccctcagaggggcactgtggccagagaaatgcttccacggcccaaagcccctgcctcccccagacgcccccagaccccaaccccgagtgagcaggacgcagaccctgggccagcaagccccagggacaccgaagcccagcgtctgcgcttccggcagttccagtaccacgtggcgagcgggccgcacctggcgctgggccagctctggacgctgtgccgccagtggctgaggcccgaggcgcgctccaaggagcagatgctggagctgctggtgctggagcagttcctgggcgcgctgcccagcaag

SEQ ID NO: 253358 - DNA, 397 bp, Homo sapiens
tttttttgagatggagttttgctcttgttgcccaggctggagtacaatggcatgatctcggctcggcgtgatcttggctcactgctacctctgcctcctgggttcaagcgtttttcctgcttcagcctcctgagtagctgggattacaggcatgaccaccatgcccagccgtaactctttgtattttggaattgctactgtaactctttatactttgtaattccttgagcccagtgacaggcaaacagagctgactctaccgctagaaggaaagaagcagtctatttaattgccttgagctagtgtgtgctgctcagttggagagtgaattttaattttggaggcactgttcctagtgacttgaaatcaacaaaccttctgtcagataagcataaca

SEQ ID NO: 253359 - DNA, 505 bp, Homo sapiens
caagctctcatggcacgctgtactgtaagctccgggtcggtgtgcacttctgttttgttcctgcatttcaagccatgcgaattgacatgttttcttccccaaggcatttgtttgttgatggtaccagctgtcaaaaaccaagcaagtggcagtgctagaggtgccacaaaagtgcgaaggaagtgtcaggctggatgtcaaaatgaacaccttggagaactggatgatggaacagacggtaaaaatcagctaaacatcagagaaaatggaggaagaggtcaaaactgtgaacaggaactagaagaaagtgtagcagaaaaagacttgtcacaaacttcgagagatttggagaaaatgatgtcaaaacacatcttcctcaagcccatgctgagtatctctgatttggttaatttcttgattgtcccaaatttggccaatgaaaaagtccttcaaggccaggtgtggtagctcatgcctataatcccagcattttgggaggctgagg

SEQ ID NO: 253360 - DNA, 638 bp, Homo sapiens
ctctgagtcatggagacacttgcagaggcccataccggcaagaggaagaggacgtcactttatgtaaaggtttaacttcgttagcgaactgagtgtgccacccagtcacatgagtggagttgtgacattcatgtacgaggtggcaaacctctaccttgtgttgatgagagaataatcttgggcagtctgggaaaataaggaaggcatctccttcttactcatggagattcaactatagagagttgaaacctaaacccgccttccttttatagaagctggactagagacggactgaccatcagctctgaactgtggctttttttgttcacctatgatgccatgtaccaaattcagaagctatcgttaataatttgttttataattgagtagtacaagcgaggaaaaaatacggaggataaccactatttttgtgcaaatagtatgaaagtgaagtaaaagcaatagaagaaatttctataggatctgggtttagagtgtgtatcattaataaatatacctttgctcttttcagggaaaataacaaccacccttactgatctataggagtggtcaccactcctatagatcagttccatcagcacttgtatcagctctacctttgaaatatgaccagcact

SEQ ID NO: 253361 - DNA, 395 bp, Homo sapiens
gcggtgagctgagatcatgccactgcactccggcctgggtgacagagtgagagcccatttaaaaacgaaaaataaagggaaaaaaaaggacagaacaggagtcccggagacagaaccttgcataaatgagaatttgccgtatgacagagaagcatcaccaaccagtggggaaaagatagactcttttataaatggcgttgggacaagtggtgatccatatgggaaagtaaaattagatccccacctaacaccacacacacaactccaggtggattcaggacttacatgtgaataacaaaattttaacacatttagaagaaaatatagaagaatatttttatgacctcagggtaaggaacaatttcttttttaaataaactttttgtttgattaca

SEQ ID NO: 253362 - DNA, 362 bp, Homo sapiens
attgctccacagcttccttctcttttttccctgcctgtgtactctgaaggtctctctttctctctctctctctctctctgtgtgtgtgtgtgtgtgtgtgtgtgtgtgtgtatgtgtgtgtgtgtgtgtgtatgacctgacctccgggcaggcagtgtatcagtgtatcccccagggtctataagcacagaacactcttacacttccacattgtggttgtgtcactgaggccatgcctaaaaccctacccatgaaggcaaggctcccccagagagacctatgcaggtgaatcccttgctggagctcttttgttagggcctctggtggctgctgggcacagtggctaccagctaagctgataa

SEQ ID NO: 253363 - DNA, 556 bp, Homo sapiens
agagaagactcagaaatggtcaattctgactatggataaagtgaaagcatcttctcattaacacattaaaatgaattagctaaatccctggacattttagaaggcacagaactcctaaaatgagatactgagcagataagagagagaaagggaaacagaagcagacaagttaaaagtttaggtcagagaaaagaggcttttgataacatgactgtcaaaatgagagttaaaatcaaacttaactacttcaaaatattgtcaaaggctgaacctcctccttagagcttactgccaatgcagcactacaacagaaagaaaagaaggtaaggaatgcatgcaagcctttaagacaataattgcttctaaaagaatgttccaaatagtttaataatatcaacacagtattttgattaatgtttaagtattaaattagggaaaaagaaaattagttttgtaaactaaattaagtcacacgtaacagatttctgacaagggtcttgagaggtttggagaaaaaagaattattctgttacagatgaagacagaaaacaaaaaa

SEQ ID NO: 253364 - DNA, 353 bp, Homo sapiens
cagagattgccagtggggctttggaagaataagctacacaagtatgtgttacatgagggtgaggccaggctggtagatttccttcaaaatctgagcgcacaccaacgtgttgcacatttctcagcttagcaaagaagcgtgccaaagttaatagaatggaccctttgttggctctcaaaggctacaatggttggcactttaaacataccacgaagccattgcatttgagacggcacccaggagaagcagtcttcgaccgggaacatgcctcttccataattactgccctagaaattcaagtcatcccctatagagaataattttaaaattccaacattattcctgacttcaag

SEQ ID NO: 253365 - DNA, 232 bp, Homo sapiens
cacttaggagagtggggaaccagcagccatgttagagaggaccttataagccatgagcagggctatgaaatgcatgctgagcgcaaagtcatccacacagaggtgagagctgattctgaatctatactcccatattttcaggactaggttcagtgaataagcaaagcaatgggtgaggataaaactgcatttactgagggaagatccagaaattctcgagttagtagtagta

SEQ ID NO: 253366 - DNA, 531 bp, Homo sapiens
ccttatggaaccacaagagtgtaaacagacaagttcatctcagctcttaaactgcttgcctttgtactgttacctgatttattgacaaaaatagttactgcaacataggctgctctcgggtttttaaggaagagtgtagtttagacactatgaaatgtgtttagaaaaagagatgaagttttgcacttgttacccaggctggagcacaatggcacgatctcggctcactgcaacctctgcctcctggattcaagcaattctccggcctcagcctcccaagtagctgggattacaggtgcccaccaccacacccaagtcaaggaaacttttcttttgagctattgacagcttttaacaagttattgtactcctatgaacaaaatttggagcatattcatttctctctacctgatttctccagaatttggcaactgtttgaattaaacttgttttatggagccagtaaaagccacatgctctgtctacacagtcgctgaacagggttcctgccctgtggtaagtaaagaatgt

SEQ ID NO: 253367 - DNA, 491 bp, Homo sapiens
cacatattcccatgtatatgttggagctaaacattaagcacacatgaaaattaacatgggaacaatagatactgcacacaactagacagaaaagggaggaaagtggcacaggttaaaaaactacctactgagtactatgctcactacttgggaccaatatacccatgtaacaatcctacacatgtgtctcctgtatctaaaataaaagagtaatttaaaaaaataggcaaatgactgaaggaagtgagaagacatattctgaaatcctgagagtgaaagttggggaaaggggtggagagagaagcgtgattgatggtggtgatgaggagaggatgataatcaataggttaatgaagagcacacattctaaaggaaatcactcaagaaacgaaggaagatttcatacaaatactcccttatgattgaaaacgaatgatattattacaacaatttaagttggaaaaaaagatatagggtttaaaaagccatgc

SEQ ID NO: 253368 - DNA, 206 bp, Homo sapiens
  misc_feature (49)..(49): n is a, c, g, or t
  misc_feature (84)..(84): n is a, c, g, or t
  misc_feature (130)..(130): n is a, c, g, or t
tgcctgcatcacattctgtccttcccaacagggaatcccaccacatttnccaattagcgctctaatcctgtttgtgtgtctctnctgctctgtgccctggaccccattcattagaatgtcattcattagngatcagagattctgaggacacagagcccagcatcattagtactaattgaagcctggattcctaacctgctgcagaa

SEQ ID NO: 253369 - DNA, 618 bp, Homo sapiens
tcagtcaagtagaggagctcttagtctatagttgtctagaatcttgttactaaaagtatgatctgagaactggcaccagtggtgtcacggaattagaaatacacaatttgaagttccatccaagatctactgaatcagaagctgcattttaagaaagatacctcaaggtgatatatgtatacatattaaactgaactatgtgccacattagatactgagtctttttattctatcatgtttaaaaagcagtttatcttagctatttactgtaccaacttattaaatttatcttatttaacttagtaatttatcttagcttagttagaaagcaatttatcttgccatatttgtttctgcacctgttagatccactttattctgacaaaactttaatattcagctgcctctaccaaataagaggtcattgaagattttttcatgaaagcaacttatgaaaagtccctctgcatctgttgcaaaagtgaggctgaggacattgtttattttagtgattaacttttccttatgtggaggatatttctttaagtgtatcacaaaaatccccctcctaatatgtcataaaatcaacataaaagagtaaaaactagaggaaaaacc

SEQ ID NO: 253370 - DNA, 3024 bp, Homo sapiens
atggaagttttccccttgctcttggttttgtccgtctggtggtctcgaacctgggactcggcgaatgcggattcgatcattcacatcggagcaatttttgatgaatctgccaaaaaggatgatgaggtatttcgcactgcggttggtgaccttaaccagaatgaagagatcttacagactgagaaaatcacattttcagtgacgtttgttgatggcaacaaccctttccaagcagttcaagaagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgaggttgtggagactaatttggttgcttttgactgtcactggatcattataaatgaggaaataaacgatgtggacgtacaggaacttgtaagaaggtcaattggaaggttaacgattattcggcagacatttccaattccccagaacataagtcagcggtgtttccgtggcaaccatcgaatatcttcaacattgtgtgatccaaaggatccatttgctcagaatatggagatttccaacctttacatatatgacacggtgcttctgcttgctaatgcttttcataagaagctggaggaccgaaagtggcacagcatggcaagtctgtcatgtatcagaaagaactcaaagccctggcagggtgggcgctccatgttggagaccatcaagaagggtggagttagtgggttgactggagagctagaatttggagaaaatggaggcaatcccaatgtccactttgaaatccttggaaccaactatggagaagagcttggcagaggtgttcgaaaacttgggtgctggaatcctgtcacaggtctgaatgggtcactgactgacaagaaattggagaataacatgcgtggagtggttctacgtgtagtaactgttctggaagaaccttttgtgatggtctctgaaaatgtcttgggtaagccgaagaaataccagggcttctccattgatgttttggatgccttatctaactacctgggttttaactacgaaatttacgtagcaccggatcacaaatacggaagcccacaagaagatgggacatggaatggcttggtaggagaacttgtctttaagagagccgacatagggatttctgctttaaccatcactccagatcgtgaaaatgtggtggactttacgacacgttacatggactactcagtgggggtactacttcgaagggctgaaaagacagtggatatgtttgcctgtcttgcaccatttgatctctctctatgggcttgcattgctggcacagtccttctggtgggtctactggtctacctcttgaactggcttaatcccccacgattacaaatgggatcaatgacgtctactactctctacaactccatgtggtttgtgtatggatcttttgtacaacaaggcggggaagtcccgtacacgactctggctacccgaatgatgatgggggcttggtggctatttgctttgattgttatctcatcttacacggcaaacctcgctgctttcctcactattacacgcattgaaagttccatccagtctctccaggacctttccaagcaaacagaaatcccttatggcacagtcctagactctgcggtatatgagcatgtccgcatgaaaggactgaatccttttgagagggacagcatgtattcccaaatgtggcggatgatcaaccgaagcaatggatcggagaacaatgttctggagtcccaggcaggcattcaaaaggtaaaatatggaaattatgctttcgtatgggatgcagctgtattggaatatgtggctatctatgacccagattgttccttttacaccattggaaatactgttgctgatcggggatatggaattgcattacaacatggcagtccttaccgagatgttttttcacaaaggatcctggagcttcagcagaatggtgacatggacatcctgaagcacaaatggtggcctaagaatggccagtgtgacctgtactcgtcagtggacacaaagcagaaaggaggcgccctggacataaagagctttgcaggggtcttttgtatcctggctgctggaattgtcctctcctgcttcatagccatgctggagacgtggtggaacaagaggaaaggctcccgggttccatcaaaagaggatgacaaggaaattgacctggagcacctccatagacgtgtaaatagcttgtgcacagatgacgacagcccccataaacagttttccacctcgtcaattgatttgacccctctggacattgacactttgccaacacgacaagcactggagcaaatcagtgatttcaggaacactcatattaccacaacaacctttatcccagagcagatccagactcttagccgcacactgtcagctaaagctgcttctggtttcacttttggcaacgtgcctgagcaccgaactggcccttttaggcacagggcacctaatgggggctttttcaggagtcctataaaaacaatgtcatctattccttatcaaccaactcctaccctggggctcaatctgggtaatgatccagaccgaggcacctccatatga

SEQ ID NO: 253371 - DNA, 863 bp, Homo sapiens
atggaagttttccccttgctcttggttttgtccgtctggtggtctcgaacctgggactcggcgaatgcggattcgatcattcacatcggagcaatttttgatgaatctgccaaaaaggatgatgaggtatttcgcactgcggttggtgaccttaaccagaatgaagagatcttacagactgagaaaatcacattttcagtgacgtttgttgatggcaacaaccctttccaagcagttcaagaagcctgtgaacttatgaatcaaggcatcttggccctggtcagctccattggctgcacgtcagcaggatccctccagtctttggcagacgccatgcatatcccccacctcttcattcagcgctcaacagctgggaccccaaggagtggctgtggactcacccggagcaacaggaatgatgactacactctctcagttcgcccacctgtctacttgcatgatgttatcctaagagtggtcacagagtatgcctggcagaaattcattatattctatgatagtgaatacgatatccgtggaatacaggagttcttggacaaagtctctcagcagggaatggatgttgcacttcagaaggtagaaaacaacatcaataaaatgattaccactctctttgacaccatgagaatagaagaactgaatcgctatcgagacactcttaggcgagcgatccttgttatgaatcctgctacagccaaatccttcattactgagatgtcgttttagaaaaacacttagggaggaaagaatgtgagtgatttttgttttcatgccagagcacagacacttacgtgacaattggagtaaataaagtaagctttgactactgttctctaattcat

SEQ ID NO: 253372 - DNA, 240 bp, Homo sapiens
taggtggcttgcaaagagaaacaagtcagacgcatactcttgacgtggaccccagctctgaggactcccagaccagtgctcttggctcagcaactaggctccagttggttacgtcactgacggctccacagctctcccccaatatgagtgatcgtgtgcccagtatcaggagtggaacagcagctcctgatgggagcctatctgtctccatagcccttgactggtgaccctagccacact

SEQ ID NO: 253373 - DNA, 421 bp, Homo sapiens
tggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggcaacctacactttcttctagcagtgagaggtactgagatccgtcaccccctcctgcaaggccaagacccagagagagccaaattttagcctagaattcagccagctcttcacagtctcccatgttttacattttcctccacaatcatttactttgaaagacttcaaacctatagaaaaattgaaaa

SEQ ID NO: 253374 - DNA, 415 bp, Homo sapiens
catctaggtttgtgtaagtacactttatgatgttaacacaatgatttaattatctaataatgcatttaccagaatgtagccccatcattaagtgacacatgactgtagttgatatttttattttgaaattattttctatttgttagtagaatttatgttccaaccagataacaatgtaaaatatcatgagttaattatattccttttattactaccagtgaaaagaagacacagggttaggtctttttaaaggtaaaaggcaagcctctgttctgtgggttcacagtttgaaaaaaatctatttttgctatttgagataccatgtagacagtgatgggttcaatatagtcataacagtcatgatgagttgtgttctattaatgagttttgagcttattaaatttatcttttctaa

SEQ ID NO: 253375 - DNA, 757 bp, Homo sapiens
cctggtcagtgccccagacgctatggctattatggcagccgggccccatggccttcgaccttcaggattctcctgcttcctcctcagcatcactcttccctttgccaccatcagtggtgacaccagcacagatccacacggctctgggccacctccgcctccaactgaaccaagagtgcaagttcatgatgccaaattcagggcacagataaaccaaaccaacacattcaacatgaacatgcaaacgctctgctgtgatgtcagaagaggcctaacatcctacgcttcagcatgcaacagacaagattccactgcaacaaactgcaaaggagagcctatgtttatttgcactggatttgcagggaagctgctggaagtaagacccttgacccaggcatcttctcatgaggtttttgtcattgctgcggctgttgttaagtgtgcctgtttcaggcagtaaaaaaaaaaaaaaaaaaaaaaaatcagctttattacttgagctcagcccaccaatatgcttcagtatgttccgacatcctgcccatggctagattatgtgacccaacccccatatgtcagtgctgggcagaggaaaaataaaagcaaacaagactgtccctgctgtcagtccaggtctcaccagagagtgagacacataagcagacggaaacggatagttcccaggtattagagtagaggaacacaaaacataggagagaaagggatcctttggactcccccacattcttcagcaact

SEQ ID NO: 253376 - DNA, 437 bp, Homo sapiens
tcttctttcaaagtcattaccacctacatgccagcggtaatgaatttcacaggctggcctgaaatgcttactccctcgaccttgccagccttggttaataggatgttaaactaatctgtgaaaaagcaaattagtgggctcttgcacccactacattagcttgtacttgatctttaaggaatcattgctgttgaaattattgttgctgctgctgctaatttttttctattccgtattctactacctgatggatatctatagccaggtaaatatctgtatatagagatctgtatctatctgtaagcagatacatcgaaccacacaaaattgacgttttgtaggccaaatatgcccaagtaacaaacttcagatggcatagcctaatatgataggatctggaattattttttaataaaatcttattcccaaaagagcaa

SEQ ID NO: 253377 - DNA, 394 bp, Homo sapiens
gaaagcagctgtgtagctatggccaaattgaacttcttgagtcggtgtcctcgcttgtaaaatggacaattctactgaaggaaattgaaggtcttaccgactccatccaaggaattgacaagagatccccaagaaggttgcatagagcgagttctgggggctggaaattcaacatcaaggcacaagcagatcagcagattcagtgtctgttttctcccccagaataacatcaatagaactcccagtgaaagaacgtcttcctaaggcaattctgaagacaaaaaagcaacataagaacacacttcccaataatgtgaagatctatgactgtactaaataaaaatgttcccttaatgtactgtaaaaaataaagatgtttggctagatttatcaa

SEQ ID NO: 253378 - DNA, 699 bp, Homo sapiens
gcttgagttatcacctcctccaagaggaggtgaccaccatatctaaagttgccacctctcctgccttactctccaacagaatataacagttttaaatttgttttttcacttaccaacatatcatgagcaacattccagattgatacatatgtatcttcattgtaatttttattgtccataatttcataatctccattttcaaatggacccttaaaactgcccataatccttctgtttcttcaaaatctttaggttttctgcctttggtgtccaatctctttgtaaagtggccccctctgagaagatctgtgttcccaaaatcaagctgttgtgttttcttttcccttatctggtcaaaatctttcaccattataatggaagacagatcttaagactttaatagattcaatctttttgaaatagagaataaatgacttaaatgcacaaacagattgattcagaaattagcagccagtcaggccaagatatcaacatataccacctatttgcatgttgaatgctttttgtcaatcaagaaccactgcacttcagcctgggagagacagagtgagactccatctcaaaaataaaacgcctacaaccaacaaactcgagggggggccccgtatcccaatttgccctatagcggagccgattacaaattcactggcccggcgcttaacaacgtggtgactggga

SEQ ID NO: 253379 - DNA, 728 bp, Homo sapiens
tcccccgggctgcaggaattggcacgagagagagagagagagagagagacaggaggaggtgaccaccatatctaaagttgccacctctcctgccttactctccaacagaatataacagttttaaatttgttttttcacttaccaacatatcatgagcaacattccagattgatacatatgtatcttcattgtaatttttattgtccataatttcataatctccattttcaaatggacccttaaaactgcccataatccttctgtttcttcaaaatctttaggttttctgcctttggtgtccaatctctttgtaaagtggccccctctgagaagatctgtgttcccaaaatcaagctgttgtgttttcttttcccttatctggtcaaaatctttcaccattataatggaagacagatcttaagactttaatagattcaatctttttgaaatagagaataaatgacttaaatgcacaaacagattgattcagaaattagcagccagtcaggccaagatatcaacatataccacctatttgcatgttgaatgctttttgtcaatcaagaaccactgcacttcagcctgggagagacagagtgagactccatctcaaaaataaaacgcctacaaccaacaaactcgagggggggccccgtatcccaatttgccctatagcggagccgattacaaattcactggcccggcgcttaacaacgtggtgactggga

SEQ ID NO: 253380 - DNA, 691 bp, Homo sapiens
ctattccattatcctccaaaaagagcacttagtttacagatctacagtttaagagcatgcctagtctactcactactcatgtggtcgagaggtttatattctaaaggatgaacaataataccccatttcattgatttctattagattgggcatcttaacatacctttattgatcacttattttttattatttgatttgactatccaaaacttctgaccagctgaggcaggaggattgcttagcccaggagttctctaccagcctggtcaacatagtgagaccccatctctagaaaaaaattttaaaaattagcttagcatggtggcacttgcatgtagtctcagctacttgggtggctgaggtgagagaatcgcctgagcccaggaaatggaggctgcagtgaggcatggctacaccactgcactccagcctgggtgacaaagtgagaccctgtctcaaaaaaaaaaaaaattatgtgatcaattttttgggtagttgtttgtcttttatatggattggtaacatcttcttagatatcatggatatcagccctttattgcctatgttgcaatattttttccaatttattgttaacttttaaactttttaatggtattttgtttaaatttttgtatattcaaatctatctgtattgttatgttttacttcattgttttgtgtcttatggacg

SEQ ID NO: 253381 - DNA, 315 bp, Homo sapiens
atcacacacaatgggatattcaatattcaatagcacacagtgtgccataaagtgagtgataatcaattgtttttcatctcttccatcccagacacaaggccaatccagatgaactgctgttgccacagtctctttcagtgatcttaagtctccaagcccagctcctttgaaaatacggtcttgcctttttatgggacacccactattacagacagaagacatgaaaccagtcaggctgcctggtaaaacgtcactgaagatcagtctctaggaaggaggcaaagctgaatgtgctacaaaactattatttgtcca

SEQ ID NO: 253382 - DNA, 570 bp, Homo sapiens
cctatggcagatagcaatgggcatctgtgcagtctaattgtagtaggcaaagttagccacatcagatacaattttaaattcacctttaggccaattttttccctaatgtcctaacctaatgtctctccagtcctggatctctaggcccagactactgggttaacttgccttagccagagatctttattttgtgagtgacaaaacccaaactcaaacaagcttgcataaactggagagctattggctttcacaactgggaatgacttgggaggcttggagaactgaaggaagagttcctgaccccagggacctggggatggaaatgagggaccctacctggcaggaccttctctcctctccacttgccaggttttattttgtagacaggtgaccacataaggcaggaaagatagtcatctgcaacccagaacctgcctccttgtatcttaggatcccagaggaaaggagaacaactctcctcccactttgatttgggaaatttgggggaaaggctccagttggcctgatttatgttggatgcccacctcttggaccagttcattcactgtc

SEQ ID NO: 253383 - DNA, 388 bp, Homo sapiens
acagattcattgcctttctatagactacgaacaatccaaacaaaactaagacgccattcactagcatggaaacgagaacacacacttaggagccaccttggtgaaggaaactgaagatttatacactgaaaatacgagacattgctgagagaaatggaaagacagcccacgttcattgggtaggagactcctattaagatttctgtctccccagatgggcccatagatcccatgaagtccctattaagatcccatcagcggccagacacggtggctcacacctgtaatcccagcactttgggaggcagaggagggcgaatcacaaggtcaggagatagatagagatcatcctggctaacacggtgaaaccgcagctctactaaaaatc

SEQ ID NO: 253384 - DNA, 324 bp, Homo sapiens
tcttgtagccagactgtaagggtttgaatcctgactctaccacttaatgactgtaggcaaattattttacttttctgtggctcagtttccttacctgtaaaagggggatgtaataatggtccttcttgatagaattgatgtgaagattaaatgagtttgtacctgtaagtgcttagaatgataacctggcaataataagcactcaggttgggcatggtggcccatgcttgtagtctcagctcctcaggaagctgaattaggaggagcacttgagcccaagagttgaatccagccttagcaacatggcaagacctgtctctttaa

SEQ ID NO: 253385 - DNA, 204 bp, Homo sapiens
cctgttctgttctgttctgattactggtgcatgcagcccccagtcatgtaccccctgcttgctcaatcgatgacgactctgtcacgcagaccaccttagagctgtaagcccttaaaagggacaggaattgctcacttggggagctcggcttttgagacgcaagtctgccgaagttcctggctgaataaagctccttccttcttt

SEQ ID NO: 253386 - DNA, 423 bp, Homo sapiens
tccgaactaaccctattccttgggaccagaagacccagtttctaccgcggatagatagcatccgccttatgctaaaagctcttttttctgcggtggtggggggcggcggggagtgtttggaaagaacggttgcaaaaacaaaacaaaacccccaaaaccactcacccaatctcaaccaccccaactgatgaatttcgaagaaagtgctttttaaaaaagaaaaaactagaagaccacagacctcccacagaaagctaaacccatgagagtggcattcaaaaactacccattttctggaacatcttttgtagctaaatcccagccatcctagccccggaacactcccgccctccgtccccgcacccccacccccgccgccacacgcgctcgcaggctgacggaggttggcggtggggcggccgc

SEQ ID NO: 253387 - DNA, 416 bp, Homo sapiens
ttgtagagcactttttccttgtgatcaccagatgtactaagagctgattcacgggcttcactcaggcgtttggctgctggcaggtattgtggatcgtcgttgttctccatcgagtgcctctgattttctgttgccattgtattttggcattagactggtggccagtggtgtcatttgatgtaggaattctgtcagtaagctcttctatcttctctctgaccgtagcctggttcatcagcctttcagctgtttttaggagcgtctcagagtgggatctgttttttaaaactctgaggagatttttaaacctctaaggagaacaattttgaatggtgcctgtgtaactcagggttcttctctttctttcctgacaacattcttaggtttatagaagaaattaattgtgcttgttctgg

SEQ ID NO: 253388 - DNA, 351 bp, Homo sapiens
ttgaagagaagaatgacgtcaatgcaaataaaggataataattatgatctcagggcaaagaggaggattagaaaatcaaaatttttaaaaaactgattatctagagagcaatattctgggaatgcaaatgtttctattgttgaaaaaatgtaccctataatcaagaaaagtaggtcaatagttcctatggccttaaagaattctacagtcttacgattttattctctattattccatgcttaaatagtctaatctattgatttgtctgctttttataacaggaaaagagaaaaaaaacacattcacgaatattctgcaaaataaacacaccattattcactaataaattgt

SEQ ID NO: 253389 - DNA, 1147 bp, Homo sapiens
tagctgggactacaggcgggcaccaccacacctggctaatgtttgtatttttagtggagacgggatttcaccatgttggtcaggatggtctcaaactcgtgacctagtgatctgcccgcctcggcctcccaaaagtagaatgttagctttttaaagatgttgggttagacgaatgttttacagagagagagatcatatacccctaagttactgcttttagtgccctcactcagatgggaatggaagaaaattacaatggcttccatttattgagcctttgtgtgccaagcaagataaatggggtgggacatagttaatatgaggcattacgtgaccaaaagcctccaaaaccatatggtaaacgctgaagaagttaagaggaattcctcactgtatcctcaagtattcaggaaagatttaggaaagaattggaagttgcactgaacctcagagccaaagactagttagtatcctaagcaaattaaggctggaacagaaaaccaaataccacaagttctcacttataagtgggagctacacattgagtacacatggacacaaaagaagggaacattagacatcaggtcttttttaaggatggagggtgggaggagggtgaggactaaaaagctacctatcaggtattatgctgatgacttgggtgacaaaattatctatacaccaaacccccaagactaacaatttacccacataacaaacctccacgcgtatcccttgaacctaaaataaaagttggaaaggaaaaaaaaaaagatttctgtagggagtttatttgagcaaaatccagagggaacataagcttcaagagacagggagtgggccagttagtttgagagaagcaggcagttttagatagaaaatagtgagaggtaagataggttgagggtctttggtactatgaaatgatactatggaatgtgctgaatcttaggttaagtagtttggatactgtaacaaaggtaaatagatgggctaaggtttgagggtaaactagtctgatctatcacttaccctgtaaccattcagttatgtgactttggctaagttacttaaccttttaaaaaaatgtaatcagttttattatcttaaaatgggaataataaaacatctttctgttgtagtgaaa

SEQ ID NO: 253390 - DNA, 374 bp, Homo sapiens
tcgtttgcactgtgaagtggagttaatatatggatgttactgtcagccagagttctcactgtggaagaagagaggttcaagtatggcatagggggccgggcatggtggctcacgcctgtaatcccagcactttgggaggcccagatgggaggatcatgaggttaggagatcgagaccatcctggctaacacggtgaaaccccgtctctactaaaaatacaaaaaaattagccgggcgtagtggcgggcacctgtaatcccagctacttgggaggctgaggcaggagaatggcgtgaacccaggaggcggagcttgcagtgagccgagatcatgccactgcactccagtgtgggcgactgagcaaaactctgtct

SEQ ID NO: 253391 - DNA, 278 bp, Homo sapiens
gagcagaaagcttatttcagggaatcaaaggggcagcaagaaaaaaatgcgaaagacaattaagaaagagaaatacaccctcagcttccaaacctgcctggatacctacgttgagagtgtatcacacacttcaaatgtttgacaaaggtcccagcactaagagggctacgtcagaccaccaagatcctgggcatacctggaagaaacttcaggtttttcagggtcttcagaataacgtgtttacaaagataaataaatttcccctttgctattgacta

SEQ ID NO: 253392 - DNA, 391 bp, Homo sapiens
cacaagtaagacttgtaaaattctctagcccataaagagtcttacaattttctctggaactgcaaaataaattttagacttatcattttgtcatttaaagtccccagatctagagccagaatacttagggatgctggcagagttgcaggaaaaaaaacttctctcccaaggctttgttctgttccagcgagcctgccagttctgcctgtacatccagtgaggggttgtgtaatcccaacacttctgggagcctaccaaccctagaagagcctgtctccaactttaacctggcctggcaggtcccccaaacaaagaaccacttcattgtctgtagaaccagtttggaccacattctgctggatttaaatctataatccacccacctacctgg

SEQ ID NO: 253393 - DNA, 478 bp, Homo sapiens
ctaccaataagagcagggtgctacattgggtgctcctgttctcgcagagtttacagctacaccattacatgaggactgctcccaggtttgctgtgtttaaatgattgacaaggcagaaactttgtcttttcttcaactgattggcactatctacttataacttataacttagcttatttttcactcccccccaaggagagtagagtccagaatggccggtggtagtctcagagtagaagagttgaggtgtcataagataacgacacccttgaatttatttctcctatactttgcttcataaaagtgagcacaaggacagacaggcagaaaatagtagatcactatgtgaggctagagagagtcctctttcaggttcaacaaaggaaagacagaagaaaagtgaataaggtacataaatataagaacataagtgtagacaggtagatgatgaaaaatgggagaaatggaagacgtaaca

SEQ ID NO: 253394 - DNA, 382 bp, Homo sapiens
tttttttacaaaaacaggctgcccataggccatagtttgctgacccctgagatacaaacaaaaacaacaacgggccaggcgcggtggctcacccctgtaatcccagcactttgggaggccgaggcagtggatcacttgaggtcaggagttcgagaccagcatggccaacatggtgaaacctcgtctctactaaaaatacaataattagctgggcatagtggcagctacctgtaatcccagtgactcgggaggctgaggcaggagaattgcttgaacccaggaggcggaggttgcagtgagccaagatcgcaccattgcactccagcctgggtgacagagcgagactccgtctcaaaacaaacaaacaaacaaacaaacaaac

SEQ ID NO: 253395 - DNA, 458 bp, Homo sapiens
cagtgatgggtgatggaagatggaagatggagccagaaggtaaaacccttctggaaagtaatattttaggccagaatctaaaagtgagtaaattcaggtgagtaagagaatggaaacaagtatcctaagcctagcaaatgccacctgccatggccaagagagtgctatggccagagtacagggaagacctcagaaagacaggcaaggagttgggtggagaagacaaagtgaacctaggcagtgcctacaaatttgtgaaatgttattttgaatatccccaaagatggcaaatctttgttttataaaggtgattattgaaagtagctgaatgtcatggagcccaaactgatgaaccatatgaaaaataatctgaaagagtgtcttttagcccaaaacaagatttaagttatgaaataacaacataaacattttcttataaactggctctgaagtaaccc

SEQ ID NO: 253396 - DNA, 502 bp, Homo sapiens
tgggcccacactccccaagagctacatggttgtggggccgtgtggagtgaagaggtcaggaggagaaccaagtcaaggcagaaatgggatgagttacaccatcaaacataccacatgaagcatcgtctcaaatggatttccagtgaattaagaaaaacttggatataatatttcttgtatttccactgagctcataaaagcccaggttttagtctgaaaacattgcagatagtaagacagttggaactgaactgactgcctaaggattgcaccgagctctgccagtacgggcacagggtggaaaatgcatgcacttcagaggctgctggcctagggagtcagaaacaactggactcaaatcccagctccaccttaatagctatacaactttggagaagttgttcagtctttctgaacctcagttttctcatctctaaaatggaataacaattcttcagagttgtactaaatgagtcaataaacgtaaaagaatatattaaat

SEQ ID NO: 253397 - DNA, 119 bp, Homo sapiens
aaaaaaaccccaaaaaaaaacaaccaaaaaaaaaccttatttatgtaaccaaataccacctacctgttccccaaaatcctactgaaaattaaaaaaaaataaaaactaagaacaattta

SEQ ID NO: 253398 - DNA, 397 bp, Homo sapiens
gagaaatcccctaaatagctcataacatacagtgtacttggctctgtgcatgtgagcctatataataatatatttgtagctgggcacagtggctcacgcctgtaatcccagcactttgggaggccgaggcgggcggatcacctgaggtcagcctggccaacatggtgaaacaccatctgtactgaaaatacaaaaattagccgggcgtggtggtgggcgcctgtaatctcagctactcgggagactgaggcaggagaattgcctgaatctgagaggcacaggttgcagtgagccgagatcacaccattgcattccagcctgggagacagaacgagactttgtctcaaaaaatgataattttatgtttgtaacagttacagaaatttgctgcatctaa

SEQ ID NO: 253399 - DNA, 341 bp, Homo sapiens
cccccagtaccagaggacaggttttcagcagtgcaatttcacttttcatgagcaattaatgattttctatggaacaaaactaaaaaagtaggttaaaaacaaacgagttccagattgtgggtcaagaggggtcatttccaaccctagatgtgcaactctttgtctgtgtgatgttgaggaatccatgttaatctctgggccctgcttttttcatggattgtactgaggtttcctgttttgtgtcacacagcttataagtgacagagtcgaccgactgcaagtttctcatggcatctccttgtacttacacatttcctaatccattgggagatgccagtgca

SEQ ID NO: 253400 - DNA, 426 bp, Homo sapiens
tagtagtggtgttctagcttactttctgtgtgggcaggcaggcacggtaatttatcccctgcacgactaaagatcacaagggctaatgctgtgtaaaactgtgaactcagtgaaggtttttctctgttagccccatctttctccatggtctacccactgatggtggccactccctccaattcaggtactccctccaattcaggtactccctctcaccatctgctttctaacttcctctctgatgccttgactgaggcagtgtcgtgtcacaggaagagcacaaacttggaatgatctgggcttgaattccatctctgacttttactagcctgggaaattgtgggaagttgctttctttccttgagcctgtgttcctacatatgcaaagtggggctaataaatgccagctagctgaaaaatctatga

SEQ ID NO: 253401 - DNA, 329 bp, Homo sapiens
aattcccgtgatataatttgctgatagagctgactgagtatttcacaaagtgtggtcctgtgaacactcatccagcagagggatccataaaaactaaacaagcatgggaagcccagggacttctgtccccttcttggagaattactgtgcacattaagggctctcaaaggatccgcaatctgcagtaaaagtctgtttcactttgtttgccctcgtgtttcccaaacatatttgatcacttaaccctttttctttggggaaggtaggtgcctatcaatcattaggtagaacagttagagaaacaatataaacaacacttgaaataaaaa

SEQ ID NO: 253402 - DNA, 415 bp, Homo sapiens
tcttattttgttttattttgctttctaatagaattggaggaaataggaagtatttaaaaagtgtttaaatttaccatcaattattcctgtatagttctctatttttaaaaatatgcccccaagttttgaaattctgattcaatacggactttgaaaggatgtgaaatttgggagcacgtattgctgttactaagactgggggctgtgagagggcttggtgttcccccaagcagtcaggcttgcagagagaatttgtgtcctgctacggtcttttgtaaaggaagctagccccacctgttgttcaaattcattttgcttgcgtgaaagaggaatgctgtccctggaaacctctgtccaagtgcctgttttttctgttgtgggcagcattgcaaaagtgatctgtatcctctcagaa

SEQ ID NO: 253403 - DNA, 486 bp, Homo sapiens
ccatcacccaagcagtgtacactgtacccaatgtatatttatccctcacccccctcttatcctttcccccgagtcctcaacacccattgcattattcttatgcctttgcatcctcatagcttaggtcccacttatgagtgagagcatacggtgtttggttttcgattcctgagttacttcacttagaataatggtctccaaatctatccaggttgctgtgaatgacattatttcattcctttttatggctgagtagtattccatggtattccatggtatatgtatgtgtgtgtgtgtgtgtatatatatatacacacacatatatatatgcatatatatacacacacatatatatgtatatatacatatatacgtatttacgtatatatgtatatatacatatatacgtatttacatatacacacacattattccatggaatacttttatatatatatttatattttctttatccactcatcgatt

SEQ ID NO: 253404 - DNA, 367 bp, Homo sapiens
cccaaaagttccgagacaccttgtctaagccctttactcacagtccaatgtgatttaaccattcaaattttttgtttttgagaatgggctttgctcttgttgaacctccgcctcccaggttcaagcgattctcctgcctaagcctcccgagtagctggcattacaggcacccatcaccacacctgactaatttttgtatttttagtagagacggggtttcaccgtgttgcccaagctggtctcaaactcctgacctcaggtgatccaccggcctcggcctcccaaagtgctgggattacaggcataagccaccgcgcccagcctcaagtattcttttatagcacttactttgtgtcaggtaccattc

SEQ ID NO: 253405 - DNA, 722 bp, Homo sapiens
caaagccaattccagaggacttactattaggacaaaacccctacatgtcagcaaagtatccgactgcttaagagggaggcaaagagataatttttctggccagagtgaacattcaccctctctcctggttccagaaaccacatgcatcaagttggaaacaatggaaggaaatcatttcgagcatcagtgggccagttgaggctacatttggccaattttatcagtgtgttttctggatgagtgccataggagatgggtctttgcttgggcacattcccaactatttgctcgtctttgacagggtctaaaaccatgaggctaaggatgcaccgagaagcaagcctgacttcaataactagccattcacttctgtgccaatttgtgcacggggcagtaacaaactccggaaacagatcagtccaactgagttgctatctaaacctcatcaagccggggaagggatttagtgtttaacagaagagaagtcttcaatgctttattgttaaaagaacgggccagagtaatttaatgatcatataacaaacatgccaagcaataaactgacacatatcaagaggatgcctactttagtacaggctttttattttctaaaacttcctgactagattaatatttgaagtttacgcaagtttaacacagtagtgtcatctacagcagcacatacagtatagtcctatagttctattcttggatatactgat

SEQ ID NO: 253406 - DNA, 366 bp, Homo sapiens
gctgcttcctcatccatgcctttccatttcctgaatttatgaaaaagccctgccataagatggacattgtaagtgtaaaaggctggactctggaattgaacagacctgagtttcagtctgcacctcatgggcaagttatttaacatctccaacctcagtttcccactctgtaaaatgaggataacagtagtaccacaggggtttatgaagattcagtataataacacgagaggtgttcctggtaatcatttagtaaatggtagctgttattttgattattacctgattggattatttgttgtaagaatactgctaaataatgaactctagtgttttaaaatataaatgcatgtttaaaacaattaa

SEQ ID NO: 253407 - DNA, 692 bp, Homo sapiens
gcttgttggggcagatttatctgcctcactttccataactctctgcccatcaggttgctgacattgatagctctcccagtaaggaggaggaggaagaagatgatgacaccatgcagaataccgtggttctcttctccaacacagacaaatttgtcctaatgcaggtaccatacagtgagacctggcacactgaacattgtgtatgtgtgtgtttggtgagaggatagatgggaaaactggacctacttttggggatacccagctaatgagaaaacagaccatgaattctaatcatgttattcattggtttgtccatccatcacatttctcttgagtatctcttctgagctcggcactaagctaggagctagagaaatagcagtgaaaaagtctttgccttattgaactttatagcttagggaacttacatgtgtcctcacttgaataatcttgaagctgatagaattttgtcacatatgtgattctcacctgaccagtctttactccatcttatcttcctttaatttcttcttaacttcacccatgtcaggctttataaattcaagtgacctgattaggtgagtacaggcactcctaggaaggagcagggtcccttggtaccttacagcatcctaagcgctgtgagataggggttcctgactctggtcgcaaaatcagtgcttgacagataa

SEQ ID NO: 253408 - DNA, 249 bp, Homo sapiens
tggcaaggtggaaatcaggacaataactacttattacataaaaccaaatatgatactgatgactcactattgtgcgatgctgggacagctatcagcggaggcaaagctgagggggagaaggggcggcggcgcagctccccagcccgttcccgcatcaaacaggtgaggggctatctagctgcgggatgtgattagagttagcccactgtcagaggtacagtcctgtgtcactgatactttcccaccttg

SEQ ID NO: 253409 - DNA, 593 bp, Homo sapiens
tggcaaggtggaaatcaggacaataactacttattacataaaaccaaatatgatactgatgactcactattgtgcgatgctgggacagctatcagcggaggcaaagctgagggggagaaggggcggcggcgcagctccccagcccgttcccgcatcaaacagggtcgcagcagcagtttcccaggaagacgccggcctcgtggaggagcccatggaggacgtggtagaggacgggcccggctaaagtcaactgcttcttccattgagactctggtagttgctgacattgatagctctcccagtaaggaggaggaggaagaagatgatgacaccatgcagaataccgtggttctcttctccaacacagacaaatttgtcctaatgcaggacatgtgtgtggtatgtggcagctttggccggggggcagagggccacctccttgcctgttcgcagtgctctcagtgctatcacccttactgtgtcaacagcaagatcaccaaggtgatgctgctcaagggctggcgttgtgtggagtgtattgtgtgtgaggtgtgtggccaggcctccgacccctcacgcctgctgctctgtga

SEQ ID NO: 253410 - DNA, 345 bp, Homo sapiens
cctgcattatattcttaagcaaagccttccctgacccccagtgcccatgtaagctcaccacagcacttaccacctagaatttcaatggtggttacgtctctctccactacgctgtgaacagcttgaggatagggaatttgccaactctgttatggtccttgcacccagaataggacgttcttgcccaaacccaccattcttgggatctcaagttcataagcgtcctgttgaaggccctcattcttatagttagccctggggagtccagttctgttaagatgctttcatcaaaaacttcacagttgctcttctgtgctctactctgtagttgggccacactgagca

SEQ ID NO: 253411 - DNA, 711 bp, Homo sapiens
tttggccctaaaatttatatgaaatgaaaaggaaccagaataaaaggatttcgaaacagaaaaagatggagaacttccactacctgaattcaaaacttattataaagctacagtaatgaagactgtaatactggcatagaggcagatatatcgatcaatggaatcaaatagtccacaaataaacctttacattatggtcagttgattttcaacaatggtgctaaaacaatccatggggaaagggtaatcttttcaatgaatgatgtgggagggaaaaaaaagaactttgattcttacctcacatcacacataaaaattgatttaagtggatcatagacctaaatataaaagctaaaactataaatttcagaagaaaaagaggaaaatcttttgatattaagttaagcaaagtttgcttagatatgacgctaaaatcgtgatctataaaagaaaaaattgatagttgacataataaatttagggttgatgcatcaaccctaaatttattaatgtaaactggtaattggtgttaaaaagcataactaataatttggtttctttcttcataacacggaaatttaaatatttctcctgatggtcttgaggttatcaccgttatgagtagtgcacagtgcggcacatatggttccatctggaagggtgtgtctcacaccttatacaagacgccagtaacaaatgcatcatacgtca

SEQ ID NO: 253412 - DNA, 613 bp, Homo sapiens
tttgcaaacagttaattgttcttatgtcattggatttgttgtgccaaatcaaaaggaactaacagaactaacttgaaagaaaggacttacaggaacttgagagtagctctctaacagttgtgaaacagaagatgaggtgcagtagtccccctttatgtgaggtttcgctttcttgggttatacctacagtcaaccgtggtccaaaaatgttaagatattttgagagagagagagagcacattaacataacttttattatagtatgttataattgttttattattgttgttgttaatctcttactgtgcctaatttataaactttatcataggcttgtatgtataggaaataaacattgtatagggtttcaggttccaagactgggggtcttggaacatatcccttgaggataagaggggactaccatacgtaaagtactttctgaagctgctatttgggcgtgtctgaaaaagtttgaaaatctattaaaaattggtttgagccctgacccatgaatcctgaaactggtctggtgacaggtgccttcaagctaaaaaatgatttttctcttttggcatcagtttgctacagtgagttcaaatcaaataggaaa

SEQ ID NO: 253413 - DNA, 560 bp, Homo sapiens
tttgcaaacagttaattgttcttatgtcattggatttgttgtgccaaatcaaaaggaactaacagaactaacttgaaagaaaggacttacaggaacttgagagtagctctctaacagttgtgaaacagaagatgaggtgcagtagtccccctttatgtgaggtttcgctttcttgggttatacctacagtcaaccgtggtccaaaaattatgttataattgttttattattgttgttgttaatctcttactgtgcctaatttataaactttatcataggcttgtatgtataggaaataaacattgtatagggtttcaggttccaagactgggggtcttggaacatatcccttgaggataagaggggactaccatacgtaaagtactttctgaagctgctatttgggcgtgtctgaaaaagtttgaaaatctattaaaaattggtttgagccctgacccatgaatcctgaaactggtctggtgacaggtgccttcaagctaaaaaatgatttttctcttttggcatcagtttgctacagtgagttcaaatcaaataggaaa

SEQ ID NO: 253414 - DNA, 505 bp, Homo sapiens
acataggggattatattggttgcatgtatgtagtggcagggatatcctggattttattacatttttaaatatataatcttatgttcttgtttgttgatatgaaaaattaacattcttagaatgcggggaagctttagaagacataactctttagccatgtggctaaattttgtgtagttttcatacagctttgaaaggttaaatgagaaagtctctggcagtaacagcatacttttgatgctattgttaattagttttcatcagcactaccaatgaaagctatctgaacacccaggttccatctttaaaatgaagttacaactagacctgatttttaaatttggactttccttaatttggtttaagaatggtattgaaaacgaaaggataatgcattttaactttacctttgcctgcttttaaatacaagacaaatcttgacaatgaactcttagttgatctcaagttgcatcaaactaataaatgtgagtcaatgataaaattg

SEQ ID NO: 253415 - DNA, 417 bp, Homo sapiens
ctcaaaaaaatccaaaatttaacaattagctggacgtggtggtgcatgtctgtagtcccaggtacttaggaggctgaggtgggaggattgcttcagcccaggaggttgaggctgcagtgagccatgatggtgccactgcactccagcctgggtgacacagcaagatcctgtctcaaaaaacaaaacaacacaaaacaaaaacaaaaacacccccaaaacttaaagtgatggtatgtacttcatgttgcatcccattaggaggtacattatttcagttgctcacttgtagtaaaggtgatggttaggttgatggccctcagaactctccatgtaattttcctctttgtaattaataagaaatctgtgggatgttggctgggtgcagtggctcatgcctgtaatcccagcactctggga

SEQ ID NO: 253416 - DNA, 2922 bp, Homo sapiens
  misc_feature (407)..(409): n is a, c, g, or t
  misc_feature (414)..(414): n is a, c, g, or t
  misc_feature (427)..(427): n is a, c, g, or t
  misc_feature (432)..(434): n is a, c, g, or t
tatttttattgaggctaatatattatcctttggtgccatgagtggatgaagaaactttcagaaggctaaacgagtggatacaagaaacttaggcaaattattacaccacaggggtgtgagaaataatgaatattctctactaggtttcagcaaacataatccaagctgatcaatttaggacacttccactgaagagacgtgaagtgtacgttcaactgaagtgtcattgtaattgtgtgccttctcagttattgggcaagttaaagagcatgatgaatgtttgtactataatggtgtaaatccttctgatttcttgcatggaagacatgtggcatcatgtagaacctgctttgacattgattctcaattgtatgagttgctcctctgattttagatcacatttgtcnnnatcanttggatatccaantgatnnngacacggttttattttagttttagacatatgacaaatcatgccatgtttgaaattgtaagtatattttgtgaagcctgtattcacctttttcagtgtatttctgtcatattccagtcccgagtcacaaagtagaaaacatcaaagcctatactaatacaggcaggaagatacatcttgatgccaacagtgcaggaatgtatggataactttatcatatttacatatgagtgattatgtatcccttttgcttttcagtgtcttctcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacagtgtctcctcagaaacaatcggcccagaaggttatatttaaaaagaaagtttctcttttgaatattgccacaagaataacaggcggttggaaatctggaacagagtatcctgagaatctgcccaccttgaaggctacaattgaaaataaaaattctgttctgaatacagccaccaaaatgaaggatgtacaaacatccacaccagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagagttgcaccaaaaagttagggaaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatggggaaacattagcaaaaacgatagcctgttatagtggacagcttgctgctctgacagatgaaaacacaacgctccgttccaaactggagaagcaaagagagagcaggcaaagactggaaacagaaatgcaatcataccattgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaaacaggaaagattttgtcaactaaaaaaacaaaatatgttgcttcaacagcaactggatgatgctcgcaacaaagctgacaatcaagaaaaagcaatacttaatattcaagccagatgtgatgctagagtacaaaaccttcaagctgagtgcagaaagcaccgtcttttactagaagaagacaataaaatgttggtcaatgaactgactcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaagtatgtatgcaactttgcacaccaacaactgttaatctgtagctagttaactaatataaagtgttttggggtactaattttagtggatggctttcttttgtatttttatgataattaatgttattaaaattttatagtggatggc

SEQ ID NO: 253417 - DNA, 2346 bp, Homo sapiens
tccggttccgaatacggccacggaaaaaaaggatgaacattatctgggacaggtttcagcaaacataatccaagctgatcaatttaggacacttccactgaagagacgtgaagttgtcttctcagaaacaaccagccttgaaggctacaagtgacaagaaagattctgtttcgaatatacccacagaaataaaggatggacaacaatctggaacagtgtcttctcagaaacaaccggcctggaaggctacaagtgtcaagaaagattctgtttcgaatatagccacagaaataaaggatggacaaatacgtgggacagtgtctcctcagaaacaatcggcccagaaggttatatttaaaaagaaagtttctcttttgaatattgccacaagaataacaggcggttggaaatctggaacagagtatcctgagaatctgcccaccttgaaggctacaattgaaaataaaaattctgttctgaatacagccaccaaaatgaaggatgtacaaacatccacaccagaacaagacttagaaatggcatcagagggagagcaaaagaggcttgaagaatatgaaaataaccagccacaggtgaaaaaccaaatacattctagggatgaccttgatgacataattcagtcatctcaaacagtctcagaggacggtgactcgctttgctgtaattgtaagaatgtcatattactcattgatcaacatgaaatgaagtgtaaagattgtgttcacctattgaaaattaaaaatacattttgtttatggaaaagattaataaaacttaaagataaccactgtgagcaacttagagtaaaaattcgaaaactgaaaaataaggctagtgtactacaaaagagaatatctgaaaaagaagaaataaaatcgcagttaaagcatgaaatacttgaattggaaaaagaactctgtagtttgagatttgccatacagcaagaaaaaaagaaaagaagaaatgttgaagagttgcaccaaaaagttagggaaaagttaagaataacagaagagcaatataggatagaagctgatgtgacaaaaccaattaaaccggctctcaaatcagcagaggtggaattgaagacaggaggaaataattcaaatcaggtttctgaaactgatgaaaaagaagacctgctgcatgaaaaccgcttgatgcaagatgaaattgccaggctcaggctggaaaaagacacaataaaaaaccaaaacctggaaaagaaatacttaaaagactttgaaattgtgaaaagaaagcatgaagaccttcaaaaggctctaaaacggaatggggaaacattagcaaaaacgatagcctgttatagtggacagcttgctgctctgacagatgaaaacacaacgctccgttccaaactggagaagcaaagagagagcaggcaaagactggaaacagaaatgcaatcataccattgtagactgaatgctgctcgatgtgatcatgatcaaagtcactcatcaaaaagagaccaagagcttgctttccagggcacagtagataaatgtcgtcacttacaggaaaatttgaattctcatgttctgattctttctctgcaactttctaaagctgagagtaagtccagagtcctcaaaactgagctccattacacaggagaggctctgaaagaaaaggctttggtttttgaacacgtgcaaagtgagctaaagcaaaaacagagtcaaatgaaggacattgaaaaaatgtacaaaagtggatacaatacaatggaaaaatgcatagaaaaacaggaaagattttgtcaactaaaaaaacaaaatatgttgcttcaacagcaactggatgatgctcgcaacaaagctgacaatcaagaaaaagcaatacttaatattcaagccagatgtgatgctagagtacaaaaccttcaagctgagtgcagaaagcaccgtcttttactagaagaagacaataaaatgttggtcaatgaactgactcattcgaaagaaaaagaatgccaatatgaaaaagagaaagcagaaagagaagtagctgtgagacagcttcaacaaaaacgagatgatgtcttaaacaaaggatcagcaacaaaagctctgctggatgcttcatcgcgtcactgcacctatttagaaaatgggatgcaggattcaaggaagaaattagaccagatgagaagtcaagtatgtatgcaactttgcacaccaacaactgttaatctgtagctagttaactaatataaagtgttttggggtactaattttagtggatggctttcttttgtatttttatgataattaatgttattaaaattttatagtggatggc

SEQ ID NO: 253418 - DNA, 579 bp, Homo sapiens
agaagcacaatcagtatttcattatttatgaattctcaattgaattatcctatcctgtccacacacataatagcattagcatttcttcttataccatgttgaaatacttttaatacaaactctcaatagaagcttaaacataagtggttaagtcttgttgtctagtctcattcacctgcctcaacatgctttctttcattctatttgcatacaaaatgttcttatttcagttttgtagacaggatatgagttagcatactcgtgtttgttcagctgtccatcctgcatcgttactacaatgcctttttctgccatttaatggtgtttgtatcaatgttcccatatctgctgcattttaactccataaaaaggaaatgtgatttcgtattaatagttttgttgatcaactcaatatttctgcaccaatcagcatacctatatgcatgtagtagtctgtacaattgttcaacatcaaaatacttgtttactttatgtcaaaatgtctataaaattgctggcattgttctccatttcagtctggtagaataagcgagatagaaaataaatgtgtaaatgaat

SEQ ID NO: 253419 - DNA, 532 bp, Homo sapiens
cctaacgctccatctacccaaactcagatacaggcacacatctagggttggctgaactgagctctttcttcccctggtggagctgatgagtccaaagatagataaagaacttgaaattttatgtatgaatactggaagtcagatgtactcctcctagctaaatatatatgaagatagagacccggtgcttctagcaggtgttgtttccacaacatgaagaaagcctgtctgagaataaaatcaacctacaccacggggcgtagtggctcacgcctataatccaagcactttgggaggccgagtcgggtggatcacttaaggtcaggagtttgagaccagcctggccaacatggtgaaaccttatctctactaaaaatacaaaaattagctgggtgtcgtggtgcatgcctgtaatcccagctattcgggaggctgaggcaggagaactgtttgaaccagggaggcggaagttacagtgatccaagattgtgccactgcactccaacctgggcaacagagtgagactccatct

SEQ ID NO: 253420 - DNA, 293 bp, Homo sapiens
tctctctctctggatacttgtccttggaccccagccaccatcctgtgaggaagcccagagcacatgaagagaccacctgcacatgttcagatccactgccccagctaagatctccgctgacagccagaccaatcaccaatcttaggagctggcgagccttcagatggtccaacctttgaggccccccagaggagccaggtggagcatagatgagccatccatgtggatccctccaccaaatggaagatttaggagcaaaataaacaatgttgtcattgctttcacccaaaaat

SEQ ID NO: 253421 - DNA, 405 bp, Homo sapiens
cctggatgcattgtaaatggatttcctcttccacagggtctggctgttttgcccagaatggagtgcagtggcgtgatggtctcggctgacagcagcctcgacctcctgggctcaagccttggcctcccaaagtgctgggattacagccaccatcctgtgaggaagcccagagcacatgaagagaccacctgcacatgttcagatccactgccccagctaagatctccgctgacagccagaccaatcaccaatcttaggagctggcgagccttcagatggtccaacctttgaggccccccagaggagccaggtggagcatagatgagccatccatgtggatccctccaccaaatggaagatttaggagcaaaataaacaatgttgtcattgctttcacccaaaaat

SEQ ID NO: 253422 - DNA, 606 bp, Homo sapiens
cctggatgcattgtaaatggatttcctcttccacagggtctggctgttttgcccagaatggagtgcagtggcgtgatggtctcggctgacagcagcctcgacctcctgggctcaagccttggcctcccaaagtgctgggattacagccccacctgcagagtcaagtccctcctcccacctcagcactgctagaaaagagcttcaggatggagccacacatgtcactcaagcccaagggtcagtcaacagcccacagccctaaactcatcttgtccaatgccagaccctgcaactgctgatttacatgaatcaactccatcatgcaagcctcatgacatcccaatgagccaccatcctgtgaggaagcccagagcacatgaagagaccacctgcacatgttcagatccactgccccagctaagatctccgctgacagccagaccaatcaccaatcttaggagctggcgagccttcagatggtccaacctttgaggccccccagaggagccaggtggagcatagatgagccatccatgtggatccctccaccaaatggaagatttaggagcaaaataaacaatgttgtcattgctttcacccaaaaat

SEQ ID NO: 253423 - DNA, 431 bp, Homo sapiens
ggcagcattcagttccttgcaacctgctcactgaggtcaccagtttttgctggccgttagctggaggctacctgcagttccttgtcacatgagcctctcctacattgccacttatttcatcaaagctagcaagggagggcatctccctgcagggcaggcattatagacttacataacgtaattacatatatgtaatcaaaagactgccttttctctgtggtgtattctgttggttagaagcaaggcacagcttccgtccacacccaaaagaaaggggttacacaaaggcaggtgtgaacatcagcaggtgggaatcatggggccattgtagagttgtctaccatggtttgcttattggtcttttaatcatactgccacagattgggctgaaactggacactggcaatgctgccaccttcagggtctcagta

SEQ ID NO: 253424 - DNA, 250 bp, Homo sapiens
gagcctgccagcaccagtacatgccaggacctaaggccaggatcaagtccacaatgagcagggcccagtgcaaaatggaaatgcagggccccttgatcaaacccattaggtgggttcagtgtacactgctcaggggatgggcacaccaaaatctcataaatcaccactaaggaactaattaaccaaataccgcctgttccccaaaaacctatggaaattaattttttaaaaagcgtatagcaacaagaca

SEQ ID NO: 253425 - DNA, 474 bp, Homo sapiens
caaaaaacaaatttgtactgcaagtataagtaatatctctttttctctctctttccccacttccttctttccttcttttctctcctttttttcctttctccttgtctcccttttttagaaatttttctagataaacatgttactattatgctaatacaaaaataaaactactcagttggttattttataccattagtccctcataattttcctctccagattataatctcttttaaaatttttgtgtctcatttagtaagtttcttggaggaagaaccatactatatatgtttcgcagttttttgcttagcattcaagtagatcttagcaaatcctaccagtatcaaataattgcccttcttctatccccacacctttagagtttcaggtctctactatccgattccttgacttcccaacccagtcaaagatacatgatttgcttggaattgtgtgtttggggcatgtacacac

SEQ ID NO: 253426 - DNA, 382 bp, Homo sapiens
tacaggctgcttggtatgctccatgaactttataatttttaaagcaatacacatttctgaggttatgtaaatcaaatttttgacaaaaacttttctgggaaatgcttctttgattttacaattcagactcctagagtatgacagctggaaaaaaagcgataatctatcaactcatttggcaaaggtagaaaccgaggctcggagatattaagtgatttccctaggatcacatagctagtgtatcaaatccaagaatagaactcaggttacctgactatagtccggcactttttctattatctttttctttctttttttttttttttttctgagacagagtcttgctgttgttggcctgggctggagtgcaatggcagggata

SEQ ID NO: 253427 - DNA, 298 bp, Homo sapiens
tacaggctgcttggtatgctccatgaactttataatttttaaagcaatacacatttctgaggttatgtaaatcaaatttttgacaaaaacttttctgggaaatgcttctttgattttacaattcagactcctagagtatgacagctggaaaaaaagcgataatctatcaactcatttggcaaaggtagaaaccgaggcaggagaattgcttgaacctggaggtggaggttgcagtgagacgagattgcgccactccactccagcctgggtgacggagggagattctgtctttaaaact

SEQ ID NO: 253428 - DNA, 500 bp, Homo sapiens
ataaacaaaagcagaataagctaatatggagcaaattccaatatggttaagtaaaaaatagcaaagagtaagagtaactataggatgtatccttttttttataagaaaaaggaaagtatgtgtatgggggataatgaaaaaaatacatatctatgtgcattgccttgcaaaaacagtgcagagggaataaaccagagtgtgatagattatctatgagggtggtgtttgaatagggtggaaggatccatgtgtttatgtttttacatagtttggattttggaaacgttaatattttgcataccaagtatatgtttaaataaacaaggagagaaaagccaagaactgaaatacaaacggaaacaaatgaaatcaattttttccaaatgaaaatgtaactatactgtagtgaaaaaaattagcatcattaccttttaaacacagtacttttactatatactgtatacaatcaatcaaaagaaaaaaaaaagaactccaaacga

SEQ ID NO: 253429 - DNA, 715 bp, Homo sapiens
agaaacctgaaggaagtaaaggaatagtgaaagagcaatgtaggcagcagaaataagtgcagagaaaggccttgaaaagcttttaaggtcaggactcgtctagaagagaatatacaaggggaagagtcttaaatgaggaaattacagagatagttggggctatgataaagaaagaatattttcttagttgaaataagaagctagcttagtagctcagagtgaaggggataagaagataaaggaagtaagagcaaagaaaagaaggtatgaaataattgtccagtgaagtggaagagtcacttaattaaaagatgtagtaaaacgcaagacaatactgaagatccacttaatgttaatctgcttaatgtatcctactaaatgtggctggagaaagggtaatgatcttttctccagccagaatttagctgcttgggtggtattatactgtataatggatggaaaattggatataactagggttgggattttgccaggcaaatacattgaaaaaaaaaaaaaaaagcaatagggagtattggtaaagatggaacatgaaatttaggcaatgtaaataaaaaagtttgaaaacttttttttcttttttacatgttcagtatatgcctttcttgtatgttctctaaaaatcatccacaaaatttagctataccagaaaaggtggagtaatgaccacctccctgcaaaattcaagaaagaa

SEQ ID NO: 253430 - DNA, 442 bp, Homo sapiens
ccaatcacccagatcaagatttgggtcctttctaggttctggggaagtgccatatcccctcccagtcgttacccctcccctgtcccctaagggaggacccttccaacctctatcaccatccctgtccttgaacttgacgtggacggagtcacattcaatgtttctttttcattgctacacagtatttcatggcataaatttaccgcaataggggcaggcgctgtgtctcatgcctgtaatcccagcactttgggaggccaaggcaggcagattgctttgagctcaggagttcaagaccagcctgggcaacaggatgtaaccgtctctacaaaaattcaaaaattagccaagcattggtggcttgcgcctataatcccagctactcgggaggctgaggctggagaattgcttgagcccaagaaagcagaggttgcagtgagcc

SEQ ID NO: 253431 - DNA, 478 bp, Homo sapiens
acccttcatttctccaaaatatttttatattatttctttgataatttgtcttcctattattttcctttctttttggaactcctattatgtattatttctctctcgtttttcaattctttttctttcctttctatctttctgggagattgctctgactttactacaatgctttgatttgattttttaaattttggcaaacttatttttaagaattcttttttttttcttttcttactgttactgtctccctcaaataagaatgccttatcttcctttccaggaatattgaagataaataagtaactctaaggtgtaaatcaatgaacttgactagacactgtcacaaaactcataacaatagtaatcttaagcagttttggtgggagtgacagaaacccaattcatgcttattgcacttgctgctaccactagcaaggtaggagtccccatagagagagaagccctttttttaaaaaca

SEQ ID NO: 253432 - DNA, 280 bp, Homo sapiens
ccccgaggttcaggggccggtattagcaacccaattaatcaatgaagatgtgatcaaatgaaagcatttaagagcggtatggagagagaagttgacgacagacttggccttctttacaattctgccaggcctaagcctaaggagattctatcaggacgtggcattgcagttggccacattaaaggacacagacccgacctgtcacctacatgccttcaggccttgcctgggcctctgatacatgtcttcactgataattttggagctcttatcatcttcc

SEQ ID NO: 253433 - DNA, 538 bp, Homo sapiens
attccgcctccctttctgtacccattctcagcctccacctcagccttccccacattctttctgcatctcgttctgcccccttgagctcctcatctttttccaccccctgcttggccttcacagtgtcccagccctgccttctggctatgcagcaccccacacactccccaagtgcccctgcatccagtcttctccctctccagcctcccatttcatcgaaaagtctctgctagctggtgggacagagcgttgaatataatatttcatactgtgaggtgaatggctgataacccttccccactccaacactcaatgagtggctttgcaggtggtacagaaaagaaatttaggagcagggaattccgctcagaaaaagaagagtctcctttctggggagagaagagaaagagagaattctatgcccatggccctcctttacctgctcttctgaggggagctgatcggctttttgagcagagcctgaagctggccattcttgcctttgtctttccctcagtaaacatctcttgagcacctg

SEQ ID NO: 253434 - DNA, 319 bp, Homo sapiens
tatttgtttcattttaaagatgaggaatttgtgctccagaacaatccagtgatttttctcaggatctcatgggatgacagggcaggtctcacctgctaggaactgtgcgttctttgctttgcttttgtgtcttattttattctagataggaaggaattttccattcaggtttatattatttttattatggttggaattgctgtcataaaggacattccatccaggtgtcaataataattttccagtttgcaaagaagaagctcaagatttagaatctggaaaccttgattgtactctgttctgattctgctggcccgtg

SEQ ID NO: 253435 - DNA, 271 bp, Homo sapiens
ttcatctggccagaggagacacaatactttacctttactcatccttcaatttatcaaaatgttgtattttccttattatttgcactatgtaaatattgttttctcatacaccaaatagtatctgatgattacattttgtattatgtaactttttatttttcctggagttaaactgtgttacttttaaaatttgttagttttttctagccaaatcttcccatgatgtacaaaagctctgtcaaatgttcccaataaataacttatctcttat

SEQ ID NO: 253436 - DNA, 131 bp, Homo sapiens
tcatgtggtctaggggttgacaaattatagttctcaggtcaagtctagcctgccacttatttttataaataaagttttattggaacacagccatactcatttagttgtttcttccttctcctcctcctcct

SEQ ID NO: 253437 - DNA, 280 bp, Homo sapiens
ctccctggccagtacctaagcatcttgtcttagtcaccactgcagccgcacagctcagacaatgcacgtggaaaacaggtggatgtaaagatttcttgaaagcagcaatttaacaaactctgatctgatgcctcccctatgctctttcactacaccacgctgcttcccaggaaaaggataaatgtgtgtacagttcgtcattctctcctaacagattcaaaggtccatggctcatctgcttcttcttcatgtactacaaagcccagcaccttgtaaatgc

SEQ ID NO: 253438 - DNA, 312 bp, Homo sapiens
gtgaggagctcggagcctagctccctggcatgggcagttcacaataggattcatgctcgtatgagaagctaatgctgccgctgatgtgacgggaggtgatgctcaggtggtaatgctttgcctgcccacctctcacctcctgctgtgtggcctggttcctaacaggccctggactggcaccagtgccgatgcaaatgacgggcataagggcactgtgggtgggggctcagggaatgccctgtgctacctgctccctgctctgtaaaccaaaaactgctctacaaaataaagtctattcacttaaaaaaaaaa

SEQ ID NO: 253439 - DNA, 449 bp, Homo sapiens
actttgaaaggtctgtctgcatttagatggtaacgctcattataaatatttttgtatattctgacatatttatacaaaaccttctttcatttgatgctgttctagtaaatcatctggctttctacacctaatgtggtaacactcagttcttgttaagaaaaattaaccaggccgggcgcagtggctcatgcctgtaatcctagcactttgggaggccgaggcaggcggatcacgaggtcaagagattgagaccatcctggccaacatgatgaaaccccgtctctactaaaaatacaaaaattagctgggcgtggtggtgtgtggctgtagtcacagctacttaggaggctgaggcaggagaatcgcctgaatcggggaggcggaggttgtggtgagctcagatcacgccactgcactccagtcaggcgacagagtaagactctatctca

SEQ ID NO: 253440 - DNA, 419 bp, Homo sapiens
caccctagattttcctccggtttctagaaatgtcaaatagaagattcactgatttttctaactgcttataaacttttgcctaggggattattatattaaatctttgcctactcactagataaatgcctcttgcttaccttagtgtatttggtaaacatttatacaatcaagattccaaatggctccattaccattaacttatcaacataagtgaaatgttaagctttgagtttaagagagatcaaataacttatagggaatgatattttcttctttcaaaaggaaagttttcactgctgattatctatgattaagctagaataacaagttaaaatcctggtcaggcagttattctttttttctttgttacttgggataattttgaacatagaaccttatgccatgataatgctttgcag

SEQ ID NO: 253441 - DNA, 1968 bp, Homo sapiens
ttgaattcctcgacactgttggcctactggttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcagcactgggctcacttcctctcatttccatcgtgggatatgttgacggaggtatccagttactctgcctgtcctcacgttttccagccctcaccttggcgcctggcttctattttactcgggttactctgtggtgccctgtgtggtgttgtcatggggatgataattgttttcttcaaatccaaagggaaaatccaggcggaactgggtatgtgtcatgtcctgagcctcccacacatggttctcccgggtccctccctgatccacagtttgagcctctggacgaccctggctgcaggctggacaggaagcaccgactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaagttcttctgcgctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattcc

SEQ ID NO: 253442 - DNA, 2066 bp, Homo sapiens
atgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggagcgttttccagccctcaccttggcgcctggcttctattttactcgggttactctgtggtgccctgtgtggtgttgtcatggggatgataattgttttcttcaaatccaaagggaaaatccaggcggaactggactggagaagaaagcacggacaggcagaattgagagacgcccggaaacacgcagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaagttcttctgcgctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattcc

SEQ ID NO: 253443 - DNA, 414 bp, Homo sapiens
cccctcttctggctcaagcatttgttggaatggctcacaaaactcaggaaggacccacgtgtgaagcctgtgagtttgattgcactgcaggaggaccccctaaagctactgctgcaaaatgctcctagagcaaaggcccttcagggtccaggtgaccatggtactgctggcttggagaccacactctgaggggccagaatagaggcaattgctcagctctccatttttgtgttaaacgcatttacaccctcactgattgtttggtgttacattatcttctttcaaggagaattcttgcatgagggctttaaatagaatcctgtgggaataactccttttaaagggaagttgaaagcacttaactcagccagaactcggtatgcatcaaaggaggaaaaaagaatataaagaaga

SEQ ID NO: 253444 - DNA, 362 bp, Homo sapiens
cacactgtatttccatcatcgcttttaatgagacttctttgcaaatatgtatggtatcttttaaaatacctgataaccagccagcaggggtggtcagctgctacactggtagccacaaacagaatccaagacacagaacttcatacggtgtcacagcttcattttccaggctacagctcccactgcccacatcagaaccatctgcaggtccataagctgtgagtttctttgggagttgggggagtgtcttttggatgtttataacttatgcatcttaatattgaatgtgcacttaatacatggaacttcatagtacttgattttttatgcaaaaatgacttaattaaaatttcttgaagaaa

SEQ ID NO: 253445 - DNA, 961 bp, Homo sapiens
tgatttctggtcttcttcactgctacactcccactagcaccaggacagtttacaaatgccatggcaatatcaggaagttaccctatatggtctaaaatgggagtcatgaataatccaccccttgtttagtatatcatccagaaataaccacaaaaatgggcaaacagcagcccttgaagctgccctgcctatgatgtagctattctctattcctttaccttcactttactgtatggactcaccctgaattctttcttgcacaagtccaagagttctcccttggggtctggatcctgacctctttccagtaacacatgtaaggtatacattggttggcccaaagttgtggaatatttcaaagtggggacttacaggtaataggtgaattcaaggattttcgtgatcagtcacttggttgaaagaatttagctttgtctaaagacagtagaaagaaatgcttgagttaagaaaaggaaggttatggaagccaaggttcttgttatgtagatgaagcctctaggtagtattcttcagagagaatagatggtcaatgtctcttttcagattttaaatagagtccaactcagttaaatctcctctagacctggcaaagacctagaaagggaaagagattctaaagatgcaaaattttaccccacaaaaggctttgcagggccatttcaacatatgtcagataaatatattttgaagtaaagtgtgttaatttctttcagggtctgctgtcatgtgatgctataccagagtcaagctggaatttggcatcttagtgccaaagggtctgtttcatccatgaagggatgtctattttaatgttaatgctgggcctagtatgaggtgagtgcctaggcattgccatgtagacgctgtctgagagatgaaggtcattctccaaggagcagagaaaatgagtatcgtcctcatcaaccaagttaccgatcaa

SEQ ID NO: 253446 - DNA, 460 bp, Homo sapiens
caattgttctccttggatactccctctggtctctatgtagacagagaacgttctcctccagcctctgttgatctctgaaggtctttaattcaaaatgcacgttacatcagggaccactattttgggggtctgctgtcatgtgatgctataccagagtcaagctggaatttggcatcttagtgccaaagggtctgtttcatccatgaagggatgtctattttaatgttaatgctgcaggtcaagcagtacctgagagcactgaggagcacctggacccagtaacttctctaaatctagtgtgggggaagatgcacccctgccacggagccatgttctatggcaggcaaccactggtcaataaaaaaaaatcagatgatgtcaagtgtatatctaattgacattaaaatacacatttgaaaatttggaaatccttttttaaataaaatttttaaatttcatt

SEQ ID NO: 253447 - DNA, 1068 bp, Homo sapiens
tgatttctggtcttcttcactgctacactcccactagcaccaggacagtttacaaatgccatggcaatatcaggaagttaccctatatggtctaaaatgggagtcatgaataatccaccccttgtttagtatatcatccagaaataaccacaaaaatgggcaaacagcagcccttgaagctgccctgcctatgatgtagctattctctattcctttaccttcactttactgtatggactcaccctgaattctttcttgcacaagtccaagagttctcccttggggtctggatcctgacctctttccagtaacacatgtaaggtatacattggttggcccaaagttgtggaatatttcaaagtggggacttacaggtaataggtgaattcaaggattttcgtgatcagtcacttggttgaaagaatttagctttgtctaaagacagtagaaagaaatgcttgagttaagaaaaggaaggttatggaagccaaggttcttgttatgtagatgaagcctctaggtagtattcttcagagagaatagatggtcaatgtctcttttcagattttaaatagagtccaactcagttaaatctcctctagacctggcaaagacctagaaagggaaagagattctaaagatgcaaaattttaccccacaaaaggctttgcagggccatttcaacatatgtcagataaatatattttgaagtaaagtgtgttaatttctttcagggtctgctgtcatgtgatgctataccagagtcaagctggaatttggcatcttagtgccaaagggtctgtttcatccatgaagggatgtctattttaatgttaatgctgcaggtcaagcagtacctgagagcactgaggagcacctggacccagtaacttctctaaatctagtgtgggggaagatgcacccctgccacggagccatgttctatggcaggcaaccactggtcaataaaaaaaaatcagatgatgtcaagtgtatatctaattgacattaaaatacacatttgaaaatttggaaatccttttttaaataaaatttttaaatttcatt

SEQ ID NO: 253448 - DNA, 461 bp, Homo sapiens
ctggtccttatgaagaattctgtgctcgcaggaaagatctgtaggaataatgaaatgctttcttcattgatgagatgaagtctctgtttttcaggcaagttgacagaacaaaacaatgagaaacgaacttctttagaaggttgaatgaaagtaagatctagatgaaaaagtcattggccaaagataatttttaaaaaaaaacattctatgttaacccttggaaaaaaaaacaaaaaacaacccagagaaatacaagaaaacaatgtacacattcatttcactgacagttacaagaaaatagccgtttatagaagttacacaatgctttcaacaaatcccaaacaaattttgggaaacagataaagccattgggtaaaaataaatatacatactagctaatataaaacaatttatggttacgaattgtcatcaattctcttaggacacaaggagaaatatgg

SEQ ID NO: 253449 - DNA, 187 bp, Homo sapiens
ggtcagagatggggaggtctcattatgttgctcgaactcctgtactcaagcaatccccttgtctcagtctcctatagtgctgggattagagacgtgagctactgcgcccagcccctctgtcttcattactgtgcttccctcgctaaatctgtacatatctctcattctccccttctctctctagctc

SEQ ID NO: 253450 - DNA, 434 bp, Homo sapiens
tctatcaatgccttgtatcagcctcaaagcagcctgttcaagttaactccctgttgaactccagggcctatacctctcttggctgaatagatataagaacatccttgcctgatgggttcatattcctcttcaattctgctgtctaaaagaagaagagatggacttctttcttccctgatccctgatacaaataatccctgggagagacagtaatttgaaaatgagtcattaatgctgtgtctacattacagagatataattcccattccaacagccaatatttattgtcggtttattttagtcatctaccttaggaattcatttttggcaatgctgggttatgctgagtttatcttactaaaatagaatctgtgtcaaaaacccccaatgactttagcaacaattaaacactgaagcacttgcaaaaatacaca

SEQ ID NO: 253451 - DNA, 5393 bp, Homo sapiens
  misc_feature (222)..(222): n is a, c, g, or t
  misc_feature (1785)..(1785): n is a, c, g, or t
  misc_feature (2174)..(2174): n is a, c, g, or t
  misc_feature (2196)..(2196): n is a, c, g, or t
  misc_feature (2934)..(2934): n is a, c, g, or t
  misc_feature (3251)..(3251): n is a, c, g, or t
  misc_feature (3495)..(3495): n is a, c, g, or t
  misc_feature (3525)..(3525): n is a, c, g, or t
  misc_feature (4082)..(4082): n is a, c, g, or t
  misc_feature (4154)..(4154): n is a, c, g, or t
  misc_feature (5344)..(5344): n is a, c, g, or t
  misc_feature (5352)..(5352): n is a, c, g, or t
tgtttttctcacaatttcatggattatgggtttgggacaggaagaccacaaagataaagggccattttcattatatcatattaaaggtacatgtgatcaacatgacatcactgtttatgttaaccttgatgatgaccttgttttcatctggtttctccactataagttactcctctcctcacttcccatttccagactctgctctctggaaggaagtcactntgtgtagcccatatttaagtgatagaaagtaatgttctacctccttgaaccaggggtattatccacataaattatttggaattcttctgcacaaaaaacttacctcttctcctctacatattaatttattcaatcacttacatatatcagtgtagactcatagatacttattttgtactttagcttataatttggcttttctttctttctttttttttttttttttgctctatttgttacaactttagctgtgggagctctttcaggtggctcttgtgtcccttttactccctcagtgtgtgtgtgtctgtgtgtgtgtgtgtgttgagcattttcttactttctggcactgaaagatatatctggtataaaagacaaacgatacacctatctacatggggcacttactgtgaatagaacttgcaggactggaagttgctttcggtgagtcattgagtgagtggtgggtgaatgtgaaggctcagttcattactgtacactactgtagactttataaatactaaggatacacacgaaatttattttaaaaaactatcttcaataattaaccttggcttattgtaacttttcattttataaactttttaattttttgaaactttttactcttttgtaatcacacttagcttaatcacaaacatgtatagctgtacaaatttttttctttttttctttttttttttttttgagacagggtcttgctctgtcatccaggctggagtacagtgacgcgatcatgggtcactgcagccttgacctctctagctccagtgatcctcccacctcagcctcttgagtagctgggaccacaggtgcacgccaccacacccagctaatttttgtattttttgtagagacaagttcttcctgcgctggccaggccagtttcacacgcctgggctcaaacagtcctcctgcctcaatctccccaagtgctaggattgcaggtgtgagctgccacatctggctttttactttgtatccttattctataagctcttttcttttcttttttcttttttttttttgagacggagtctcgctctgttgcccaggctggagtgcagtggcgcgatctcggctcactgcaagctccgccttccgggttcacgccgttctcctgcctcagcatcccgagtagctgggactacaggtgcccgtcaccgaattttttttgtatttttagtagagatggggtttcaccgtgatctcgatttcccgacttcatgatctgcccgagggattacaggcgtgagccactgcacccggcccttttctttttttttttttttttttttttgagacggagtctcactctattgcccaggctggagtgcaatggcgctatcttggctcgctgcaacctctacctcctgggttcaagcaattcgcctgcctcagcctctcgagtagctgggattgcaggcatgcaccaccacgcccggctaattttttgtattttagtggagatggggtttcaccatctctaacttgaactcctgatctcaagtgatccacccgcctcggccttcaaaagtgctnggattacaggtgtgagccaccgcgcctggcctatacgcttttttctgttaaaaaatatttttaagtttttaaacttttgttaaaaattgagacagaagcaaacacattacttactaggcctacacagagccaggattatcagtatcaatcccttccgcctccacatcatgtcccactggaaggtcttcggggcagtaacggacatggagctgttatctcctaacatgccttcttctggaatacctcctgaaagacctgcctgaggctatttaacagttaactttttttttatatgtaagtaggagtactctaaaataacaatataaaatgtagtacaataaaataataagccagtaacgtagttgtttattatcaagtatgtactgtanataattgtatatgctagacttntatacagctggcagcacagtaggtttatttataccagcacctccacaaacatgtgagtaatgctttgcacttgaccttctgtcagctatgacatccctaggttgcaggatttttcagcttcattataatcttatgggaccatcttcatatgtgagtggtctcttgacccaaacattgttatgtagcacatgactgtaaattttggaatcaccttgtcagtatttacaaaatagctttctgagatttagtggcaggatctcagctcactcctacctgcacctcccaggttcaagcgattcttatgcctcagcctcccaagtaactgggattatagacgtgcaccaccaagcatggctaatttttgtatttttagtagagacagggttttgccacattggccaggctggtctcaaactcctggcctcatgtgatctgcccgcctcagcctcccccagagtgctgggattacaggtatgagccactgcgcctggccaaaattgcctaaatttttaaaatcctaaattggtgttgaattttgtcaaatgctttcctgcattgattttgatgatcacttgatttttctccattcttttgttaatgtgctaaattatgttgcttaatttttgaatgaaaaaataatcttacattcctgaaataatttcggtttggttgtgatgttttattcattctatttcgtgctgaattcagtttgctaatattttgtttaggaattttgcntctatgttcatgagacagatcggcctgtaattttacttttttgtaatgtccttgtcaggtttaggcctcaaagttatgttgactttataaaatgaactgtgaagtatttcctcttttttatgctttagtttgagtaagattgattttttttaaaacttatgtcgtccttaaatatttattagaattcactagggaagttatcttggcctgttactttctttcttgagtaaattttgttttcattctttttttatagttaagtatattgagttagaatgcatacacaaacaaatgcacacaacttaaagtccagttcnatgaattttgactaatgtataaacctgtttaacttccactgtaagcaaaatatagtgaattttcgtcaactaaaaagtccccttgtacccatttaccttcagtacctatccctaccccagccacaggcaacaaatgattttcatgtgcttatttgccatctgtatacctctttggttagttttctgtttatatcttttgcccatttatttttttttttttttgagacagagtcttgctatgttncccaggcaggtcttgagctcctgggcttangggatcctcccgcctcagcctcccaagtagttgggactacaggcacacactactactcttggtttgcctatttttaaatcaggttgtttgttttcttattattgtgttctctacactgtaggatattctacctttcctagaatttcatgtaaatggactcagacatactgttgtgtctggcctcttttgttcagtgtaatgtttttgagcttcatccttgcatgttatgtgtatcagtgattgattcaatttttattgctgcatagtattggattgtatagctataccacaatttgtttattcattctcctgttgatggaatattggttgtttccagtatttagctattattattattatttttttttttgagacggagtcttgctctgtcaccaggctggagtgcagtggtgcaatctcggctcactgcaacctccgcttcccaggttcaaacgattctcctgcctcagcctcctgagtagctgggactacaggtttgtgccaccacgcccagctaatttttatatttttagtagagacgggatttcaccatgttngccaggatggtcttgatctcttgacctcgtgatctgcccaccttggcctcccaaagtgctgggattacaggngtgagccaccgcgcctggtcttttttgtttgttttgttctttttttagacagagtctcactctgtagcccaggctggagtgcagtggcatgatctcggctcactacaagcctgcgcccctcaggttcaagagattcttgtgccccagcctcctgagtagctggggttacaggcgtgtgccaccatgcctggctaatttttgtacttgtagtagagactgggttttgccatgttggccaggctggtcttgaactcttgacctcaagtgatcttcctgccttggcctcccaaagtgttgggattacaagcgtgagccaccacacccggccagggatgtcattttttataactagccataaactttagctttgaagtaaaactatttctagcaagtgattcttacctgatattttttgttgttcttgcccatattttaattgggttgtgttattatggttctctatgtattctagatttaagtttttgtatatggtgtgaggcaagtgtcaagtttaattttttttctacaaacatcctgttgttccagtaccttttgatgataagactgtcttttcccccattgaattatcttaacgccctcatgaaaagcaattggccatatgtatgtggatctacttttggactctcaattctgttccagtgatttatatgtccacccttatgtcaataccacattattttgattattgctgctttatagtaagtgacatcatgttgcctgaaatcacgttttccacctttattcttctgttgatggttgctttggcaattaggggtcctttgcattttcgtagacattttagaatcaacttatctattgctactaaaaatgcttgattgggattgtggtaaatctagaaactaatttaggaagaatggtcatattaacagtttcaagtttcagatccatgagcatattttcactctccattaggtcttttaaaatttatcctagcagtgttttatggtttttactgtagaggtcttacacattttgttacatttgttgctatgtgtttgaccttttttgatactagtgtaaatggaaattttttcttttatgttctagttgttcattattacactaaatcatctttgggtgactactaaacattctattgaaaatttgtgaatggcgtgaacccgggaggtggagcttgcagtgagccnagatcgcnccactgcactccagcctgggcgacagagcaagctccgtctc

SEQ ID NO: 253452 - DNA, 380 bp, Homo sapiens
agtgagcagagagggtattctttggacatagggaccttttaagtagccttaaaactatagtaatcagggtgatgcatttcctcaaaggcttgcccagtttatgtcatccaagcatgccactctctacacagcacacttaaaactttttagaacagaaattgccgatgtgttttagctcacttgccagtgcttgttgattgtcagtaattacatgaatctctcttgaaaacagttctgggagcggggagggatagcatttggagatatacctaatgttaaatgacgagttactgggtgcagcacaccaacatggcacatgtatacatatgtaactaacctgcacgttgtgcacgtgtaccctaaaacttaaagtataattt

SEQ ID NO: 253453 - DNA, 497 bp, Homo sapiens
gagggacgtcttttttgcgttctgcatccgtctgtcgtccgtcggtcttacggtggccgggcgtggggctactcgagcagcctggccgtggccaccggcggctctgggtgcttgaggcttgcgggtagcgccggcccccacgccggccggagcatgcgactaaccggcctcatccgcatgcgtcttgtcctggctgccttctggccctgacggccggagtgtcggatcctagatggggaccctaggtgggagccgcggggtcacatcggggtcaccccgggctgagctcgtctgaccggctcccgcgcccctcctcccccggccaccgctgccgggctcacctcgctcccattggttccggccaggctgttactgaggcggagacacgggtgatgattggctttctggggagagaggaagtcctgtgattggccagatctctggagcttgccgacgcggtgtgaggacgctcccacggaggccgggtaagcggccgc

SEQ ID NO: 253454 - DNA, 412 bp, Homo sapiens
ggagggaggtgcatcaccggggccttgtgctgttagctttcagagacagcctatggtaatgacaagcaggcagcccaggcgcagtggctcacacctgtaatccagcactctgggaggctgaggcgggaggaggggtctcactatgttgcccaggttggttcgagaccagcctgtgagacctccttctccacaaaaaattcagaactagccgtgcatagtgggcacagctgtagtcccagttactgggcaggctgagaatggaggatcacctgagcccagaattcaaggctgtcatgagccatggtcacgtcactgcacaccagtgtgcaatcttttaagatcctgtctcttaaaagaaaaaaaaagcaagtaataaagatcgggcaaaacaaagcgagtcgactgcctacca

SEQ ID NO: 253455 - DNA, 494 bp, Homo sapiens
gaggtttagtaacacaccaggttgcacccctcacaaaggagggcagatgcccacctctcatcacaggcccatgctggggccatgcacacagattacctggaatgactggcccacagaacccatcattggatcacaggcccatgctggggccatgcgcacagattacctggaatgactggcccacagactccatcacttgggggtgtttgatgagagagacaaagtgagaaggcgagttaaatacgttttgatgaagatagacagagcttcactcttgttgcccaggctgcagtacaatggtgcgatctcagttcaccacaacctccgcctcccgggttcaagtgattctcctgcttcagcctcctgagtagctgggattacagagcctgactttctcatcgaaaccatggctgcttggacccaggctctccccatgaggtaataaatgtgcaagcactttgcagggaaaataagtgcctgacacctgacataaa

SEQ ID NO: 253456 - DNA, 1005 bp, Homo sapiens
  misc_feature (898)..(898): n is a, c, g, or t
tcttttaaacaaccatatctcaggtgaactaactgagtgagaactcacttatcatcaagaggatgatgccaaatcattcatgagggattcatctccacgatccagtcacctcccaccagacctcacctctaacattggaaatcacatttcagcgtgagatttggagggaacaaacatccaagccatatcaggtattgttgagttaagggttttggttttttggtgtatcttattccttcaaagcaggaatgtgtcattatccagaataaccataacttgttttttaaaagtgttctctgcagagaatacctattgagtgtcttcatgtttgttagctgaggttttggtgaaaaggaaggaaaggatttatgttcttatgaactaagctctccagtggtcatggtgttcttattgttttatgcattgtaattgtttttaatagtcttttatttgaggcacctgggttcttcagttccccagaggagagataaatcattctttaattatgaaactatctgaggcatacttgttgcatcacttaaaggcaggtttttttgtttttgtttttgttttttttttaagtttaaaggaaaataaaactctattgtgatcctgaagtcagcagtagaacttagtttggtgtgtatgtcccccagagctatcaatacatttagatgttgaggatggaaacaggtcaggtaaacttgttcatggttctaaggtagaagttagaatattacaataagtctttttgcagtgatgaaaatatttcatatctgtcccagctactcaggaggctgaggcaggagaatcacttgaacccaggaggcagaggttgcagtgagccgagattgcaccactgcactccagcctgggcgacagagggagacgctgtctncttaaattaaaagcttgaacggagaccaacgtctatgtgtctgtatatatatatatatatataatatctgtggctatttcaatgtgcatgaattaaaattcaaaatt

SEQ ID NO: 253457 - DNA, 545 bp, Homo sapiens
cggcgaatctgctgctaccaatgtaaaggtcaggccgaggccggcgcggagaatctgctgtcgcctgcagctgctcgcctgtctccgtcggaagggagcccaagctttgcagagatgaagtcttgctctgtcgcccgggctggagtgcagtggtgcgatctcggttcactgcaacctccgcctcctgggttcaagcgattccactgcctcagcttcccgagcagctgggattataggcatgcaccacctcgcctggctaatttttttgtatttttgtagagatggggtttcaccgtgttggccaagctggtctcgaactccggacctcaagtgacccacctgcctcggcctcccaaagtgctgggatagcaggcgtgagccactgtgcccagcctcacctaatggtttcttagcaaacttcagtagaatgtttagaacgcggccctgataaacttgagtgctggtaggaggtgctacctcgctcaatctgtgagcaaccagccctgtgccctggatgcttggccgggtggagagaaagacagtgt

SEQ ID NO: 253458 - DNA, 441 bp, Homo sapiens
cggcgaatctgctgctaccaatgtaaaggtcaggccgaggccggcgcggagaatctgctgtcgcctgcagctgctcgcctgtctccgtcggaagggagcccaagctttgcagagatgatgaacgattggatgcccatcgccaaggagtatgatccactcaaagcgggcagcattgatggcactgatgaagacccacacgaccgcgcggtctggagggcaatgctggcacgatatgttcccaacaaaggtgtcataggagatcccctcctcaccctgtttgtggccagactaaacttgcagaccaaggaggacaaattaaaggaagtcttttcccgctatggtgacatccggcggcttcggctggtcagggacttggtcacaggtttttcaaagggctacgccttcatcgaatacaaagaggagcgtgccgtgatcaaagct

SEQ ID NO: 253459 - DNA, 370 bp, Homo sapiens
ttgtcgctgattcagcatatacacatcctccagtgtgacaggattgtgtatggaaacaggtaagactggtgaatactaggctgtgttcaagtgtagagtctcatgattatcaccaatactgtgggctctccctcttttagatgagtttttctaccatatctttggctttacaaaatatattaacacagtttcataatagatctcttggaatatggtcgtttggtgttaagcattctatctggcaaaatgaaaaataagatggtaagagttatcctacaaaaatcctaatgttctcaagctactgctgaaattctttttctagtaatttacaaaaaagtccccattttcttgtagaaataagccaattaaa

SEQ ID NO: 253460 - DNA, 488 bp, Homo sapiens
aaacagataaacatcaagttgaaacaagaccccactgacacatgggacaaatgtgtcggagctggccactctctgcagggagaaacgcagctcggtttctccccagcttccagaacacccggcagcgcctgctctgccatcttcattacctcaacctccagaaactggggtgcccagggcccaaacccaacgtgtctttcctctcattgatcgcattcagtctcatggctttaaacacaatatcacaccaaatttacctcccgcctgggcctctgccctgtccttgggcctcctgcattttactgcccacctgcacctatgtttggacataaaagaaactcccagcgccacctgtaatgcggcactccgtagatcctccaagtcggctctgtctactgcaactctgcccatctcagctgagggcagtgccactgtccagtggtcaaaagccctggagtgcccctgactcctgtctttctctcacaccc

SEQ ID NO: 253461 - DNA, 340 bp, Homo sapiens
gctggaggtcattatcccaagtgaattattgcaggaacagaaagccaaataccgcgtgttcttacttataagtgggagctaaacactgggtgcacatggacataaagatggcaacaatagacactggggactcctagagggaagagagacagagggattcaaggactgaaaacaacctgtttgctactatgctcgctacctgagtggtggggtcagttgtaccccaaacgtcagtgtcatgcagtatgcccatataacaaaccccttaatctaaaacattgagattattaaaaataagagattaaagatatttttaaaataaaaaaaggtatatgccaaa

SEQ ID NO: 253462 - DNA, 1024 bp, Homo sapiens
tcgatctaaggatccccgggtttatcgatgccacccttccattttgggaagggtgacattgatttcgtttagctgcttaagatatgtacttgctgttgtcttgtgagacatgacatctgaagctgaagaggagtccctctcattgttgtcattgtcccaccgggactgaaagtctcccagttgaggcagcattttagctttgatgtctacagggcaatcatggatcaggaaatttctgcaaattagacttggaaaacaaggtcttgatccttcttgtctttggacgaagactaatcatcacttttgactgaaggtgtagtgctggagactatgttggaggcagcacctgatgcactatccatattcttccccttgatcttgtcttaaagttttccaaatggattccgaggcttgtctttgatgaaaaggtcaaacatactggcagtcatgttgtttctcataagctggatgtcaacctcaatttctcctctttatccttctctcctggtttggatttcaaggtataccaccgcatcttcctgctcccctagtctgggtgcaggtcctgcaggtacacctcggcgaagcccaagtacagtagcagcagcacctcaaaggtggcctcctcctctgacactgaggtggcatacttctccttacccacctgaatcaccgagtacatgttgcttgtaccgtcaggctcttggttcttggcccctggccctatgcctgcaacactgtcacctgcacgtggattgggaaccacatagcccccggacctgctaaggccattaaggacaggatggtgatgcctcggctgactgacgtgagaagattgtcatgacccatggcctctactgctgtcctaccaacagaaacttcataatgttgtgcaggcgttaccactacctagttccagaacattgccatcacccccaaaataaatcttgcattcattaagcagtcacccctattttcccccatccctgtcaaccactgatttatgttctgtctctatggattc

SEQ ID NO: 253463 - DNA, 1354 bp, Homo sapiens
tcgatctaaggatccccgggtttatcgatgccacccttccattttgggaagggtgacattgatttcgtttagctgcttaagatatgtacttgctgttgtcttgtgagacatgacatctgaagctgaagaggagtccctctcattgttgtcattgtcccaccgggactgaaagtctcccagttgaggcagcattttagctttgatgtctacagggcaatcatggatcaggaaatttctgcaaattagacttggaaaacaaggtcttgatccttcttgtctttggacgaagactaatcatcacttttgactgaaggtgtagtgctggagactatgttggaggcagcacctgatgcactatccatattcttccccttgatcttgtcttaaagttttccaaatggattccgaggcttgtctttgatgaaaaggtcaaacatactggcagtcatgttgtttctcataagctggatgtcaacctcaatttctcctctttatccttctctcctggtttggatttcaaggtataccaccgcatcttcctgctcccctagtctgggtgcaggtcctgcaggtacacctcggcgaagcccaagtacagtagcagcagcacctcaaaggtggcctcctcctctgacactgaggtggcatacttctccttacccacctgaatcaccgagtacatgttgcttgtaccgtcaggctcttggttcttggcccctggccctatgcctgcaacactgtcacctgcacgtggattgggaaccacatagcccccggacctgctaaggccattaaggacaggatggtgatgcctcggctgactgacgtgagaagattgtcatgacccatggcctctactgctgtcctaccaacagaaacttcataatgttgtgcaggcgttaccactacctagttccagacacagggccctcagtgaggaacacatccagcctatactggcttatcctcatcccttaaccctatagcaactaaggggattccttggcgtaatagctttctgccgaaaatggactcccaggtatggcgaaataaccaggtcattaaatacactaattaaggaaactcagaaagccaatacccatttagtaagatggacaactgaagtagaagtggctttccaggccctaacccaagccccagtgttaagtttggcaacagggcaagacttttcttcatatgtcacagaaaaaacaggaatagctctaggagtccttacacagatccgagggatgagcttgcaacctgtggcatacactgactaaggaaattgatgtagtggcaaagggttgacctcatgtttacgggtagtggtggcatcgataacaccggtaac

SEQ ID NO: 253464 - DNA, 232 bp, Homo sapiens
actagactctgagctcatctgaagacagactatccccaagttcttacacaaattctgccacagagtagacacttgacaaatgtttgctgaatgagaaagcatagagagagggtgaggacgctaaagaccacagagatcttccagttgttgaacttccacttactatgtaagaaattagaggtacagaagatttaaatactaaagccatggttagaaaacccatttccactac

SEQ ID NO: 253465 - DNA, 383 bp, Homo sapiens
agacacataaaccagtggaacagaacagagaactcggaaataagaccatacatctacaaacgtctgatctttgacaaaccagacaaaatcaagcaatggggaaaggactccctattaagtaattgatgctgggataagaggctagccatatagaaaattgaaactgaccccttctttacatcatatacaaaaaaaagactcaggatgaattaaagacttgaatgtaaatttaactcattttgatactgtttcttgtgcataaaaaatttaatacctctttaatgtgctatatccatttgcttgtatttgcgattatacttctattgatccaatctcagaaaaattattctgtgttcaataaaggcaataagatggatggatga

SEQ ID NO: 253466 - DNA, 430 bp, Homo sapiens
atgtttttgtatatgcatactttgtagaagggctaaatcaagctatttaacatatgcattacctcatatatttatcatttttggaggtgagaacacaaaaatctactcttactctcagaaatttttacatatagaatatattgttattaactgtagtcactactgtgatgaacaacagatctctggaaattattctttctgtctcattgacattttgtgtcctttgactaacatctccacaatgtgctcaactcccagcctgtggtaattaccattttactttctgttctatgagtttgaatatttttacactccaaatataaatgatatcatgcagtatttatttgtttctgtgcctggcttgtttccctcaacataatgttctccagattcatccacagtgctgcaaatcacaggatttctttctttt

SEQ ID NO: 253467 - DNA, 369 bp, Homo sapiens
tttgtatttttaatagagacgaggtttcaccatgttggccagcctggtcacaaacacctgacctcaggtgacctcccacctcggcctcccaaagtgctggaattatagacgtgagccaccgcgtccagactacctgttttttaactttataccaaagataagacatcgttgaaaggcaaattataagctgtgaatatatgtaacaaaaatgatagaagaaacattaatgtttgtaacatctaaagaacacacatgaggacacactagaggccaggagtttgaggctgcagtgagctgtgattgcaccactacactccgctccagcctgggagacagagcaagactttctctctaaaaagtagaaaacat

SEQ ID NO: 253468 - DNA, 464 bp, Homo sapiens
caagccatcttcctctcatagcttcattttcttggtaagataaaacaattatactagccccctgaggactatgttcgagtgagttctagtatgacttcataaacttgaaaggactacacaaatgagatgttgcaagcccgtttctcttcctggctctgtgcttcctgaaccctatggctagaggggagcatggatccccttcttgacttgctctgtcataaacatgatcttaaacgtgaacatgctcactattctaccttcaaggaaaggtcagcctaatgtagggaacaagcacttctgatcctttctcacctgactgtgctgatacacaagctctttggctagtgacagtcacctggccagccttggaggatgttactgggactgctgtctcttgactttgatgaggaaaacagttctgtgctcaaaaaaggaagagtgggggtccaggcatggtgactcat

SEQ ID NO: 253469 - DNA, 166 bp, Homo sapiens
gggagaggtgaaatgggagctctttttctttctgtgtttgactctgcattccccgtcctccccatataatcagtgaatttccactttcgaagcctcaatggatgggctgaattctccataaactggcattcttctttttaggaatccctccattatgaactacact

SEQ ID NO: 253470 - DNA, 275 bp, Homo sapiens
tgcctcagcctcccaagtagctgggattataggcatgcgccaccacaaccagctgatttttgtatttttagtagaaacggggtttctgcatgttgatcagactggtctcaaaatcccaacctcaggtgatccacctacctcagcctcccaaagtgctgggattacaggcgtgagccatcatgcccggccaacttttttattattcactaattagaagtagactttctacttctaattggagaaacaggattgctgcttctcaaaaaaaaaaaaaa

SEQ ID NO: 253471 - DNA, 483 bp, Homo sapiens
taggtgtgggaggtttcatagaataagcaaaatctggggttgtgttggtaatgtacaagagttaataaagaaaaaaaatgaccagagaaaatgggatatgttatactgggaataacaagtatctttgaatgctcatggactaatctgccatcttttcagatcctggggtctctatacatacttcagttatttgtttctgaaggttttgcagcaacaaaaatttttaacacatttgtcagatttgagttgtagaggcctctattatcctgttttagaaagaataaagaaaattttaacttctagaagctttatgtataacttgaaaatctcaaatgttccacaacttgtctttgggcaactacaggtaacaggattgataggagaagagtctggtgaaactaaagttttcatttagagagcccatgaggtagtttaaaaacagcaacaaaaaagccacaacaatttttttttggtcaggccata

SEQ ID NO: 253472 - DNA, 376 bp, Homo sapiens
gctgtccttggtgctccttggcttgtagctgcatcactccaattgctgcctcactccaattgctgcctctgtcttcacattgaccaccttccccttgggtctctgtgtgttcacacaacctcctaataaggactgcagtctttggatttagactccactctaatctagaatgacttcatcacaaccaattacatctgcaaagactctatttccaaataagctcacattttgaggtttggagaggacatgaattttggagagatactattcaactcaatagaggaatcttttttaaaaaaaatcaaaatcaatgcaaaaaatccataaggaacaaaatttcaaaattctaaataaagacagaatccacccctgcaga

SEQ ID NO: 253473 - DNA, 782 bp, Homo sapiens
gtctcttttgctggcttgtccaactctaatatattcttcctttttctttattagtctacccattctccttgagtaatacaatgaatgcctcaggtttccaccaaaatccatgtttataactgctttagaatgcttcattcaaatgcttccatcttggatgattccaactatccacttttccatgtctagagccaggtggccaagagcttcaagagacaaagcacaacaggcagattgacattgctataaattaatgcttgccaatctcatttgaacctcatcttatctacaaatcctatagatattttgtctattctgatcatgttgactccttgcaattacaatttcaaaccttctccacagtcttcaaacttcctgttcgtgcgttcccctttcatgtttgacagatggccttgtctcttaatttacagattaaaaacaacagcaaacagcaatattctcaataaaatctagcacttataatatattctgcattcttccagttccaatagaggaattgttgttcctcctatccaaagcccatgtttccagcttactctggtcctgatttttggtctcaaaaatcttactttattcattatatttttatatgtcatgtgtgttttactacttaaagtggatccttctcaaaatattttaaacatgcacaagtctccctcacttaaacaaaatttcctttagatgtaagctatctcattgtctttctccttttattttatagtcaaacttcatagaagaaaagatactaccctcatttcctc

SEQ ID NO: 253474 - DNA, 463 bp, Homo sapiens
ttggggggtgatggacaagtttattatcttgattatgctgatggtttcacagatgtaaaactatgtcaacatttaccaaagtccacattttaaatatgtgcaaaatttaacaaactgtacacttaaatatatcaattatatctcagtaaagccgttttcagaagtttgtaagtgaagcataaccccaatagatatttagttatgatgaattactttcaaattattagagatattgaaagagagagagacagaaagagagagaaaattgacaaatctagcaaagcaaaggaaaagatacaaaatgggatggggagaaagcacagtaaatgagacatataaaatgttatttgtaaaatgtaatcgactatgtaagtaatcacacctaactccgtctcagcctctgcttcctggatgaccttgctgacacgccaggtctaatctctagattctctaatttgacagg

SEQ ID NO: 253475 - DNA, 385 bp, Homo sapiens
cttgttaattttatattctttactatactttgagcatcctgttttttccattaactgccagatagtatatgccttagactttgcaggccatgtaaggtctctgtctcatagtcttcccattgttacaactctttaaaaatgtaaaaaccattcttagcctgggggccttaagaaaacatgctcctggctggatgtggtccttgggccatagttttggtgacctgctttagaaactataacgtgcatcctgctaaaaactaatctaagcctggcacagtggctcatgcctgtaatcttaatgctttggaaagctgaggcaggaggatcacttgaggccaggagttcaagaccagcctgggcaacatgataagaccctatctctacc

SEQ ID NO: 253476 - DNA, 685 bp, Homo sapiens
gttggtttggttcatggtctcaataatcttgtcctttacctcagccatttacttccataccctagaacttgtttttaaaaattgataacccttccataatctcttaattccatgtgttatactttaaatatggtacaaggccaccataactagacttaggtcaacatggtgacccccaaacctttgtgaattctacatctcatttgatggaaactgcaatttctaaggcaaaatttaacattcatccttgatcaaatgcgtcaggaaaacgtactaagtaccttcattgtaaggtatggtcaggtactttatcagaaaaagtaaatataaggacagaggtcacgatcagttggcatatatgttatcttggatcttacaatgtcttactcagttgcccaggctggaatacagtgccatagtcatagctctgtaacttcaacctactggactcaagcaataatcctacctgcttcagcctccttagtagcaaggactacaggcaggcaccgtcacatctttttttttttttttttaaagtatggatggggtctcatgtttcccaggctggtcttgaactcctggccttaagtgttcctctttggcctcccagaggctggaactacaggcatgggtcaccatatcctatacgtcttagatctggattcaagtacactaattgaacata

SEQ ID NO: 253477 - DNA, 416 bp, Homo sapiens
ctaggaagcaaaatagttgctagcaccaaaactgctcatcttggactttaagcttggaggaacctgtagggctgtagcgaaaactatggtgacaatagaggctttatttggagttccagagctgcctctgagttaatgtgcaactgacctttggcaagtctgttggatcttcagttttctcctctgtaaaatggagataaatagagtttcttgcctgtcctgcagggctgtgatgagagagtgtattgcagtgagtaaagtgctatatggtgcagaggatgataaattatccaggtttgtctgaccagtccttttaactagggagatggcatcaagctagtcccaacccacaagtatcctcactagcagcagctgcagtgctcagtctagttccataggagaatcctttagagatg

SEQ ID NO: 253478 - DNA, 676 bp, Homo sapiens
tctgttttccacataggtaaattatggcagagatgatattaatgaagagaggaactctattaattacctatttctatgtcaaagccagccccaaacttactggcttaaaaaagacaaaacaaccaaatttatttttttcttatagctctgtgggttggctgggcagtttgataggtctctctgggactcaggcttactaatgcgttgaattcagatgacggctggatgtccggaatggcccagctcacatatcagactgcttatgctggctgttggctgcaattccttggttcttttccatgtgggctttcatcctctatgaggctagagttatggcatggcaatctcagggcaggactctgggataaccaagtctgctgcaaaggcactcgttaaacctctgcttgcttcacttttgtcaatgtgatgttggcccaaaacaagtcatatggccaagctgagagtcagtacgagagtgagtttaggtgccttctcttgatgggaaaaatggcaaggggtttgtggctgatttggctgtttttaatctagagtgaaagttttcccactcttctaaaaacctattctttttcttttgtaaatgaattataatcccaaattggaaaattattgcctggcccccttactctggcgtggttgacatggaagtattatatag

SEQ ID NO: 253479 - DNA, 544 bp, Homo sapiens
gattatgtatatttgaaggcttatgaaaaattgtactctaaaaatatacgtttacatcttcacttggcacagtaggcattattttcttctgtaattttgccaacttagcagtccaagaaatgatactgccatttcttttttatcatttgaacttaaactttttaaatataaatttctagttcacaatattttgcccatttttctattgtctttaccttattaaattgataagaaccttaaaaattaagattataagtaacctggccaggcacgatggctcatgcctgtaatcccagcactttgggagtctgaggcaggcggattacttgagatcaggagttcaaggccagcctggctaacacggtgaatccctgtttctactaaaaatataaaaattagccaggcatggtggtgggcgcctgtgtctcagctactccggaggctgaggcgggagaatcacttgggcccaggaggcagaggtggcagtgagctgagatcacgccactgcactccagcctaggcaacagagtgaaactctgtctca

SEQ ID NO: 253480 - DNA, 278 bp, Homo sapiens
gtgaaactctgtccccctcaaaaaaaaaaaacagtggcggcgggagcccccggttcctcaccgtcttgtcccgtacgtagcagcatgccatcctgactgcggagagtgcagacagcagcagccctgccacctaggagcttgcagtctgaggcggaggtggggagtgggcccctgcagactcctcatatggttaggaagcctgtcctctggaccagacacagtcctaggtgctgaggacgcagcagtgggcagcagagaagcaaagccctgtctggctg

SEQ ID NO: 253481 - DNA, 611 bp, Homo sapiens
aagcagttattacagactcatcatgaatagacattacctattgtcattcgttgaataaactacgacttagcagttcagagcttacataagaaaagcagaatgtgggccaggcatggtggcatgcgcctgtaatcccggctacttgggaggctgaggcaggagaatcacttgatcctgggaggcagaggttgcagtgagcggagattgcgccattgcattccagcctggcaacagagcgagactccgcctcaaaaaaaaaatctgtatatcaaagagtttgtgttatgcttattccttgacaccaataaaatgaagatctaaagtaaaatgtgcattgttttgtatcttttattgagtgtctgtgatataagaatccctgggagtacagcagtctataaaataagctaagttatatatgtattgtattgggatcatgtgaagaattttgtatatgtatagggatgatgttagccagctatagtaggcaaagtaatttggataaacattagctgggttgagagaaatgttaagtaatggacttagggtgcattttaaaatccctgaaacataatgcctgagatctgaaagacagctaagggtctgaaaatcac

SEQ ID NO: 253482 - DNA, 394 bp, Homo sapiens
tctaattgttctatgattcatgacctgtgttccaacacctagaaacccatcaggatacaaatatatcacttaaaataagacacatagggatggttagtttttctgtctcattctatattgttctgagaaattacagatattttcttctaagaaaggcatgatcaactattcaagttttgctgaatctaaggtaatgtcagaatactcttaaacaccttacggcctcagatcccagtagtttagaattctagggatgatgtaaatttataatcactgtgaaaatgttatcctatcaaaactctgtagaaacatctatgcttttgcaataacagcgtaaaagacctcttctgatgagagagacagagagagagagagagagggagagagaaagaaa

SEQ ID NO: 253483 - DNA, 394 bp, Homo sapiens
cagatgcaaagaggcaagtaaaggaaagaagttggttaaaaaataaaataaagtagagaatagtggagaagagaaactaaagtggatgaaagacaaaaatatgaaaattgcaaggatcagaaatcctttcagtagctatgtgaccaccagaaagtcaaagtcctgacttgctcctcctcctgacaaaggtggctctgaatgaagggcaacctctccatgccggcaaatccgctcaatgttcatgcattcgatgaagtatgccacacaagatagtaatcagaggaaactcccaaaaatcaaaataaaaagaattaaaacagtgaagaaagaattatggataataataaaaaagaaattagatgataatggggaaacatataacagtctcacaatg

SEQ ID NO: 253484 - DNA, 232 bp, Homo sapiens
agtagagaaggggtttcaccgtgttagccaggatggtctcaatctcctgacctcgtgatccgtccgccttggcctcccaaagtgctgggattacaggtgtgagccaccgtgcctggcctctttctctctttctttctttttctctttctttctttctttcttccttccttccttctttcccttccttccttcctctctctctttcttccctttcttcccttccttctctttc

SEQ ID NO: 253485 - DNA, 355 bp, Homo sapiens
atgagtcagccaggtggtgtgcgcccagagtctcagctacttaggaggccgaggtaggaggactgcttgagcctcagagatcaaggcagcagtgagccgtaatcgcgccacagcactccagcctgggcaacagagcgagacccagtcctaaaaaaacagaaaaaaaaacagacttttgtcaactgggttctactgtgtgatccttcatgccctcaactaaaagctaagttcctaaagggatcatgtttaaatgtctgagtcctccacgggatagagtacagttctatatacatagtgtgctccaaaaatgtttagtgcttgactgattcaagagttttttcacactaagaaacag

SEQ ID NO: 253486 - DNA, 301 bp, Homo sapiens
aagcataaaatccttgaaccatagacccaagagaagacaaaataaaatgttttgatggccataaagctgcatgagaagaggattgtgatgaaaaaacaaatgtgacagctctgtgtagaggaggcttatgctgaggaggactgtttctgaatgttgggttacatgacttggaatattgatgtttctgcctcttattttgcattccttattaattcagagcatgttaatgcacttgtactccttacatttatacagacaaaaaagaggaaaaaacaaaataaaccatatgttaaaaagtata

SEQ ID NO: 253487 - DNA, 472 bp, Homo sapiens
ctcccaatgccaaattccaactttagtctgaagaccagttaggaattgaaatctttcatttctttgactcacagaccaatccagatgctgagactctgttactagattatgtagggtgtaattatgtcttttttttttttttaagaaatctcctggggattcctgtaacccaagtgagttctgcaacttggagtaaaatgttacttctttatttttattttcccctaactgaaagttgatgtttccttccaatttgaatgcaagtaaccaacccacaccaatattagaagtatttatgactttgtcagcagtagtaattataagaatttttatattgtattgcagttgttggagagatctccaaatatttaaactcatcattattttgaaatgaagatggttattagacccaccactacatttcaaaattttagtgtattaataaagaagcacatatattgctgtttacaaa

SEQ ID NO: 253488 - DNA, 451 bp, Homo sapiens
caatacttaagaagaaacagaaaacatgagtggtgctataacaccaaaaaagattgaattagtcattttaaaacttcccacaaaaaaaaaaaaacaaaaacataaaaacttcctaagctcagatggcttcactgacaaattctaccaaacacttaaagaagaattatcacaaattcttcacaaacgttttcaaaaaatgaaagaaaacacttcccaactcattctataaggtattacccgcattactataatgccaaaaccaaagatgtcacaagaagagaaaattataaatcggtatctcttatgaatatggatgcaaaaatttcccacaaaataccagcatgccaaatccagcaatatataaaaaggattacacaccatgacaaattgggatttagcccaagaatacaaggttggtttatcatttgaaaatcaattaataaactttatt

SEQ ID NO: 253489 - DNA, 419 bp, Homo sapiens
tgtctgtgctatcctgggatggaagaggcagggcaacatgaaaggatcacagtggtgatttgtccaaggcctaaaacaatcctctgttggaattgtcacagcccatctcttattccttagaaagcagaaaacaaaatgtggcttttatgtgtctggagacattaaattttggttcttgggttgaatctcacatgacagaaatcactaggacaacactggcaaccactcctaggagaaatgtttgttcttctttcaatataaggcaatgaatttgatatctgttgttaaagtaaataattgcattacgggggacataacttcctttgtttttctttaaataatggctgaacttattatctaagatgtttatgtactacaaactgtttatgtagttgactttctattgaactgaaattcac

SEQ ID NO: 253490 - DNA, 745 bp, Homo sapiens
taataagtcatttatgcccattttaattatccaatttaacacattcaacaattaaggcattcagattttggtgctaacagtcatatcaaaacacctcagatcctgtcttccccctccaaacatctgtaaactataatttatgtgaaaatatagctatccacttattgtaactggcaagatagaatagctattctcgaagacaatggttttcaactgtgactgcacaatagaaacacctggacaaatttaaaaacatgaaccatacctgtattccattgtaagccaactaaataaagatcactggaaagagtgagtgcccaacaatttttttcttaaattctccaggcgattctactgtggccaggcctaggattcactcctctgggacatttctcaggcagtgcattctctgactcgataaatgaagttcagccaagaataatcagtggaaagattgcctgaagtcaatgtcattcattactttccaggctaccatctttaattaacccaggttggcagaataaaggtggagtgctaggacaggattgtaatgccctagcagacttaccgtttccaaatttcccttctgtactctcatgtactttatgattagtcaattatatctgtattattccaactactatgatgccggaaaaacaggttggcatttttgaaaaagagttttagattcctatcattttaaaatggaaaattatctggttcttactaacttgcattgacgaat

SEQ ID NO: 253491 - DNA, 478 bp, Homo sapiens
gcaatgacttttgcaccaacctacgctaaggcagctaaggcagcacacaggagagaggaactctgagagcatcccagggagctggatggtgaaggaggagttggagttgattaggtgaggaatgatgattggggaggtgcattctgtgtatggaatgttcataaatgcatgaaagcttaagagcttacagctgggatgtcctgtgcggctagaactaagcaggtaagatctcgaaggtaaatctgattcatatcagagaggcctatcgtgattctaatgaatttggacatcattcttaaggtctccaaacacttttgatgatgcatccttttggtgaagaaaaaaagaaaggtacccatacctttcccaatataatacatgttatatttatgaataatgtacatgtattgtgtaaataaataaagcatacaaaaaatacaagtgtttaaaggatcaaattaaaggtaaatacaaaaaa

SEQ ID NO: 253492 - DNA, 364 bp, Homo sapiens
ggggaggggggttcatagtagaagagcgacggtgagagctaaggtcggggcggtgatgtagagggtgatggtagatgtggcgaattttggaaaagttgttgagaaccattcttgcagtgaggtttctgctgcaagagtcctggtctcaaagtgaggcagcagcctggcagtggcaactgaggcagagatgccaggtgttcagggcctagataactgtcagatgtgcgggagagaaggcaaggagacagcctagcagccttttgggtttctccttcgggtggctagctaagtgacggttgtatttgtaggaatagaaaatagagatgtggaaagggtaagaaaagaaggtacctaggagatgaag

SEQ ID NO: 253493 - DNA, 339 bp, Homo sapiens
tcgacggtgacaccattggggcattccgttatgtccagggtgatggtagatgtggcgaattttggaaaagttgttgagaaccattcttgcagtgaggtttctgctgcaagagtcctggtctcaaagtgaggcagcagcctggcagtggcaactgaggcagagatgccaggtgttcagggcctagataactgtcagatgtgcgggagagaaggcaaggagacagcctagcagccttttgggtttctccttcgggtggctagctaagtgacggttgtatttgtaggaatagaaaatagagatgtggaaagggtaagaaaagaaggtacctaggagatgaag

SEQ ID NO: 253494 - DNA, 703 bp, Homo sapiens
atttttggcacataaatgtaatattaaagtcagtgatgctataacttgcaatgtttgcatcatgtccaccttttttaaggagtgaaaaagccctagtatgtttttaaagaatagccagtgcaagctcagtactagagtgactacacacactgcatgttttcatatgtggcactttgatgtaccgtgttgggttattgttctagattggactgttaaatactatgttcaaggctgggttgtcatttttataaaggtcttggtgttttatggccattatttattacttttgatatagagaatgagctacgtgcatttataaagcaataagaggatgtatttaatgtgccttgttttgaactgaataagaaccggaagcatgaatcaataaaactgattaaaatggtcaaaaaaaaaagctggtgaagtatttatgttttcctttaaaacacatgcagaacacatatacgcatgcttgcgtgcacgcacacacacaactcacacacacaactctcacacacacacacacaccagccaaacagtccacctaaatggcgctgtggtggtgagagctctgggcaatggaatcttaccaaacgtgcagtgctctgttttggagacagtgacaccctttttgtttatttcagatataaaacaatgcaggctttgtcctgaatatcattatccaaacaagaaaagggaacat

SEQ ID NO: 253495 - DNA, 480 bp, Homo sapiens
ggacttcgaacctcgccccctgcacgacccacacaaagccctgagccctggcgttcccacccgaagcccccagtccccgctgccgccgtcttcttcacctgttctcgggaagggctgcatctccgagccgaagtcaggccgtgggccggggcgaggtcccagagaggccacagcggatctgccaggctgagccggagccccagcagccgacgagagatctcagagaccaaggctcgccttggcgagctcttgccttttcctcctcccgcaagtctcaaacattcatacactgagagttcagctctataaatcctgctcctctttcccatatcataattaaaaaaaaaacagtaggggaggttttaacttttattgcgatttctggagttgggctgcggagcatatattaagtttacgcttatgcgctctcggcggggagggtcctttaagaaataaaaatccatcttaatatccacagac

SEQ ID NO: 253496 - DNA, 493 bp, Homo sapiens
tgctggtgctcttactcttcttcaagaaaccaattaagatcctctatagagaaacaacatcatacagaatcccaaaattttcatatacaatgacttacactcaatcaaaaataactaggcatacaagaacttaatgcagcaacagaaaatcaaaacaagagaagtaacagacaacagaaacaaatatacaagggtttcacacagtgaaattaacaacatgaattctaaagtaacagcatgtttagggaaatcaaagactagattgagaactgcagccaagaagaagaagaatcgaacgcaaattccagaatggaaaaatacaataactaatacaaaaactaaaaatacaataactaatgctacatatggatatatagcattttaagtaaatacagttgaagagagaaattagtgcattgaaagccaggtcagaatagccatagtaaggcatagacaaaatgcaacattagataagagaacacgtcaagaacaa

SEQ ID NO: 253497 - DNA, 401 bp, Homo sapiens
caattctcctgcttcagcctctcaaatagctggggattacaggcacctgccaccatgcccaggtaattttttatatttttagtagagacagggttttaccatgttgtccaggctggtctcaaacacctgacctcaagtgatccaaaatgccttggcttcccaaaatgctggggttataggcatgagccactgcgcctggcctgctatcagctacctctgacttcagctggagcttcatctgtaagggctcccaggcgctcctggaaagtacacatttccccagctttcattcactttattcaatgattgagaaagagaaacatgcttggccagttcacaaatctgaatttagatgtttgggagttctccaatgtttcacttctttttgctgaggtaggctt

SEQ ID NO: 253498 - DNA, 284 bp, Homo sapiens
gaccagctaagggaggcaaggagaaggcccctaatgccccccaaagaccactgcctgttctgttcaggatccccagcatcaaatccatagaccctgggattgcttttggagatgggtagacaagcttggtgagctgtggaatcagtgaccgtgagaagcagccttaggacaccaaggtggggaagctgctggagaaagacaggtggcgtcaccggctctgagtctaaagggaaaatgggtggcaagaaggtcctgccagggttgcccagagaaaggtagacaag

SEQ ID NO: 253499 - DNA, 440 bp, Homo sapiens
ttgaaaattatttagaaatggtcttccctgtgtacccctgctgtctcatgagacttcaagatgaatgaggttcctctctccctcttatgtaatagctactttccaatctcattttctaaaaccaagactccaaagaggataaaagctaaacttagtatgatctttttaaaatttttaagataatgatataatgaaaaggaaaattagtccttgagctcctccagcctgggtgacagagtgaaagcctgtctgtaaaaaataaataaacaaaacatgtaaaggtaatttctatctacttatattttattcaagacttccttgaatgattcctttaaaccatcacaatacatgtgtatttaggagggaaaggaaatgattattgtcactttttagggtttctcaaacaacaattcacccaaaaccctttattttagtttaac

SEQ ID NO: 253500 - DNA, 280 bp, Homo sapiens
gtgtagcatctcaatgagggagggggcaagggtggaggtttgactgaatggaatgatttatgttcacagaccacataagtgctctggagacccgaacttgtcatccagcaccctgtttgacatcattctccacacattcatggactgccatcacccagccatgtaatgggtaccaagaaatgaccaaagccaggtccaaatgatcaaagttgatccaccccgtccctggataacacggaaacccttttgtcctactgggagactaagatgctacacttgg

SEQ ID NO: 253501 - DNA, 478 bp, Homo sapiens
agcaggaggcctttagcctgaggcagtctccttactcccagtgtctatgtaacaaactgcaaccacatttagtaagtaaacaaaccaaaacctaccttatgagtatccttttttttgtaacaaatagccatgttgcagccaatcacaaatagctgagcttcagccaatcacaggcaaccaattgatcagaccattcccaaataaggcagacaactcatcacatcgtgaccaaataaggcaaacacctcattgtacccaatcagataagttttctactttgcttccatgtttggcctataaaatcttactgctcatgccactgggcagtgctctctgaacctctttgggttttgagtgctgcccaattcatgaactgttctttgctcacaacataaagtgtgtttaaatttgatttgtctaatttttttaacacgtcaaattggtataatataatgtaaataaaatcagccaataatgc

SEQ ID NO: 253502 - DNA, 700 bp, Homo sapiens
ctaccgttgggtgtcatctttgatgaaatcttaaaaattaagatttaattatggtaatgagttaaaccgaagtagagatgggttctgagattttggttagaactgttgtcttgctatagctttcatgtttctttctataccctctgtgtttctaaagaactatgaagtgaaggcaaagatctactcttttctatttctatgaaaactgtacttcttttgtggggttgatggtacataaccatgtctaactatgtaccactgacgtgagtttcaatatgtggttctcttcacaaacaagcttcagttttgtatggtcattctcaagactctactgacatttgctccataggaccacagacatcagagtccttacaatgttagtcaaaagtaatctctctctgtttctctctctgtgtctctgtctatctctgtctctttatttctctctctgccacacacacacacacacacacacacacacacatgcacgcctgtgctcacacaagttatataatcctgtcccaggtccaaatactatttctaactgcctcattgatttttattatttcaactaagctatttacaggtatcctaagcactttataatattaaataccacaaaatatactgatatcatataatctaattgaggagaaaaatatatatgttaagtttcaaatgcataatgaatatagcattt

SEQ ID NO: 253503 - DNA, 1069 bp, Homo sapiens
caactttttaaatgttcatccacttcaaatcccttcctcttccctgtaaggtttattacactgtactcacaattggtgtgactcaccagcagaaggaaactggatatgactgggagttgtgcttagtttcctcattcaacagagatttatggagcacttgctatatggaaagcactggccttgggtctggaaggatacaaaaaaatgaagatcagtttcctgctttacattctagttgagataagaatggaacataaataactactgtagaataaatgttgtcttattcatggtgagtgccagtaaaaccttgaacttccaagagctaggcctcctatgttccagatgctgtgtcacacagtttacaatgttcccacttaaccttcgcaacaacctctaaagaagataattgccattcccattttacagctaataaaacaggaactgagaaattacaagtggaaggaaataagatctgtatacaagtacagatgtgaagagtggcttccaggtctttgttcttctctgtcaattcattgatgttatctgtcttcaggatttcattttacgcctatatcagaaataaataaccttgaggaaaccatggatgggtttcaaaaggtctatgaaagaaactatgtgcatgcttttttcttagaggtttttttcatgatattttcaaaatgtcttctgatcttagagagttttaaaattatccacatatttggacttttctctccactctaggtccttatttccaaatgtctactggaaatctacttttatatcctacagattgctcaccttgtcaaatattgaacttttactatccttttcccaaagttgcttactgttgctgctgtattgcctttcttgatgaatggtgtgctaccaccctttgtcttgggacctcccacttctttagtgtctccccctcctcctatctagttatttgcctcattgtgttagttggatttagtacagtttaataaatatggattacatgctactgtgaggctgatactgtggttggttctaacagttcaaaaattaaaaatgaaaacacaat

SEQ ID NO: 253504 - DNA, 173 bp, Homo sapiens
tctccagccttcctaaaaattctgtgaagcaccaaatatatttaagtaaatttcctatgtgctcaaccagccagtaaacaacttctgctgactgaaaacactgaatcgtccaatcatgaagccaaaagaatgtggctgtataacaagaaaaataaatccatgtatctacagta

SEQ ID NO: 253505 - DNA, 842 bp, Homo sapiens
gcaacacagtgagattccatctaagaaaaaaaaaaaaaaaaacaccaatcctcatttcaaggttcatctcaaaaatccatgaatcaaaagaggaggcctttaaggagaggttaaggcattctattcaagcctctttttttttttcagaggttcagggtttgttgagtaggaaggtatgatgtggctcctggaatgatgctcataccaaagggtagaattttcatttttaaagaattttgtgcaaaaatgatggaaatcttttttttttttaatttctaagggtgatatgactcattaatgcatcaggctttcttttacactagacagcaatcacatactcactactaaggttacctctgttagcaagaggtatctcatctataagcagctaataatgggaaccaaatagatgaaataaatcagatgtgaaacaaatataagaccctcgaaatgtaagtgaccagcaaagagaatagtgcatcttgggacataagctatgactatattagaccttcaaagccatatttgcacagataggtaaagtgctaggaacaggtgaatgcacaaccgtacctgtgggacaaaaggcctcagatgagataaagagtgaagtcagaagaagagagattttatataagccaccagaagacacaatagcactgcactctcacacttgggtctctgtctctttggacatctgtcttgaccattccaatagaaaatttaaatcttggttcaggctgggccattgatcctggtcccagtcctctattgagtatgtgtcagagattcctgggtgaactttcctctcttttcctaagggttccatgggagacaaatat

SEQ ID NO: 253506 - DNA, 789 bp, Homo sapiens
gcaacacagtgagattccatctaagaaaaaaaaaaaaaaaaacaccaatcctcatttcaaggttcatctcaaaaatccatgaatcaaaagaggaggcctttaaggagaggttaaggcattctattcaagcctctttttttttttcagaggttcagggtttgttgagtaggaaggtatgatgtggctcctggaatgatgctcataccaaagggtagaattttcatttttaaagaatttttcattaatgcatcaggctttcttttacactagacagcaatcacatactcactactaaggttacctctgttagcaagaggtatctcatctataagcagctaataatgggaaccaaatagatgaaataaatcagatgtgaaacaaatataagaccctcgaaatgtaagtgaccagcaaagagaatagtgcatcttgggacataagctatgactatattagaccttcaaagccatatttgcacagataggtaaagtgctaggaacaggtgaatgcacaaccgtacctgtgggacaaaaggcctcagatgagataaagagtgaagtcagaagaagagagattttatataagccaccagaagacacaatagcactgcactctcacacttgggtctctgtctctttggacatctgtcttgaccattccaatagaaaatttaaatcttggttcaggctgggccattgatcctggtcccagtcctctattgagtatgtgtcagagattcctgggtgaactttcctctcttttcctaagggttccatgggagacaaatat

SEQ ID NO: 253507 - DNA, 358 bp, Homo sapiens
agatgtgaccttatttggaaattaggtctttagaaggtaattggtcaaaatgaggtcattagggtgggccttaatccagtatcactgcagtccttataaaaagatgaaattttgacacaaagatatgcacagaggaagattatatgaggaaacacgggggaatgccattggagtgatgcatctactagccaaggaatgccaaagattggcagcaacacaacagaacctggaggcatggaagaaattctatatcacagccctcagaacaaaccaatcctgccaacactcataatttggacccagcctccagaactgtgagacaataaatttcctgttatgggctggacacgatggttca

SEQ ID NO: 253508 - DNA, 471 bp, Homo sapiens
cactacacgatgactgaatggtggcaaagaagaccctcctattcaggctttcagctacttttttccttctgatccttatgtgtggttcctgtggtcttggtcagtatcagcaaacatgtttagtgacaatgtgttacctgttacttctctatgctataagaaacaaaggaccatgcttttcatgtgagtggaatttagcactcattttgatattgccactagaattttatgttagataacaaaattatgtgtgtatgtatgtgcatactatatgtgtatatgtatattcatatatatgaagccctttaaagtgttcatttgcttttctcaatctgtatctatttatctaactagtgtatgtcatatagtatatattatgcaatattataaaagaaattatgcctgtcaattataagaaattatatatttgtaagaaattttgcctgcaattaaaaatatttcttacctagt

SEQ ID NO: 253509 - DNA, 779 bp, Homo sapiens
tagttccaaaagcatttattatttgctaatttgctagcatgcaggttgatgcaggttgataccaggtgttggatatttcttgaccagtcagacttggttaaggaatggagttggggtgagagacaatgcattaagttagtaaaaggttgtaggcaaactatgctcatcacaaaatgaatcagttagtaaaagacagcatatattatgtaatacaatgtagaaatctgaaggaataaaatggaagaaggcaatgtggatagatcttaaatataaaggtggttaaacataaatgagaatcagaatggtatttaaagcacagtgcttgtattggacctaaatcttatgtacgtccccagatttcctccctgctgccctgtcctatcgccccgtcagttgccctggaaatcccagttcctctgctgccaccagacagccaggtggaccagttgtgtgtctagtttctgattcctccagcgactaacagatttgtatgaaataccctacagagaatggaatctgacatccctaccaccaaagggggcagatgatgcatatattactttaagcagctaaagtggcagctaaactgctaaaactttttcagtctctctacattatattaaaaaccagattgctatgtataatatgcagatctcaaatgtcacataaacacatagaatgcaacagagtagttttataagttttctttcctgggacatctgtcaaatttagacatttatgattaagtcatataagccagggaagtacagattttccaa

SEQ ID NO: 253510 - DNA, 805 bp, Homo sapiens
ccctgagaggccgtgctcgggctcgcctgctcagctcactccgaaagcctctgctcagacctgcacccagtcacagcagcacagatgtgcaggaggagaccatttccacggaccctccgactcctaggaggcagtcccttagggactggccctaacaacaaatgaggagaagccaagttctctgctttctgcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtttcagatcccttagttttgggtgcccaagttcacggagggtgccggggaatagaagctctgtcagtctcgtctggatcttggtcctcagcaactgtctggatcctgacagccttggtctaggtctctccaggcctttccttcctggagccacagtgcttagagacaggccactggggtcagcatttgagctcagctatgatcagaaaaaagcaccgttgaggttgcagtgagccgagatcacgccactgcactccagcctgggcgacagagagagactccatctcaaaacaaaaacaaacaaacaaacagaaagcaccgtcgagaaatggctccagcgctgactagcggccacctcatttccccccttgaccactgggccagttgggtggctaggttgcctcattttgcatccttctgtatccccaaatctgaaataaaagctggaaaaaaa

SEQ ID NO: 253511 - DNA, 777 bp, Homo sapiens
ccctgagaggccgtgctcgggctcgcctgctcagctcactccgaaagcctctgctcagacctgcacccagtcacagcagcacagatgtgcaggaggagaccatttccacggaccctccgactcctaggaggcagtcccttagggactggccctaacaacaaatgaggagaagccaagttctctgctttctgcagacagggcctcccctggatgggatcttcctctgaggcgagcttcagatctgctcaagcttcctgcagtggggccaggaggcagggcctgggcaggggagaccagaacctctcggtgatgcctccgaatggcagggctcagacacacacacctggctgggtttcagatcccttagttttgggtgcccaagttcacggagggtgccggggaatagaagctctgtcagtctcgtctggatcttggtcctcagcaactgtctggatcctgacagtgcagtaagagcttgcctggcctgtgtgcagagctgcctcatcctgaaattctgggagttgaaagccccagggcaacccttaaccaatgggggaaaagcattggtgtgtaaatcccccagcttccctgggtgggctgcagctgagccatattctacatgacacttccgaggatccccagtgggcatgacctcaatcgcccacattggatgccacaacctgcactggcttttctcccttccctgtgggtctctctctgcacttcctcccttgtgcattctaggttcaccttccaaataaatgatgtgcactcagg

SEQ ID NO: 253512 - DNA, 1177 bp, Homo sapiens
ggggggcccccccaaatgagggaaaagattccctttggctcccccaaaggggggcaacgggccccaggagcgcctacacctccctggaggcccacacttctctccccagaagctcacacgcagcgtctgaggtgcagggcccaggtgtgctggggtgacaaagccccgagctgtggtgatgggagggaggaagcgccggtttatgtctgttctttgggctgatttgctgtctctgtctttgtctctaatgtcctttgcaccactgaccttgaggagccttttgttcctcctgtcccagtttggtttccatgggaacctgagtggcagcgtcatcactttgctgaggtgaaatgcccctggatgccatgaatacctaggggaaaacctgccagagaagaataaaccatccaagagacggcgctgcagggcctcacagtctgcttccatttcctctcaggtttcagatcccttagttttgggtgcccaagttcacggagggtgccggggaatagaagctctgtcagtctcgtctggatcttggtcctcagcaactgtctggatcctgacaggtgtgtgataattacttagtgaattcatgggtgtgggccgtgatagaattaagtgatttgatgtcctctcgataaatccaggtaacgacatagggttttttgagtttgaccctctcctgaaatttgccatctgacaaaatgacatcatggcagagttgtaaactgctgtggatgtatttatttaatttctcaaattaaaataaaaggtaacggtacacttaagagtggtcactacagccaagctaattgacacccactgaactttctggaatgggccataggatgctggacaataggacagatttggaatgagcagtcttccattccaactttagtttctgcaaagctgttgagagcatggagccaggctgcggggtctgggttcaaatcctgactctaccacttaggagctgtgtgtacatgggcaggacaactggcctgcctgagtctcagtgtaggtgtctgtaaaatggaatgataatagcttccatctcacagattcactgtgtgggtaaaatgatagatatgaaatgctaagaacagcacctgtacgtagtatgtcctacatatcttactgttatcattagcatatttgtttattccaagat

SEQ ID NO: 253513 - DNA, 433 bp, Homo sapiens
acaacaacaacaaaaaaccccacagaattgtacaacacaaatagtggaccctaatgtaaactatggacttttgttaataaaaatttatcaatatagattcatcatttataacaaatacagcacactgatgttaataatgggaggaattgggtgcaggggaggaggggttataggaggactcagttctatctgaccagttttttctgtaaacctaaaggcatctaaaaaataaagtctattaatttttctaaaaatctttcattgttaaattcagattttaccaagtgtactcaagtatgtggaacaattatgttttctaatagaaactttttaagattatttgttttatttatgaaatctaaattgctgaagctttttcaagacgactgcttccattttttgtggatctataaagaatgcacagttcatgttg

SEQ ID NO: 253514 - DNA, 419 bp, Homo sapiens
gaagacagagtctcgctctgtcacccaggctggacggcagtgatgcaatctttgctcactgaaacttccgcctctaggttcaagtgattctcctgcctcagcttcctgagtagctgggattacaggcacccaccaccacatctggctaatttttgtatttttagtagagaagaggtttcaccatgttggccaggctggtcttgaactcctgagctcaggtgacccacctgcctcagcctcccaaagtgctgggattacaggtatgagccactgtgcctcgcacatcctgcatctctttgtttctgaccatagacatctgaatatgaagccaacattacaaaaataagttgacataaacttgacctattcatcgtcctctttcagttcaactaacactttatacattcgtcgatttttcc

SEQ ID NO: 253515 - DNA, 2372 bp, Homo sapiens
  misc_feature (1930)..(1930): n is a, c, g, or t
ctccagagaggctgctgctcattgagctgcactcacatgaggatacagactttgtgaagaaggaattggcaacactgaaacctccagaacaaaggctgtcactaaggtcccgctgccttgatggattatacacttgacctcagtgtgacaacagtgaccgactactactaccctgatatcttctcaagcccctgtgatgcggaacttattcagacaaatggcaagttgctccttgctgtcttttattgcctcctgtttgtattcagtcttctgggaaacagcctggtcatcctggtccttgtggtctgcaagaagctgaggagcatcacagatgtatacctcttgaacctggccctgtctgacctgctttttgtcttctccttcccctttcagacctactatctgctggaccagtgggtgtttgggactgtaatgtgcaaagtggtgtctggcttttattacattggcttctacagcagcatgtttttcatcaccctcatgagtgtggacaggtacctggctgttgtccatgccgtgtatgccctaaaggtgaggacgatcaggatgggcacaacgctgtgcctggcagtatggctaaccgccattatggctaccatcccattgctagtgttttaccaagtggcctctgaagatggtgttctacagtgttattcattttacaatcaacagactttgaagtggaagatcttcaccaacttcaaaatgaacattttaggcttgttgatcccattcaccatctttatgttctgctacattaaaatcctgcaccagctgaagaggtgtcaaaaccacaacaagaccaaggccatcaggttggtgctcattgtggtcattgcatctttacttttctgggtcccattcaacgtggttcttttcctcacttccttgcacagtatgcacatcttggatggatgtagcataagccaacagctgacttatgccacccatgtcacagaaatcatttcctttactcactgctgtgtgaaccctgttatctatgcttttgttggggagaagttcaagaaacacctctcagaaatatttcagaaaagttgcagccaaatcttcaactacctaggaagacaaatgcctagggagagctgtgaaaagtcatcatcctgccagcagcactcctcccgttcctccagcgtagactacattttgtgaggatcaatgaagactaaatataaaaaacattttcttgaatggcatgctagtagcagtgagcaaaggtgtgggtgtgaaaggtttccaaaaaaagttcagcatgaaggatgccatatatgttgttgccaacacttggaacacaatgactggagacatagttgtgcatgcctggcacaacatcaagcctgtgattgtgtttattgatgatgttgaacaagtggtaactttaaaggattctgtatgccaagtggaaaaaaaaagatgtctgacctccttacatatgcaaaaatataccttcagagactgtcagtaggctggaagaagtggatattgaagttttgacatcaatgatgaggctccagttgtctattcattgactgatggtgaaatggctggagtgattctgaatcaaggtgattgtgattatagtgacaatgaagatgatgctattaatactgcataaaaagtgcctgtagatgacatggtgaaaatatttgacaggcttatggaaggactacagcagcacgcattcataacagaacaagaaattatgtcagcttataaaatcaaacagagacttctagacaaaaaccattgttgatgaggcagatgcctctagaagagacgtttaaaagccatcaaacacaatgcctcatcttccctggaggacccacttcctgatccctcaactgtgtctgatgtttcttctcatgtaagaaataaaaaataaaaataaaaaaanatatattggtatgtaactacaggaaaaaaataaaaaatatatagtggacagtaacctttcaatcaaaactcagtatcataagtagagactgaaaacttgccgttattgattgttgttattaacagctgatacaggtattctgctgatgctactgctgcctagttaccatgaacacgttttttcactattaatggtgcgtcatattttttacttttaagtacttacgtgtgagtaagtgtaagaaaatgattgcttatcagtagtatcaatgatttactcaatatctgaatcaccttgattcagaaccatttcagctgtttcaccatcagtcaatgaataacagcctcattgatgtcaaaaacttcaatatccacttctttcagcctactgtagactctggaagtatactttttgcatatgtaaggaagtcagattttttttt

SEQ ID NO: 253516 - DNA, 687 bp, Homo sapiens
aagacgtaggatatcttgaaatccttgaaagttctaccagtccagtgaattacgaagggatttaaagtaaaatttataatctggggcccactcataagccaattagggagtttctctatcacctaagaaaaagtatttgtaaaatcagcttgttcattaaatgtcacttacatgtttcacattatgaatttaataaatgatttgtaattaacttgaaaaatttagaagacagaaacacatcagacatcttcctgacgtttggcctttgcatgggctcttcctatcatcttaacacacttccccagacatctaagattccctcacctccttcatatctttgctaaatgtcttcttttcattatgaacttaatgaactgttctatcctgttaaacactgaaacctgccctctctcccaacctcccgaactcccaatgctccataacttgttctatatttctttttcccattgtactagacccaacatactataaaatttatttattatatttgttgttcattgactatcctccttgttagaatgtaagctctgcaagggtagtttcttttactaataatattccaggtgcctagaatagtgccttcacaaaaaaatgcactcaaatatttgttaagaatgaataaacaaacaaattcatgtactactttctcaatttgtgtcctgtctt

SEQ ID NO: 253517 - DNA, 239 bp, Homo sapiens
ggaaaattattgctttaattaacatttgtcattatcagcccatattcccttaagaatattaagccatttgatgatggatttttttatttgtttgtttgtttgcttgtatttcctagctttacacatattacattagttttcatttgtttgtttgttttgagtcttgctccggcctgggtgacagagcgagactctgtctaaaaaagaaagggaaagaaagaaaaaaaagaaaagaaaag

SEQ ID NO: 253518 - DNA, 246 bp, Homo sapiens
ctgatctgatggaattagtgtccttattagaaaagactccagagccttctctgtctctgcctctgcctctgtctctgtctatgcctccgcctctgtctctgtctctgcctctgcctctccctgagaacatacaaggaagagcacacagtgagatgatagcagcctacaagccaagagaagagacctcagaatgaaacctactcttccagcaccttgatcttggacatctcaacctccagaactgtg

SEQ ID NO: 253519 - DNA, 311 bp, Homo sapiens
aagcatggaaatacctgttcctgtcccgtgcttgtgaagaagaagggggtggtggtggtggtggtgtgcttgagtcttctctctgctcacttagaaagtgaaagaatccattcttgaacctacagatgaaagggaggtgctgtttcatgtgcagagctcctgctgggattctcagtctctaaggttctcacctaatgtacatctgccctccctgtgttgtttttttatatttagaaccaataaagttcttgcacagctacagttgttggcctgcactgctatcaagggtctctctctttctccctctccac

SEQ ID NO: 253520 - DNA, 670 bp, Homo sapiens
ctatgtgatcctaccaaccaacctcccaatcgctgggatagagacatgagccactgtgcctgactcaaaaatcatactttatccttgagccagtggtcaggatagattcgcacactccctctgcagtgactccaggagcccctctcacagctcagagcggaagctgaggctgcagcctgccatcttctccgaataggccgcatccaaagcgctttggatgaggcctattggaaggtggaaggttggagaggggagaggatcagaaaaaataactaatgggtactaggcttaatacttggatgatgaaataacctgtacaacaaacccctgtgacacgagtttacccatataacaaacctgcacatatacccttgaacttaaaataaaagttaaaaaaaagatagtagtagttcccttttcaggaaagaaaagatgaaagagagaaggggcccagataacttggagtgaagactaagacctaagagacaaccatctggcaggaaccaggaatcagtgagctttccggctttcttactgatcagaaatatgccataatttgcctttcaaggtgacttaaaagttctgttgcctgccaggaaccaaaaagaagatgcatgtatctttccttttgtagagcaggaaactcacctatgtgtaagacaggctgcct

SEQ ID NO: 253521 - DNA, 301 bp, Homo sapiens
ggctggagcaaggaggtggtgtcaggccaaagaaacaagctcatgagcagctgggagagacagggctcctgagggctgctgtgagcttggctagcagcagagtgaaaaggtgaacccagcaccccacatggagagggaccctcgaggccagcaatgccctgtgatataggaaaggacaggagcaattctctcctcaggagctttcccagtccctagtgtgagccccaacaatcaaaatcaggcaacgagcacaacacaaagattaaataaacaagaaaacaagtcgctataattgaaagcc

SEQ ID NO: 253522 - DNA, 413 bp, Homo sapiens
tttaagaattagatgctacattagaggtgctaaccttggagcagatatagaaagagctcctaaaatggcaagatgctcataaatcaatgaggcaaactcctcaagggtgacaaactggggaaggaacagtgaaaagttactccagggctgtacgcagcagatctttggggcatggaggtgagaaagacttggggtaggagggatctgggaaaacttccagcagatgctatgcctgagttaagttttgaaggatgtgctggagttagcctcataaacagaaataaaaacacagaactctaagtggtggtggagtatgatgatggaacagacatatttgtttatggtgaaggggcaggaaaggaggctgggtgttacagattgttggtagctttgtggcttaaactggtgtttaa

SEQ ID NO: 253523 - DNA, 385 bp, Homo sapiens
gagaaaaatgctgacatgggtgaagtgtaaatattttagtaggcttaatagtagtgggattggtgaattctctcactgcttttgttatttaaaaaaatgtaacagggctggatatggttcatgcctgtaatcccagcactttgggaggccaaggcagggggatcacttgagcccaggagttcaagaccagcatgggcaaaatggggaaacccagtctctactaaaaatacaaaaattagctggacatgttagcatgttcctgtagttccagctgctcgggaggctgaagtgggaggatcacttgaacccaggaggtcgagggtgcagtaagccatgattgcaccactgcactccagcccgggggacagagtgagaccctgtctca

SEQ ID NO: 253524 - DNA, 538 bp, Homo sapiens
caaaaagctaactgagctctagaggggaattgattaatatgcagtggctcatttataatttaacactaaatgataaatagattgtgatagttataagcacatttgatttccaaaaggggtttttaatcctatacctgactttctgtggcatcaaatataaatagatgtatactatttttgtaaataaattatatactctcataatcagatggtgccatgtagcccacagagccaaattatgaaaacaagacgtattcagtgaattcatctaattactgaagcagataagggccatgcaatgttagagtggataggtttgttggaaataacccagcatgcctcctcatttgatgggtacatgaattgaggcccccagacactgccagactgacaagacaagttagtgggaaacagactaggactctcatcggtttctaacacctgttttaagctgctgtttcgcagcaaaataaagccattaaaaggtgttctttggtgctgtcctccttttcctttaagtgataaggtccagtgagaa

SEQ ID NO: 253525 - DNA, 384 bp, Homo sapiens
gcctccaaacgtgggagaaggccttagagtctccttcggtaactgagaagcagaatactcccattgtatgaggttgcttggcagttgcagctgtcactcagacttcttatccacaccaagcacttccaaatacaggaaagaaattagactttgtttctctaccctatttggataataattaaatgtttcaactagaaacctcttcactctggcatctgaagcatcatcttagtgtcaacttctcttgaaaagggcacacacacatacacatgcatgtactcatacttgctattttctttgccaaaatgtttactatgttatgggaaaaaactttttctcttttcttgaaataaaattaatttcttttgtttgtgctttccttca

SEQ ID NO: 253526 - DNA, 519 bp, Homo sapiens
tcttggaaaccatcagccgttgtgaccctggaggtttccaaaaaagaggatgacacctgaacgcccagcaggtctttggaactgtgaaatgcttcatctgtggggtcctggcaatcatggcagtaagcatgtcttctccaaaggatgtccacatcctgatctccagcacatgtgactatgttagatttcatggcacaggggaattaaggttgcagctcgaattaagatagggacattatcctggattagatagtccaggtgggcccagtgtaatcacaaaggtcctcacaagtgaaagagggaggtcagagtgatttcatgtgagaagaacctgacccgctgtggttgtctgtgaagatggaggatggggccacaagtcgaggaatgcaggcagcctctagaagctgcaataggaaagaaagcggcttctctcctattttagccccccaagactgattttggagttctgatctccagaactgtaagattataaatttgtgttgtttgaaaaaactaggt

SEQ ID NO: 253527 - DNA, 511 bp, Homo sapiens
cagcctttcattaatctaaagattgcttctggctcactgtcttcctcttctgccctaaattggcttctttctaatacctttaacatctacattggtgaaccatccagggctttagactcctacctacttctatgtctacctcatctttagtcctttacttcagctccaccatatccagattacattctggatctagtcaccagaaattctatgcactctgaactcttgatttctagcgtcccactttgtaaccactgctaccacccgctatattgtgttgtcaagtattgtgttgtcaactgctggcacagttctttgacctcatcactttattatctatagctccttctggcttcatgatcatttattcattctttcagcaggtgtttattaaagttcctgttaagtgctggcattgtgctatgtgcctgggatacactgatggctaagagacatattctctgctttcatagatcctatatcctgagaaaggagataagaccaagaatat

SEQ ID NO: 253528 - DNA, 1015 bp, Homo sapiens
aaacgctggcgtcaccactagaccaaggagccctctggtggccctgtctgggcataacagaaggctcgcactcttgtcttctggtcacacctcactatgtcccctcagctcctatctctgtatggcctggtttttcctaggctatgattatagagcaaggattattgtaatattggaataaaaagtaattgctacaaactaatgattaatgatattcatatataatcatatctaagatctatatctggtataactattcttgttttatattttattatactggaacagcccgtgtcctctgtctcttgcttcggcgcctggatggcttgccgcccacacaagagcaccttaaaaccagaactgcttaacctatttctgagactccaaaaagctgttcgctctcatgctgccccttttcatatttctcatatccgatctcacacacaacttcctggggccactatctctaggtaatgatagagcagataaattcatcagttctatatttcaacaagcccaagcttcccatgctttactgcatcagaacaacttgcccttactcgtatgtttcatctgcctcgcagccaggcttgagttattgtgcaagcctgccccacttgccagcatgtccctggtgttgcacctgtggaaggatgcaacccacgaggcttggctccaaatgaaatctggcagatggatgttacatatatatagcagcctttggctaactccgctatgttcatgtaatatagacacttactcccatatgttacatgccacatgccaaactggggaaacagctggtcatgtctgacgatactgtctgtcgtcatttgcccatatgggggtccctaaacaatttaaaactgacagtggactcgcttatgttagtcatgctttcccaattttttacaattgtgggcaatcaatcataaaacaggaattccatacaatccctgagggccaggcattattgagcgggtacatcaaacactacaacgcatgctgaaaaaac

SEQ ID NO: 253529 - DNA, 778 bp, Homo sapiens
tagagacagagtcttgctctgttgcccaggctggagtgcagtggtgtgatcatagctcactgcagcctcgaaatcctgggctcaagcaattctccctcttcagcttcctgagtaactgagatcacaggtgtgtgtcaccatgcctggctaattaaaaaatatatatatgtagagagagacaagggtctcactgtgttgcacaggctggtctcaaactcctggcctcaatggattctcctgtctcagcctcccaaagtgccggattataggcatgagccactgtgtccagttatgtttgctattattattattatccttatttagatgaaacttaagaggccttaagtattccatgctcccacatttacctgttcctgttaagtgttttaaggtttctcctagttcttaggtcattgattgatttaactgtgatttctaaaatctcattctctctctctctctcctcaaccctgagcacacacacacacacatatacactcgtcaattttcactgtgcaccataacatgtattaattgctcttacatttcacagttatgtttgttacagcggcctcacatggaggtccctactgagattgtctatgtgccaggtaccatggatggtgttagggctataaagaaaaatggcacaccctgcctttgaaaaactgatggtctaacagtaagttgatatgttgataaataattgccaaacattgtgatgagtgcttgatagagtcacaaaggtgctatggagccccagaagaaggcacgactg

SEQ ID NO: 253530 - DNA, 435 bp, Homo sapiens
ccggcctcctgtcccctcctggtagcacatctaccaccccgtttcccttccctgtaaagccacccccctttaggtaaatcccagcccctggccaagtttgaggttcttatgatgtcctggtctctctctcctactccttttccagcccccacctcccgcctccctgaacttctgacctttgtacttgaggacttggatctggctctgcctactaaacctttttcctctctgatctgcagaagctctcctggcttagctaggttatgtttgcttcctgatagcgaaaccaggctgggcttgggccagggtgggctgggtgggtgtggaccgggagcagaggggaggtaggtgaggaccacgggagccaaggccctgcagggctgccatgcttagctggaggggcacggttgccctctcctctgagtggcaggcagg

SEQ ID NO: 253531 - DNA, 458 bp, Homo sapiens
caccaggccctgtcaaactggtgggttctgcatcgacttcaccagcgagatgtcggccgggttcagggtgtccagagcagctagtgcagcctcgatgcagaacccaccaggccctgtcaaactggtcatggagagcatctgcatcatgaaagggatgaagccagagaggaagccagaccccagtggctccggtaagatgatagaagattactggggggtatccaaaaagattcttggggatctgaaattcttggagagtcttaagacatatgacaaagacaacatccccccactgaccatgaagcggatccgggaaaggtttatcaatcacccggaattccagccagctgtcattaaaaatgtatcgtcggcctgcgagggtctgtgcaagtgggtgagggccatggaggtgtacgatcgcgtggccaaggtggtggctcccaaacgggagcgactga

SEQ ID NO: 253532 - DNA, 402 bp, Homo sapiens
ttctcgttttactgaattactaagaactctagtagattactgatggttgtggtgttgggtattttcttcctgttctgagcattaatgcaaatgcagccaatgcttcaccatcaagaatgatgtttgctgtagttttgtgggaattttccttatctttctagtttgcttggaactttaggaatgagtattgaattttattaaatgctttttggtactcactgagatgatataggtcttttctcttttaaatcagttaataaattacctatcagtctatctaaaatggtgattcatcattacattcttaaggtaaagccttcttggtgatgttaaattttatgtgaatgcactacctaattcagtttactaatacgatgcagtcatatttacacaaatttaggc

SEQ ID NO: 253533 - DNA, 871 bp, Homo sapiens
gcagatcacccccacctgcccggcactcactgtccccagtggctggactctcaccgggccagtcactgagctggggccagcctggtctcaccagtgtgtgtctttaaatcatccaatttcttcagctgtaaatcgggctgggaggggccaggtgagctgcctgcctcaggggagtcggcgcccttacctgagtgatcccattcactcctcacaacaaacccatgaggcagggattgtcatcttcattgtacagagcaggaaatgggtgcacacagaggttaagagacttgcccaggtcacacagctaggaagaggctgtgatttgaactcagtcttctggctccaaagcccccacagagtcactcagggcactacaaagagttaacctgaatatgaaatgatctaagagtcgcagtgacaaaggcatgctctaagcgcttttcctgcagtaacttgcttaatccttacaacaaccctataaagtgggtactgttctcgcctcattttgcagatgaggaaactgaggcacagagcagctcggagggggcagagctgaatctgacaggctacagggcccctgcgttgctttgttataagatgacaataaggaagttcctttcctttgggattatttctgcctgaaagctcaagacttttagccacatcattgtctgggctccacgggaaggcggtgccacatgctgaggcatgctgggaaaagactttgttccatcctgtttggttgacatgctcttcatttttaagcctgaaaccgaagcttcctgctaagaattcaaaccatggagaaaaacgcagccatgataacggccactacttcctgagcctccagtgttccctgtgcttggggatc

SEQ ID NO: 253534 - DNA, 417 bp, Homo sapiens
agatgggtctgcttccacttcgcctttggccatcacctgcagaaccatgaaccaagtaaacctttcttctttatgaattacccagtctcaggtatttctttttttcttctgcacaaattaaccttagcagcttaaggtgtttatttatagcaatgtgagagcagagtaacgcactttcccaatcataagacacttagattgtttccaatcatcacgatctataatgctgtcatgagtacctttgtactaaatcttgtaagcatctctaattcttttcttatattagagttttggaagatgaactacagagtcaaagaatacaaacaattttaagacttttaatatgtattgtcgagttgatttacggttaagttttaccaacttaaacacccacaagcacttgcttcactgcacggt

SEQ ID NO: 253535 - DNA, 505 bp, Homo sapiens
taaattaaatcaacaacaggatacgtgtcattttttcacctatcagattggtaaggattttgaaattcctaatatccagtttgggcaaggctgtgtaaaatggacagtctcttgttttgctggtggaagtatacagctttcctgacaagcaaattggcagtgtgtatcaagttcctgaaaaatattcataccctttattccaataattctgcttctaggaaattttagtaaggaaataaacagagatgtgaacaagtctttatatgcaaatatgttcattacagcattatttatagtagcatcagttggaaacaatgtaaatgtccaacagtaagtagatggttacagtgttataggatcagagtcatgcagccattcataaatattgtgtttttaaagaatattgtcatgaaaaatatgcaaatacaaagtattaaaaaggaggatagcaagcaaaatataatatcctgattttattatattaaatgaatacattgcagtagag

SEQ ID NO: 253536 - DNA, 396 bp, Homo sapiens
cagatagtagcagtgaatacctcacaggactgttgagaagactaaatgagatagttcaaggaaggcacgtggattgtgcctggcccatgtaactactcagtaaatgtttgctatctttatgtatttgaacccagagctttgataatcatgattcctataatcgcttttagattaaaagatacaagttttaactttaagagacaaattttaaaacacttaagtatcattttcatttatatatggtccatctcaccattccagcaggcccatctgcagtcatgttacggagtcaatgcaaacaagtaaaataaatgacaggaaaaataatacttttgatatgcacatcagcaatgtgaatatgagctaaagcattaataaagacagtttcatattctc

SEQ ID NO: 253537 - DNA, 447 bp, Homo sapiens
gcaacccccccccccagcaatatccatccaggaaaaaggctgtaagcccacagcgaggcgcaccccaaatgtgggcttggtggtgatactgtttggacatttgtcctgccctaatctcctgttgaattgtaatccccagtgttggagttggaggtggggtctggtgggaggcaatggcagcatggcggaggatctctcctgaacggcttgagccaccccttggtgatgagtgagctccgcgactccctgttctgatcatttaaagccatgtgatacctctccctaactctctgcctctccctaactctctccctctccctaactccctcaactctctcccccacgagcgggggtgttgttattaaacgtctgtggagcttctgctgcaaggaacaaaaaagaaaaaaatcaaaaaagcgacaaaaaaacacaaacagaagaggaaaa

SEQ ID NO: 253538 - DNA, 312 bp, Homo sapiens
tgcctttgtggcttttcagggttcagcccccatgactactctcacaatttgagtgcctacagcttttccaggtataggatgcaagctaccagtggatctaccaaagtcatatatcattccagcattagctcaaaagtcccaagtctcatgtaagaaaatgaaagtcctttccattgatggagctgaaaaccaaggctcgagaactacatgaagaatgcaaaagcctcaggagccgatgcgatcaactggaagaaagggtatcagcaatggaagatgaaatgaatgaaatgaagcgagaagggaagtttagag

SEQ ID NO: 253539 - DNA, 1237 bp, Homo sapiens
actcagctgaaagggttttcttgactaccattttccactgactttaggaacattttctggtttctatataaaggactgacttatcaataagccacatttttccccttcctggaaatatccttgagtctgtaggatttctctcctccacccaccccccacaccaagtttcattaatatgaataactttccatgtttcttgtgttcacagaatggcctgggaatttttagttgagccaaaaagatgaatgagctgtgcccattacaaaccttgttggttatctgactgctccacagctctaaattcacactcatgtaggtggaagatagcggagaagtaagttattaaaggtgtggtattattaacagtttgtttaatgctcattaaacaaagttaactgcctacttagtttattcatttagtattctttaagagataaccctgaggatcatattacacttcagagttatgtctaaggtgtttcatatttcaattctcccaggttttaagaggtagggatcaaattttggagtcttgatggtgtttatgacagttcttttccattgcattcaacaatgtagagtccaagtggaatctgagttatgtgagaatcatgtatttaaacagaaaagtgaatagttggaaagctgttcgcggtaaatgaaattatccataggacagaggccttatgccaagatggtagctctattactttagttcccatctagttaggggggaatgaactgttaccagatgggggaaagattagttatcatcagtcattctagcatatgacagcaaagatattagaaactaaattttattgttgaaaggactttttctttatcgtttcaacaaagaagacacaattaaatgtgtgccattcttccttcagtgaattctcctcaccatcactacagctttttttaaaaacaattttgtcagaaatatcttgagctttcagggcttcttgtgttcacaggatggcctaggaatttttagttgagccaaaaagatgaatgagctgtgcacattacaaaccctgttggttatctgactgctccacagctcaacattagttccttgatggctgaaatcaagaactttggaagaacttgggctccagagttctctttggcatatgtaagattcagacttgtgtgagaaacttgcatatgaaatcttttgggaagtaaatgctaaagcttggccacatgttgcttttgttcatcagtgact

SEQ ID NO: 253540 - DNA, 1892 bp, Homo sapiens
tggagccatgctccctgggctcttccgcgggcgcccgcgcgctgcccttcgcttgaggcaaaaggactcttgtggaagatggaactcattgtccattttccagaatgtatttccaagcccatcaatgggacctgatactgctgttctgtgttgaaatgcttgaagaactcctgcatctctgcttgcatcttccatcctactgaaaccatggtcttctcggcagtgttgactgcgttccataccgggacatccaacacaacatttgtcgtgtatgaaaacacctacatgaatattacactccctccaccattccagcatcctgacctcagtccattgcttagatatagttttgaaaccatggctcccactggtttgagttccttgaccgtgaatagtacagctgtgcccacaacaccagcagcatttaagagcctaaacttgcctcttcagatcaccctttctgctataatgatattcattctgtttgtgtcttttcttgggaacttggttgtttgcctcatggtttaccaaaaagctgccatgaggtctgcaattaacatcctccttgccagcctagcttttgcagacatgttgcttgcagtgctgaacatgccctttgccctggtaactattcttactacccgatggatttttgggaaattcttctgtagggtatctgctatgtttttctggttatttgtgatagaaggagtagccatcctgctcatcattagcatagataggttccttattatagtccagaggcaggataagctaaacccatatagagctaaggttctgattgcagtttcttgggcaacttccttttgtgtagcttttcctttagccgtaggaaaccccgacctgcagataccttcccgagctccccagtgtgtgtttgggtacacaaccaatccaggctaccaggcttatgtgattttgatttctctcatttctttcttcatacccttcctggtaatactgtactcatttatgggcatactcaacacccttcggcacaatgccttgaggatccatagctaccctgaaggtatatgcctcagccaggccagcaaactgggtctcatgagtctgcagagacctttccagatgagcattgacatgggctttaaaacacgtgccttcaccactattttgattctctttgctgtcttcattgtctgctgggccccattcaccacttacagccttgtggcaacattcagtaagcacttttactatcagcacaacttttttgagattagcacctggctactgtggctctgctacctcaagtctgcattgaatccgctgatctactactggaggattaagaaattccatgatgcttgcctggacatgatgcctaagtccttcaagtttttgccgcagctccctggtcacacaaagcgacggatacgtcctagtgctgtctatgtgtgtggggaacatcggacggtggtgtgaatattggaactggctgacattttgggtgatgcttgttctttattgacattgaattctctttctcatagcctctccactttatttttttttatagggtttgtgtatgtatgtgtgtgagcagtgtaaagaaagaatggtaattatagttctgttaccaagaataaataataggaaagtgattacaaatattacctccagggttcaatagaaatcctcaatttagggtgaggagacttttttttggttttggggtttttccttgattgattttgttttcatagtgggaatcaggattgtgctttattgagcctgcagttacattgaattgtaggtgtttcgtgtgctgctaaggtatgcttatttgagtttatcaagacttttttttttctggaagacactgctgcttttaccatcacattggagcc

SEQ ID NO: 253541 - DNA, 431 bp, Homo sapiens
tggagccatgctccctgggctcttccgcgggcgcccgcgcgctgcccttcgcttgaggcaaaaggactcttgtggaagatggaactcattgtccattttccagaatgtatttccaagcccatcaatgggacctgatactgctgttctgtgttgaaatgcttgaagaactcctgcatctctgcttgcatcttccatcctactgaaaccctgccgcctcaggcagcacctccaccccagcctcatgccaggacctttgctatggtaagatagctgctctctacttccacactgttcgcatgcagacagtgcagactgttgcagctcgcccaatgagttgcagtctcgcacctagagttggcagatcgcccatgagttagcagctcgcgctctgagttagcagctcgccctgagttagcagctcgcacctgagc

SEQ ID NO: 253542 - DNA, 2033 bp, Homo sapiens
  misc_feature (590)..(590): n is a, c, g, or t
  misc_feature (1763)..(1763): n is a, c, g, or t
  misc_feature (1773)..(1773): n is a, c, g, or t
  misc_feature (1816)..(1816): n is a, c, g, or t
  misc_feature (1820)..(1820): n is a, c, g, or t
  misc_feature (1830)..(1831): n is a, c, g, or t
  misc_feature (1850)..(1850): n is a, c, g, or t
  misc_feature (1852)..(1852): n is a, c, g, or t
  misc_feature (1857)..(1857): n is a, c, g, or t
  misc_feature (1862)..(1862): n is a, c, g, or t
  misc_feature (1866)..(1866): n is a, c, g, or t
  misc_feature (1874)..(1874): n is a, c, g, or t
  misc_feature (1882)..(1882): n is a, c, g, or t
  misc_feature (1887)..(1887): n is a, c, g, or t
  misc_feature (1891)..(1891): n is a, c, g, or t
  misc_feature (1893)..(1894): n is a, c, g, or t
  misc_feature (1920)..(1920): n is a, c, g, or t
  misc_feature (1934)..(1934): n is a, c, g, or t
  misc_feature (1938)..(1938): n is a, c, g, or t
  misc_feature (1955)..(1955): n is a, c, g, or t
  misc_feature (1965)..(1966): n is a, c, g, or t
  misc_feature (1969)..(1969): n is a, c, g, or t
  misc_feature (1982)..(1982): n is a, c, g, or t
  misc_feature (1989)..(1991): n is a, c, g, or t
  misc_feature (2005)..(2005): n is a, c, g, or t
  misc_feature (2020)..(2020): n is a, c, g, or t
  misc_feature (2025)..(2025): n is a, c, g, or t
tctgtttatatttcggtagccccatggggcgggtggccacagtttcagtgcagatgtaaatccggaagcctccagcacctgcagctcatagacagctctcgcccaccttctcccaggaccaagccagtcctgtccagtccagtgtctgagcagagtcagaatccacaccacccgccgcctgggctcagaaagttctgctttaagtcattatttctccactgtacgatggggaatgcggtgtgtgggggccatttacccaccaacacagcagctgtgaggcacacacggctattgaaaattcatggaaattgctgggtgtggtggctcatgcctgtaatcccagcactttgggaggccgaggcaggaggattgcttgagtgcaggagttccagaccagcctgggcaacatagcgaaaccacatctctacaaaaaaatcctccaaaattaaaaaaattagcccgagcatgttgttgcatgcctgtggttccagctactcaagtgatccttctgccttgggtttccgagtagctgcaattacaggtgcacaccaccacacctggctaatttttatattttttgtagagacggngctgggattacaggcgtgagccaccgtgcccggccgatttccccatttttataaggccaccagtcacatgggattaagggcccaccctgctccagtatgacctcatcttaactaatgccatctgccacaaccattttccaaataacatcctatgctgaggtcctgggggttaggatgtgatcatgtagattttgttgggactacaggcatgagctactgtggctggccaattgcagacagatggaactgtggccagccacttcaccagtgaagtcccaaacacccctctgcaggcatgataagctagggtagttcttatcttttcctgattcctgttctctgtgtgtttagtggggaccacagcaggcagggtggggtgttggtggaatttgggataagtggagtctgggcaggcctggagctctctgtctgccttctgggcccgtgttggctgaccctgttgccccctctgccctgctttggctgagctgaattatttcttggtccttcccttctgggggcttctcgcttaacctcctttgttgtccctgataaaggggccttgttagcccgcaccttccctccttcgtcacttgacttctgcctgctcattctttgtaccttagttttagcgtcacctcctccaggaagtcttctttgatttctcctcctccctaggtctcctctaggctcccacagctgcctgtgttccctgcatgacagctctgctttatactgggattgctccactgcactccagtctgggcgatagagtgagactccgtctcaaaaaacaaaacaaaaacaacaacaaaaaagaaattaaatgaaagttaaaaatttagtctctcagtgtattgatttgctagggcagccatgacagtctcacagatggagaggcttgaaaacagacatttatgctgccataattctggaagccagaagtctgagatgaaggtgtgagtagggctgggtcctcctgaggctgacggggatctgcccaggcctctcccagttcctgctggtggccggcgtccttgatgttccttggcttggagaagcgtcagccgcatctctgcctccatctccacaaggcgccctccctgggtctgtatccaaactcccccaactccttcaaccttttttattttaagagatgaggggccgggcgcngtggctcacncctgtaatcccagcactttgggaggccgaggtgggcggatcangagntcaggagatnnagaccatcctggctaacangntgaanccccntctntactaaanatacaaanaattngccngnngtggtggcgggtgcctgtagtcccanctactctggaggcngagncaggagaatggcgtgancccgggaggnngancttgcagtgagcngagatcnnnccactgcactccancctgggcgacagagngagantccgtctc

SEQ ID NO: 253543 - DNA, 665 bp, Homo sapiens
cagctcctaacaggtctcagaatcttacttgcagtaataatctctctctctcctggtagaactaccagctgagccccagtacatgaatatactatgagtcattcctctgagacatgaacagaaaacacaggcctgtcagttcacttttctaggaaagcataaagaacatccgccaaaggtctctgagttacatgggaacagtgaatcatgtttcacttataattctggggtttcacaagggtacatgttttggttttgttcctctttcagtcagtcagctacaagcttattgtcttccagtatctttcagcatttccaagagctagacactagattcttggtaacttggtgaatctatggctaagcctaaagcctgcgggagcaaaagggaaattaatcgctgggaaacacccctttatatgttaaggcctaaggccctcgctcccagattctctgcttgctgtgcgctggtgcaaggggaggggtggaggagtgcctgagaccaatgcttgtgaacttgccctctttttccccatcacagctgaacaagagcccccagtccctccttcactgaaaggttacaattttagagacgtcttaagattaataacccacaggcctacactgagggttgcaaggaagaacttgcttttcttccaatcaga

SEQ ID NO: 253544 - DNA, 419 bp, Homo sapiens
cagccctgatgctgggctttgatggagtagggggatttccagaggaagaggaggcctggtgttttgggcagagggactgggaaattcaagggatggaggaagaggagagggcagttagcaagagggatggagaaccatgtggctgcaagggccagtgggaatgtctgaactcacccaggtcttaggaggcagggctggcaggagcctggcattctcaggctcctcttggacagaccactcaggcatagactcgggtgatagcaacccaggagtgtcatctttcatcaaaaacagggaggaggccaagcatggtaggttacgcctgtaatcccagcaatttgggaggtcaaggtgggagaattgcttgagtccagcaatgagagattagcctgagcaacatagtgagaccccgtctctac

SEQ ID NO: 253545 - DNA, 2586 bp, Homo sapiens
acagagccacagagggctgtgagcttgcccagccccaggtaacgctggcggtgggtgggcctccagcttggagcagagaccccccgaggcatctgcagacagaactggatggacccatgaatacggatttagctgctggaaagatggcttctgctgcctgctccatggaccccatcgacagctttgagctcctggatctcctgtttgaccggcaggacggcatcctgagacacgtggagctgggcgagggctggggtcacgtcaaggaccagcaggtcctgccaaaccccgactctgacgacttcctcagctccatcctgggctctggagactcactgcccagctccccactctggtcccccgaaggcagtgatagtggcatctccgaagacctcccctccgacccccaggacacccctccacgcagcggaccagccacctcccccgccggctgccatcctgcccagcctggcaaggggccctgcctctcctatcatcctggcaactcttgctccaccacaaccccagggccagtgatccaagtacctgaagcctctgtgaccatagacctggaaatgtggagcccaggaggaaggatctgtgctgagaagccggctgatccggtggacctgtccccacgatgcaatctcaccgtgaaagacctcctcctttcgggcagcagtggggacctgcaacagcatcacctgggggcctcctacctcctgcgacctggggctgggcactgtcaggagctggtgctcaccgaggatgagaagaagctgctggctaaagaaggcatcaccctgcccactcagctgcccctcactaagtacgaggagcgagtgctgaaaaaaatccgccggaaaatccggaacaagcagtcggcgcaagaaagcaggaagaagaagaaggaatatatcgatggcctggagactcggatgtcagcttgcactgctcagaatcaggagttacagaggaaagtcttgcatctcgagaagcaaaacctgtccctcttggagcaactgaagaaactccaggccattgtggtgcagtccaccagcaagtcagcccagacaggcacctgtgtcgcagtcctgttgctgtcctttgccctcatcatcctcccctccatcagcccttttggccccaacaaaaccgagagccctggggactttgcgcctgtacgagtgttctccagaactttgcacaacgatgctgcctcccgcgtggctgctgatgctgtgccaggctccgaggccccaggaccccgacccgaggctgacacaacccgagaagagtctccaggaagccccggggcagactggggcttccaggacaccgcgaacctgaccaattcgacggaggagctggacaacgccaccctggtcctgaggaatgcaacagaggggctgggccaggtcgccctgctggactgggtggcgcctgggccgagcactggctcaggacgtgcagggctggaggcggcgggagacgagctgtgagccccgccaggactatgctcccaggcccctctgcccaggggtgccttggggatgctgcactgggcagctacccacctggggatgggacgtgaggccaagaccccagcagagatgccagaatgggggaggcacagctcatagccacacacccagggcctgactgaggcccacgcaggaaccgacactcagacacaaggcaaagagggccacaggacccgggaaatacacacagagccaggagcagaagcaaagagcagacacacatacagcctgaaacagacctggacagacagacacagcctgaaacagacccggacagacagacacagcctgaaacagacccagacaaacagacagacagacacagcctgaaacagacccagacagacagacagacagcctgaaacagacccagacacagcctgaaacagatccggacagacagacagaaacagcctgaaacagacccagacagacagacagacacagcctgaaacagacccggacagacagacagacacagcctgaaacagacccggacagacagacagacacagcctgaaacagacccggacagacagacagacacagcctgaaacagacctagacagacagacacagattgaaacagacccagacaaacagacagacacagcctgaaacagacccagacacagcctgaaacagacccggacagacagacagacacagcctgaaacagacccagacagacagacagacacagcctgaaacagacccagacagacagaccgacgcagcctgaaagagacccagacagagagacaggcagacacagcctaaaacagacctggacagacaggcagacgtagtctgaaacagacctgaacagacagacagacgcacacacacaacagatgcgcagcaactccccgcccagggacccctcccggcctccctcgcacactgggaggaggaagccgccgagactgcagggagcctggccccggagccccgggtgcgccctggtctttggagcagccacggcccacaatcaccccccttttctaagactgcctgatccgaaataaagtattttgacaaa

SEQ ID NO: 253546 - DNA, 130 bp, Homo sapiens
accaatcagcactccccatgccctagccccctgttcaccaaactacctttgaacaacccctaacccatgagccttcaattgtaaccgagcagcttagcagctgtgaatccaaaatatctgagacaggact

SEQ ID NO: 253547 - DNA, 626 bp, Homo sapiens
cagaatactactgtctggtcccactgcaggaaaagaggctgatgtctttgggtcagcagctggcctgtgcatgggacttttaaaagctcctcagggctgggcacagtggctcatgccttttatctcggcactttgggaagccaaggtgggaggactgcttgaggccaggagtttgacttgagaccagcctgggcaacatagcaagaccactagctgggtgtagtggcgtgggactgtagtcctagctactcaggaggctgaggtaggaggatctcttaaacccaggagtttgaggctgaagtgaggtaggattgtgccactgcactccagcctgagtgagagtgagaccctgtctctaataaaaaagcaaacaaacaataacaacaacaaaaagaaataaaagcttctcaggaaatttactgtgtagcccaggttggaaacaactgcctagagcgctatgcaacgaacacacacctggagacaggagggcgacagcaattatgtagaaaggcttgagaaaggaaaatatatcttgggaccccaaaatcactaagccaaagggaaaagtcaagctgggaactgcttagggcaaaactgcctcccattctattcctaaaacagctact

SEQ ID NO: 253548 - DNA, 397 bp, Homo sapiens
cattctgtcatccacaggaattagtcctgtatccgaaacattctctggtagtcaaaagcttataagcacaagatgtgaaggaggccacacttaaaaaaaaacttgaaatggagtttcatttggaaggacactgactaaggaaaaacagagaaaaggatgaaacccaagccaactctgcaactctattaaaaacaccaagacttcaatataatctccttaaagggaggcagtgcattcttcatggctagagcttcagcagctatctagaaccatatggtggaagccacttactgagaactgtgaaacaagagcctcctgggtccctgacatatgaagccaccatacctaccttaaagtgtctttcacttgagggaaaaatacatctttcttaggtaag

SEQ ID NO: 253549 - DNA, 398 bp, Homo sapiens
ctttaaaaaaaccaaatgaattggttcaatagagtagatgcaattgaggagagagttagtgaaccagaagataaagcagaagaaaatatcaacaataaagcattttgaggcttttagatggaaaataaatatcagattgtgaaagacatattaaatatggtggaaaggcctaatatatgtgtaactggaggttcagcaggagaggagagagaaagtgggacataaaaaataattggaaaaaaatagctgagatagttctaaaactaacaaatcacacaaagccacagaatccagaagccctagggcaccaagcaggataagtacaaagattcaacatagtaaaatttctgataacaaagctaacgagaacaacatagggacaacatggtaacatttat

SEQ ID NO: 253550 - DNA, 360 bp, Homo sapiens
ctaaaaaagtctcctctcctctccccctaggctatcttgtgcactctcaagttttagagccattgacttaataaatatgaagttgcaaaattaacctgattgagcctagttaatttttcttaggctccatccagggaacttccaaatgaatactgcactcacacccatctcccagtgagcaggtgagaggatgagggtgacctcctgggcagggatgagggcaacttgctgaagaaaggggcagcgggagccacttgcagccaacactcagcagctttcacatgggagctcctcccacctcctggagctaatttgaaccccattttacagagccagacaaagttgttttgtgctggtgcc

SEQ ID NO: 253551 - DNA, 310 bp, Homo sapiens
gaaaagtccacttagtgaatcacagtgggatggcaaaaattttaaataatttcattagctgttattttaaaaacaatttttataataaaagagaggtttcattcaaatatgtttaaacaaaagactagtttacaacgtggtcttttagttttatatgctttaaataataaccgtatattttaaaaggtggtactttttgatagagacaagtgaagttttgaaaccaaccaaaatttttttttttttgagatggagtctcgctctgtcaccaggctggagtgcagtggtgcgatcttggctcactgcagcc

SEQ ID NO: 253552 - DNA, 396 bp, Homo sapiens
cggcaacagaagaggaaaatcccgagagagaggttagaagaagcacaggtttggaggacagactcaatctgaatctcggctctaccaccactagcagtggaatttcttggcccctcgggttctttatctgataattaaaataaaaccttccaataattaaacattgatactgtattgacatatggaaaccctcaactctttctgtcacctcccgcctctctctaagagaaacaccagtcaccttctggtccatgtctttctggatcttttcgtagatatacctacctttgcctaaaaaccaaaatagaccatactgtgcaaactgttcagcaacctatttttctccccctgtcaataatttatgacggacttattgccttggcagtacaaataaat

SEQ ID NO: 253553 - DNA, 323 bp, Homo sapiens
ctgtgctaaggccccagcctgggatctatgcttcttcccagctcctgtggtcccatgtctacttctgtccttgtgctgactacacccagctctgactgcctgggtaatatcaccatatagtaatgaaccagggaaataaattggaaaaagggaatagaaagaaatgtctcaatgggactaattatggaatataaaacacaatgactccctgtatgcactggaaaaaggcagagagaaaaagctaacaagacaggcacccctagtgaagcaaattaggttcctgattacaccgctgtggagctgaaagagaaagttctccaggg

SEQ ID NO: 253554 - DNA, 274 bp, Homo sapiens
gcaacccttcccaaggcctgtctcttcagaagcacctcgacccaccaggctccctcaccagaagccccggaccccctgcattctcttcttccctatattcctctgtctcaggtcccatcatttctttcctcaaaatgtaccttgcagcttctggagagttgggggagactgagtgagcagactggtactccccacctttcatcaaccttgaatttcctacacacatgaattactttcacaatttaaaaataaaaagtgtcacttcaacttaaaa

SEQ ID NO: 253555 - DNA, 420 bp, Homo sapiens
tacaccagttatataatttacacttattagtatacaatggggctaggataaatttcaatagaaaagctctttttttcaagatagtttattcttattttcctgtcaccttcctcacttaactgtcgggttcagcaaacaaatatatcaagataacattaaataccaataaaacaaccatagcatctgaagagaaatgttcatgttgaaatttagtttttatactaatttcatcctccactacattaaaatataatgatattaaaaatgtatttcctggggtagtggggatactctgaggggcctgctgctgtgtgggtagaggatagccatagtacagccagggaagctgcccaaggaacagaagctgaagctgtagaatgatcatgggcgagaggttttatttagaatctgctcatgttt

SEQ ID NO: 253556 - DNA, 642 bp, Homo sapiens
aaaggtttggacacctctggctccaaagtggggctggaggctagagcaggggtggtctctgtaagagtctgatctcaagggggcctcataccaacaacatcaccttctttttggagaggcagcctagtggagtggctggtagccttaggccttctggggccagggaggacagagactaaaaccaggaactggaaggagaaagatgggaagaaataggagagaagagagcctgggtttccattttgctcccgccacttggtagctctgtggctttggcaggtcacttacccttttttggttcgtaagtcacttaccctctttgtcacttaccctctttggtatcatctgtaagataggatgatgggccaggcgcggtggctcacgcctgtaatcccagcactttgtgaggctgaggcgggtggatcacgaggtcaggagttggagaccagcctggccaacatggtgaaactccatctctactaaaaatacaaaaattagctgggtgtggaggcgcgcacctgtaatcccagatactcgggaggctgaggcaggagaatcgcttgaactcaggaggcagaggttgcagtgagctgagatcatgccactacactccagcctgggtgacaggatgagactccattt

SEQ ID NO: 253557 - DNA, 439 bp, Homo sapiens
agccattggagggctttacgtagaaaaggggtttgatctgaattttaccttgagaagatcactctgagcgcatggagaatggatcgtgtggggcaagactgcagagtcattaggagactatcttagcagtctggctgatgcatggtggtaaccaggagtagggtttcagcaataaagttggtgatgagatttaggatacatttggaagtagtgccaacaggacatgtatctccagatagcacctgccatggtgcctgaagcaaatcagtgctccgtaaataagggctgaatgagggaatccagttggtttagaatgcaacagaggactgccgtgttcatgaaaggaatttgtaaaatttcctcctaatagtaattgtatttttgtcacgccctcacttaggttgaaatttctcttgaagtttatatactggtcctatag

SEQ ID NO: 253558 - DNA, 418 bp, Homo sapiens
caaattatgagcagaaagggtaagtgttgttaatattttgtttcagttatatatacatacacatctacacacacacaaatgcaggtatgtattgaaatgcaaaatatgtttactgtgtcaaaatttaagactttaggctgagcacagtggctcacacctgtaatctcagcactttgggaggccaaggttggcagatcacctgaggtcaggggttcgagaccagcctgaccaacatggtgaaacctcgtctgtattaaaaatacaaaaattagccagatgtaatggtgcacacctgtaatctcagctatttgggagcctgaggcaggagaattgcatgaacctgggagctagaggttgcagtgagccgagatcgcaccaccgccctctagactgggcgacagagcaagactctgtctta

SEQ ID NO: 253559 - DNA, 358 bp, Homo sapiens
gacgcttggaacattcacaagggctagattatatgttgggccacaaaacaagacttaacaaatttaagaagattggaatcatctccagtaccttttctgatcataataacattagaaattaataacaggaattatgaaaaatggacatatgtagacattaagcacacactcctgaacaactacttggttgaagaagaaatcaaaagagagattaggaagtatcttgaggcaaatgcaaatggatacacaacataccaaaagttacaggatgcagcaaaagcaattctaagagggaagtttagagggataaaggcctacattcggaagaaagatcttaaacaacctaatttcacacccc

SEQ ID NO: 253560 - DNA, 613 bp, Homo sapiens
  misc_feature (35)..(35): n is a, c, g, or t
  misc_feature (37)..(38): n is a, c, g, or t
  misc_feature (53)..(53): n is a, c, g, or t
ggaattcgttacgaggacagatctagtctcaacanannaaaaaaagaattaanaaactaattaggaatcaaagggattttgttattgaaattgtcaagatagaacaggaagaataaatgttattttatgccccatccctgttaacatggagtatataaacctgcaagtggccttctgtgagtgtgagtgtgagtgtgtgtctccttacctgtctcactgtcttatcatccatgtgtttactggagtagcacttctaatttctttcaagaatttttcctttgtattcaacacttagctaacgggttggcacaagcagcttagcttttggcctttacatgcctttctcactaaactcaatcatttctagcttttaatttaaagtaagaaacatgcaacttttccttttagttgaaggaaggccactgatggtttggctgtgtccccacccaaatctcatcttgaattgtagctcccataatccccacgtgtcgtgggagggacctggtgggaggtaattgaatcatgtgggcaggtctttcccgtgctgttctcttactagtgaatatgtctcatgagatctaatggttttatgaagggcagttcccctgcacac

SEQ ID NO: 253561 - DNA, 384 bp, Homo sapiens
gtagagacagggtctcactctgttgcccaggctggtctggaactgctgggctcaagcaatcctcccacctcagcttcccaaagtgcttggattacaagtgtgagccactgtgcatggccagtgttttgttttttttttttttttttttttttgagaatcttactctgtctcccaggctggatgcaaattcaggagagattgaaaataaatgtgtatgtttatttaccatgtttatctgaacctaaatatttctttcttcctctttctctctctctctcttgctttcttgagacagagtctcattcttgttgcccaggctggagtgcaatggcaggatctcaactcattgcaacctccgcctcccgggttcaagcgattctcctg

SEQ ID NO: 253562 - DNA, 419 bp, Homo sapiens
caagtaatcgggttgtgtgtcaagtgtctgtatcaacctgggatactagaaatgaaggaggggagtggtttgaaagatactgaaagcaagaatcatgggatttctgcctgtcagataggggcattttaataagtctcctaagaaaggaatgccctttgattatgatcctcaatggagaagatcagtggagagccaatccctagtttggttggttagagttttcacaagttataagtcctgagtttcagtgcacaagtcccatttcaggggttcaaattacctaatctaaataaaaagccaggcatgctcgtgcaagcctgaaggccccacctgctcatgaagctgagagaggaagattgcttgagcccaggagttggagcccaacctgggcaacaaagcgagaccccatctccaaatta

SEQ ID NO: 253563 - DNA, 443 bp, Homo sapiens
gatggcttgagcccaggagtacaagaccagcctgggtaacatagcacaaccctgtctctacaaacaatcgacaacaaaaaaattagccaggagcagtgacacgtgcctgtggtctcagctactcaggaggttgaggcaggaggatcacttgagcctggaaaatcgagggctatagtcagctatgattgtgccactccactcctgcctgagcaacagggtgagaccctgtctcaaaaaaaaaaaaaaaaaaaaaaagtgaaaaccattcttagtggcaggctgtactgggcctctgggcaatcatttgcctagttctgatttaacaaactcttgtatggagtttactatgtaataggcattgttttaagcactttacaaatattcagccatctaatcttcacaacaaccctatgaggtaggctattattctccctttatagagt

SEQ ID NO: 253564 - DNA, 386 bp, Homo sapiens
ttcttgatctgggtgctggttacctgggtagtttagtgtgtgaacagttatcaaggtgtttctcttacaacaaataactttgttctcaatgaaaagtgtgcataaggccagaaacagtggctcgcacccgtaatcccagcactttgggaggctgaggcaggaggaccacttgagcccagaaatttgagaccagcctggacaacacagagagaccctgactctacaaaaaatttaaaatttagccatgtgtggtggcacatgcctgtcgtcccagctactcgggaggctaaggcaggaggatcacttgatcccatgaggttgaggctgcagtgagccgagattgcatcactgcactccagcctgggatacagaaggaggcccgtctc

SEQ ID NO: 253565 - DNA, 673 bp, Homo sapiens
tttataagttgtgtcatgatttttagttaaaccagtattcagtatttatattattatgattttataagtattatttctagctaagctatataatatgctatgataatagttcctttgttcaatttttgttttccctggagttaataattaccttgttttcttagttttattttgtataatagacagtatttttacataccagttactgttcttttattttttttgagatggagtttcgttcgctcttgttgcccagactggagtgcaatggcgtgatctcggctcactgcaacctctgcctcccaggttcaagtgattctcctccctcagcctcctgagcataccagttactgttctaagccctttataaaatttaactcacataaaccttctaaaaactgagaggccggatgcttcattacattccagcttcactggccttctattccttccaaagtcccaccttatagcttttaaccgtgtacaaaccctgagctagacacagggtgctgattggtgtatttgcaaaccttgagttagatacagagtgccgattgttgtatttactatccctgagctagacataaaggttctccaaggccccaccagagtagctagatacagagtgtcgattggtgcattcacaaaccctgagctagacacagggtgctga

SEQ ID NO: 253566 - DNA, 289 bp, Homo sapiens
gtactcaagaccagacagacctaacagacatttaggtctgtttgcagtaagtttgcataagtttgcagtaagcatgccactgcactccaacctagtgacagggcaagactccgtccacccccccgccaaaaaaaaaggaacgtttcattcaacagccccagaatacacattcttttcaactacacatttatatagcaataaatgcctatcaaaaaggagaaaaatgtcaaataaacaattgaacatttcacctcaaagaactagaaaaacaagagcaaactaaaccaaa

SEQ ID NO: 253567 - DNA, 645 bp, Homo sapiens
caaaaataaaccctcatgtatataatcaaataattttccacacgggtaccaagaccattcaatggggaaaagatggtctcttcaaaaagtggtgttagggaaactgtatattcatatgcaaaagaatgaagttggacccttaccttatatcataggcaaaagttaactcaaaatggtccaaagacctaagtgtaagacctaaaactgtacaactcttggaagaaaacagaggaaaaaagcattaagacaatatatgtatttcttggatatgacaccaaaagcacaggcaacaaatgtaaaaatagacaaagtggactatattaaagtttaaaacttctgggcatcagaggacacaattaacagagtgaaaagacagcctacagactaggagaaaatatttgcaagtcatacatctaataaagggttaatatttccaaattatataaacaacttgtacaaattaaaaacaaaataacccaattaaaaaatatacaaaggacttgaatggtcatttctccaaagatgatatgcaaacagccaacaagcatatgcaaatatgctcaataccacaaatcatcaggaaaatgcaaatcaaaccacaacgagatatcatgtcacaccaattaggatggccactattaaaaa

SEQ ID NO: 253568 - DNA, 256 bp, Homo sapiens
caaaatctagaagtgattcacgggaaagtatttcttccaaataagagaagacagcaaagtataatggctgtactggccatatggaacctcaccaggaagctctgtgataaagttgcccttctttctaatgtgcttcagcatcattcttggaatttttatttgtttgtttgtttctgatggagattatagttttgtgacagctaggcccttgtctgttgtttcacatttttctatcttataaaatttctacacctga

SEQ ID NO: 253569 - DNA, 500 bp, Homo sapiens
gaagcacccttttggtgttgggctttgcgctaccaatagagacgatgtggaagaaaacaagctcgcttccctcatttccctcagcgtcaagtgaaacacgcaggcctgaacagaccttcggtagcagcagctgaggaagaaagcaaaggcagcatcaccactccctctctgctgctacagtcaccctgagccagggacctgcaattgttggcatctgacctccttctggccctgacggttctttgtgatttcagttctctacctcatggcccaggaaagttctgctaatcttccaggggccacctcctctgggagtctcgcctggccctcccagtatgagtgttcaaaacacacacttgggccctattataatttgtcagaggtaatgatctggccctacgcacttgggttctctaagggcagggcctggacctccttcccttcttttttggaaatctgcacaggaaatgtcagtaaaatctcacctgctattgtaaaat

SEQ ID NO: 253570 - DNA, 378 bp, Homo sapiens
gcatgagccaccttgcctggcttaattgtgtttttttattagttcaagccacaataagaagtttattcagtcagcaatctgtttttgactacttaaccacgtgccagctacaaaaaaataacatatagcttcaaaagcctcttaagcggctgggcacagtggctcacgcctgtaatgccagcactttggaaggccaagactggcagatcacttgaggttaggagtttgagaccagcctggccaacatgacaaaaccccatctctattaaaaatataaaaattagccagacttggtggcaggcacctgtaatcccagctacttgagaggctgtggcaggaggatcacttgagcccaggagccagaggttgcaatgaacc

SEQ ID NO: 253571 - DNA, 213 bp, Homo sapiens
ttagatagtaatggttaggtcatttagaatttgaataaattgctgaaatggtatgaaatcactaaaaagaaatgaagtcagaagaattactagacttcacataaaagagtactgaattaggtcacagaaaaatcagagctggtaacactggcaggaactaggatttctaggttccaggaatggcaggctgagttattcagaccaaattgccca

SEQ ID NO: 253572 - DNA, 287 bp, Homo sapiens
gagacggagccttgctctgtcgcccaggttggagtgcagtggcacgatcttggctcactgcaacctctgcctctcgggttcaagcaattctcatgcctcagcctcctgagtagctgggattacaggtgcccgccactgcatccagctaatttttgtatctttagtagagacagggttttaccatgttggccaggctgtaccagctttttatgggtggtaaaggtgggggctagaacagtcttcttttagttaaatcctaattcaccccttctttcaaagttttactt

SEQ ID NO: 253573 - DNA, 450 bp, Homo sapiens
tgttgttttcttttttccctcttttgcagctgcaaggaatttgggccaaattagagaggctttgttacccataatttggaattctcactcagatcggaccaagtcaggtagagttggtcaaatctgatgggagaaagaccggaataaacaacaataacaaaaaacccccaacatgatcaccgagcgctctaacggtaaagagaaattaagaccagctggtagttaaactttaaccaagacaaaaccccaattcagctacttacctaggaatgggtctcaggctgaagactgctttctaccatcctagaagcaggaaaaaaaccctcaaactcatcttccttgctgggagtgagctcaaactctataaggcagttacctgccttccattgtcatggaaacaggaaatcctaccttccttgttggaagcaaggaaaactccaaaaaaaaaaa

SEQ ID NO: 253574 - DNA, 391 bp, Homo sapiens
atagctaaatatcctagtgtgagttaaggttgattaagtgatcatctttaactctgcttttcccagggctctttgaactcttgttttattaggtaatatgctatgctgttattttattgctgtttaaaaaaccttctcttttgggaaagaaaacatgtgaattctttggtttctagatagaaattagcaatcttttgctcggaatgtaaaagtatgctgtattatcacaaactgaccctcctcctcccccagaattctagggagtaaaatgcgtgcacaggaaatcagaaatggatcaacagagttataggttttaaaaaaactgccttgcatttttgccctggaattaattttcagtgaaaattaaaatattttttctgttcatctggaa

SEQ ID NO: 253575 - DNA, 477 bp, Homo sapiens
cagtgggctgagattgcgccactgcactccaggctgggtgacaagagtgagactctgtctcaaaaataaaaaataaaaaataaaaaacaaacaaacaaaaaacacctcatatatgacagctactctatgctatctctgaaccacatagcaaccctgaacattctacggagggggaaactaggactcagtgattaagtaaagggcccaatatcctgggccctataagtagcagagctgggactcaaacccatgctgtcagattccagatcccatgcacctcactgctgtgccatgctgcctctcttctgtggacagagataaagtagccaggcatggtagtgcatgcctgtaatcctagctactcgggatgctgaggtgggagaatcacctgagcccaggaggtggaggttgcagagagccgagactgggccactgcactccagcctgggcaacagagtgagaccctgtcttaaaaaa

SEQ ID NO: 253576 - DNA, 342 bp, Homo sapiens
ctgtagtccagctactcgggaggctgaggcaggagagtggcatgaacccgggaggcggagcttgcagtgagctgagatcgcgccactgcactccagcctgagcgacagagtgaaactccgtctcaaaaataaataaataaataaataaataaaatatagtttataaaaaaggaactactggaaataatataaatcataagtaatctctagccacaaatagctagaaagtgtaatttttacaaaggtaccatttaccataaaaacaaaacaaacctttaaatacaaaagatttatatgtcacagaaaatataaggtacttagaaataaattgatttaaatatt

SEQ ID NO: 253577 - DNA, 311 bp, Homo sapiens
actcactgtccaggagaagaatgtcccagggtcaactgatcagttagggtagggcaggaaccagtcatagtggtggaaggtcatatggagggtcaatcggtgaaggcaggaactggggtttcacttcttctgtggtttttcggctgctccagatttcgtggctcctgcagaccatctggacatatgtgtgcaggtcacaggggttataaaaaatctgagctttggctcagaggcctgacagaactcacacacacacacacacacacacacacacaccatattcatacacatgtgggcaagtgtatgtatgc

SEQ ID NO: 253578 - DNA, 792 bp, Homo sapiens
gaagatgacttaagtaagtaaaaaattgaaggaggtaagggagttagtaatgtagatacattgggaaatggcattccaagaagcaggaaagtaaggccttgagatgggagcttgctttgcatatttcagaaatatccaggtacatgttactagagtgaacaacaggagaatatatgggagatgcctttggagagataatgggggctaaattatatgacatcttagaagcttttactcccaattagactttttactctaattctgggctagagtttttactcccagtgaaatgataagtgattagtgattttgagcaatgatttggcaaatctgacttacattttgagagacttgttctaactagaacgtggaaaacaaattgttggaacatcaagattggaagcagaccagttaggaagttatagccatgattcaggtgagaaacatggtagttgagaccaagatggtagtgctagaggtggtgagaagtggtcacattctgtatatactttaaagatagagcggacacattttcctggtgaatacgatggggtgagtgtgaaggagtagaaagaaagaaaaaaaaagagagaagaaaaacaaacaaagcagtcatgtattcctcccccaagttttgacctgagaatataatggatttgacctcacatacagtgggaacagtgaaggtggcacaggtttgcagagaattcaggagtttacttctgagcatagtcaagtttcaggtgttagctaaatctctaaattgagaaatggaataaactagctggctat

SEQ ID NO: 253579 - DNA, 243 bp, Homo sapiens
ttgtacctctgccctcagtgctcaccgtgagacctggactacgccactcttccttgttcaccaaggacatggcctctggcttatcccagcctcctctccaacccctcttccttgactctctcagtcgtctccgtgtcctcaggaagaactagaattccagtcccgcgcctcttgaactccatctcctttgctctgcccaacagctgcccccaccccacgatcacaccctgagcctttgtatca

SEQ ID NO: 253580 - DNA, 439 bp, Homo sapiens
caaatttaaaaaaaaaagaaaggccacttgacatttgattcctcttctcaaaaactgatacataggtcagtcatggtggcttacacctataatcccagcacttttggaggcagtggtggcagtatcacttgagcctaggaggttgggtctgcagtgagctgtgattgcgctactgcactccagccacagagggagactggtcgcaaaaaactgatacatgaaatgcataaaatattttcttgtttcttataatgcttttcatttggttccttttctcacatactagaaatgctgatttttatatgcatatagttagctgaggaaatgtctggttttcttggataatactatttcctattctcttgagttgttacacccacgttgtgttgactgttatctgatttaatcttatcctgcaagcattttttttcacaattgt

SEQ ID NO: 253581 - DNA, 1014 bp, Homo sapiens
gttggggagcacgagggggtggctcgaggcgggacggaggggcaggaagaaatagcaggaagacccaggggcaggaggccggtgttcaagcgtcgaggaacgtttcatcccttctgaatcccaggcctcgctggaccacggacccgccaggttctcccgcaacttgcggacgtcctggaccggcccttcccagaggcgcacggctgagtcccaggagcaggacctgaaccaggaaggggaggggcgagcacagtcctgcctcctcctccccgcacagtgctgggggaatgacccccactgccttcttctcctcccccaacactgcagggggaatgacccccactgcctcctcctcccaacacactgcagggggaatgacccccactgtcttctcctcccaacacactgcagggggaatgacccccactgtcttctcctcccaacacactgcagggggaatgacccccactgcctcctcctcccaacacactgcagggggaatgacccccactgtcttctcctccccccacactgcagggggaatgacccccactgtcttctcctccccccacactgcagggggaatgacccccactgtcttctcctccccacacactgcagggggaatgacccccactgcctcctcctcccaacacactgcaggggtaatgacccccactgcctcctcctccccacacactgcagggggaatgacccccactgccttctcctcccccaacactgcagggggaatgacccccactgcctcctgctccccacacacacactgcaggggagtgacccccatattttaatgcagtggtttctctggtcactcacggtccagcactagcacgcagcagtcggggaaatgctgtgggtatgagacggcctggattttgaaggcgctgcatgaaaaagaatgtagagaatctgaatgcattttatgtatagattgcatgttgaaatgatgctgttgggatatattaggcaaaataaaatatatcacaattt

SEQ ID NO: 253582 - DNA, 368 bp, Homo sapiens
caaaaaaaaactataggccaataaccctgatgaacacacatagatgcaaatatcctccacaaaatactagcaaactgaatctaacagcacatcaaaaagataacgcagggcaggcatggtggctcactcctctaatcccagcacttagggaggccaagacaagtggatcacttgagttcgggagttcgagatcagcctggccaacatggtgaaaccctgtctctactagaaatacaaaaattagctgggcatggtggcaggcacttgtgatcccagctactcgggtggctgaggcaggagaatggcttgaacctgggaggtggatgttgcagtgggccgagattgcaccactgcactccaccctgggc

SEQ ID NO: 253583 - DNA, 1101 bp, Homo sapiens
tcagattgattatatagaaaagctactagaactgggaaatgagtttagtaagatgcaggatactacatcaatatgcaaaatgtatttctctatatacactcagaaattgaaatatatctcttacaatatcataaaaatataaaacacttagtgataacgtgtgacaaaagttgtaaaaaacctgtgaaactggaaagctacagatcattaatgaaataaattagagaaaaataagtaaatggaaatataaaatacattcatgtgccattcatagtattgttgtcaattcttcagaaaattgatctatagttttagggcaatcccaataaaaaaccaaggaggcatatttgtagaaattgatagactaattttaaaattcacatggaaatgcaaaggacttcaaaataaccaaaaaatgtttaaaaagaagaaaaaaggtggaggactaacaccacttaaggtttattataaaccttcaagagcatagctgtgtggtgttggcataaatataggcaaatagaataatggaacaaaatagagagtccagaaaccgacaactgcccccccaacacatatatagatacatgatttttgacaaaagcgcaaaggcaattaagtgaaaaagggatattcttcaagaaacagtgagtgctggaacaattggatatccacctgcaaaaatataaaccttacctcacctaatacagaaagattcaaaatggaccatagacttgaatgtaaaacctaaaactactaataaagtagttttatatgtaaaccttccatcttttagaagaacacataagatcaaaacttagcgcacttgggtttgagcaggcaaatatttcttatgacaacaaaagcacaatccataaaagagcaaattgctaaattgaacagcatcaaattaaaaacttctgtatttaagaaagaataaaaaggaatgtaacagactgggataatgttttggaaataaagtatctgatgaaggatttatatccaaaatatgaaaagaacctcaaaattcaaaaagaacaactaaaaaaattggcaaatgtttaaacagacatttcaccaaagaggatatatgaaaagcaaata

SEQ ID NO: 253584 - DNA, 752 bp, Homo sapiens
tgggaagggagcagccaggggcagacgaaaccctcaatagagtcaacgagggaagagaaggaacggtggatccgttccaaatatgagcataagctctttctggccccactaccctgcactgagctgtccctgggccagcacctgctgcgggccaccgctgatgaggacctgcggacagccatcctgctgctggcacatggctcccgtgaggaggtgaacgagacctgtggggagggagacggctgcacggcgctccatctggcctgccgcaaggggaatgtggtcctggcgcagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgtaaaaacaaaatgggaaaaataaggataactcagaatttcaaaaggaaatcacaaattcagctaataatagcattttcagtacttttcgtaaactaagtaaatacacaaaatgttgatttttctgaccataagacatattttatgtccttttgccgaggtgggtgtgttagtctcaggccctcctggccacattgcccaagtcacacaggcttctgtattatgtatttagataagatgtgtgaaaatatatttgaaaaaaagttcataaatatgcattgatttttgt

SEQ ID NO: 253585 - DNA, 251 bp, Homo sapiens
cactccctcgagcacaccttcatctctcttcccccatagcactctcctggtttacacgcccttctgcatgcttcactcctggacataaacagctgaatgggatttttttttaaatgcacaaccctgatgacttatccccttttaagtgtaggacccccaaatctcaggtagccaacagcaatgccaggcaattatcctacatgttcacagtccatgttgctccattatcactattgcataccttatcctgt

SEQ ID NO: 253586 - DNA, 516 bp, Homo sapiens
gaagcatttccttccacttttacaaatgtgtctgtatgtacatctaagtaaataaataatacacattttcatatttatggaaactgaaatgcatagttttatatctgcttttttccacttagcattatattgggagcaattttccagattattaaatattcctggaaaatgtcatttttacagctgcattctattatatggatgtataatagtcacttctctagagctggacacgtaggctatttctagtgtttttctggcgtaaatgttgatgtaataaacttgcttatatgtctttttgtgcatgtttaacatccttcttaggatagatgctataagtagaatcactgggtcaaaaattttaagaattttaagaatcttgatttttatggttaaattctgtaccattcctaatgagttatatgaattccaagttctttatgtataggtgcaaataacttacctgttttttttttttttttttttttgtgcctacatttaattttggtaattaaa

SEQ ID NO: 253587 - DNA, 487 bp, Homo sapiens
tcaaatgaacttttactttgggaaattttgttgaatttctatttttgaaaaaaagcagtgtaccaaggagggtaaatgtatatagcctccggagtcagactgcctgagttcaaatcccagctctccatttattaggcttgcaaccaagaacaagttacttaaactttcctgtgatccagtttcctcatctataaacggagataatacttatctaacaggattttgataagagttaaatagactaatacatgaacacggtgcttagtcaatgcttagtaaatattacctaaatatagattattttaaaatataaaattaaagcaaatacttatattaatataacctaatagtctaaaggaagtaaatctttgcctcccatctctattgataatatttctttgaggaagatctcttaatgggtatgaaagaggtgaattgtgttattttgtgctatgaaaatggataaattcttaatagaaactatatt

SEQ ID NO: 253588 - DNA, 424 bp, Homo sapiens
gaatgagaaagttctttcttgttaatttttataccaatcatatggcattcattatgcaactgatggtgtgtatgctatcgagggccagacactgttgatctatttgtgactctaaccctgaccccattgccctgggcaatgtaaggttgatgtattaaaacatgtataacagcaatatgtgaaaattttgtggttagaagattctgggaatgtagtggcagtggcagcataatttttcaaactacctagtcctcccataaaagcagaacaactaggtcacaaaaccaaaaacccacagacaacatttacaacaaaacttagtgacaaaggtagtcctgagagccccaagacacaaattaatgggaaaataaaacactgatcgctgcagggtgatatcagcatctgtgtgagagaaagcagaggg

SEQ ID NO: 253589 - DNA, 307 bp, Homo sapiens
tctctctctcagattgcctgctcctgcagagggctgctgccatgtcatgagcactctcaagcagctctagcgaggggtcatgtcatgaggaactgagaccttctgccaatagctgtgtgaatgagccatcatggaggcaggtcctccagccccagtcaagccttcagatgatggcagccccagctgatgatttgactgcaaactctcatgcaaccaggaataagaaccactcagcagaaccactcccaatttcctgacccacagaaactgtgagataaataaatattgctttaagctgctgtgctta

SEQ ID NO: 253590 - DNA, 185 bp, Homo sapiens
ctccagtgtgttttgataaatgtttatatccattcaaaatatagaaaagttccgttactacagaaatttcctttgtgtccctgtcagtcaccatgcaaaaaatcataccgctgttgcgatttctatgaccatgtatttgtttggctgttcttgaactttatatataaatgaagtcatacacagta

SEQ ID NO: 253591 - DNA, 413 bp, Homo sapiens
atttcatttggtaagagggaatacaggataatgcagaaattataggatatggcaaggatataacagcacaaaacactaagaagatgtggttgtctcataatcatgaagatcagaataacgaggctacttaacattgtttcaccaatttctagtgcagtgtacagtaaatttttacaagggggaagaatgaacagacccattttactgaaatatttcatacatatacgaaattgaaagataaatgagacacaatacagttataaggaagatgggaagatgagattgataagttcctagataaataaatattgttgactgaacctatagaattaatacaggattaattaagtattaatatctattagaaatttttgcagagataacttaagcctcaaaaaaggttggaaatatgt

SEQ ID NO: 253592 - DNA, 571 bp, Homo sapiens
tgcaagaattctgaaatttgatttggttgctagtggaatgagtctgaccattaatctctgaactatgacccttttcatacgttaggatttgacgtcaacccgaaaatgggaggattagccacatttttgaattctagaagtttggctagttcataagcgctatccaagtgcttttggtgaggactaacctctaatttttttaatcttgcccaaattcctatctaagaggtctggggagtcatgccctacaaatcataaattctcatcagatgggttttattcaaccctatatatcatgatttactttccaacctgactctggcataacattaggagacaaagaagaaaatcaaaatattttacccccaaaacatgtttcttgtcatattttgaaatggccctgcaaagctgttctttgtggggggaaatttgcatctgtaaagaatctctattaatatagctagatctttttcttccagaccctcccaatcctaaagagattaactaaaatctgaatagaaaacatttgtcacctattgtctctaaatgcagccactataagacttcaaaa

SEQ ID NO: 253593 - DNA, 392 bp, Homo sapiens
actcaaaacaaagcaaacatccaccacagttaaatcaaatccttatttctttgtgacttctccttttactatttatggtggttcacacacatggtctgggaggtgtaaacatcttaccatatctcccatcatacatagttaagctttcttggactcagtcatcatatttatccaaaaattattgactttcaccactagtattgcaagcagccctaaaattacaactacagctctgtatggtgacaaggagcatgcactttcccactgtctccacatcaacaagtgagaaacacctggatcaaaattggcataaacaatcaacatgacactgggttttggagtgtaatatggacctgatttacttccagctgggaaataaatcttttgccaaa

SEQ ID NO: 253594 - DNA, 151 bp, Homo sapiens
gttatacattttgtgataatttgttaagctgtatgtttattttctgtgtactttttagaaggtacgttatacataaataatatttcaatgattaaaacattttctctaaagcatgtgaccttttgaaaataaaaacactacaattcaaata

SEQ ID NO: 253595 - DNA, 265 bp, Homo sapiens
aagctgggaaaaatattttagtgagcacattgctgccttaacaaatttggactctctgtgaggagtaagagagaatggacactgggtaggcaaaatagcagtctctgccacaccaattaaatattaatagctatgttaagttcaaaacagactggggtgcagtagctcatgcctgtaatccctgagctttgggaggctgagacaggagaattgcttgagcccagttcaagaccagcttgggcaacctagggacacccctaggtta

SEQ ID NO: 253596 - DNA, 612 bp, Homo sapiens
agcaggactcccagcccctcagaatggtgaacgtggttctgaattgtgagcgaaaggatggctggatacttaaatttttggaatgtcatatgattagaagcagcgtttggcagattgtgtgaacttgggtgttttcattaaaggcttctgctcttggattttaacatgaagagctttagagtgaagaatggatgtgtgtgtttgtgtgtgtgtgtgtatagaaactaatctgtgaaaaccttgaacatgttcattgccatggcctcccagttaattgaactttctggctaaactatgctgaaataatacactggatggaaaacttaaacctgtctattcatctacaggcatctgagcataagcagtaaaaggatcctaaaagtgtgattgagtcagtgatgcctaattggcagtcaagaagcccaagtgcccgggtgggttgggttaaaacaaaggcaatgtttgaatgttatgaatccattgtttaaccagcctttcgactgagcttttctgtcgcagtcctgagccttgatgctttaagagccatctaccagccactgagtttgcactggtgtttctcatcactttgcatgtccacctgactattgacta

SEQ ID NO: 253597 - DNA, 503 bp, Homo sapiens
ttcatctttttactgcttggtctgctagggtttacatttcaccctctcccatcttgtaatggcttggataccgggtgaaccagcctaaaggagcacccactggtagggacacagtagctgtgcatagaattgtgaattacaagcattgcactaatagatgggagcaacttggggtatagctgaaagttcttactcccgggtattttgtacaagaccaggaaggctccatccagacacaggcactctttaaagatgtattttttgaactagtgatttgccttgaatttagcacaggtgcaggtcaagagtgagcaggatttttggtgtgtgtaaataggtcatgataattaacccaaattacatattgtgttgtaactcagacgttgttaattattagctagagattttcacatatagtaggtcagtactctgggcaggaaataaatgaggcagtagtaaacttaaaatctttatttaataaactttacattttcttaacatgg

SEQ ID NO: 253598 - DNA, 306 bp, Homo sapiens
ttcccagatttttgaagacaaaaaatgctggctagaaacaactccttagtgactgaatttattcttgctggattaacagatcgtccagagttctggcaacccttctttttcctgttcctagtgatctacattgtcaccatggtaggcaaccttggcttgatcactcttttcggtctaaattctcacctccacacaccaatgtactatttcctcttcaatctctccttcattgatctctgttactcctctgttttcactcccaaaatgctaatgaactttgtgtcaaaaaagaatattatctccaat

SEQ ID NO: 253599 - DNA, 472 bp, Homo sapiens
cttgatgattctgaagtcaacaagatagaatcagcagaattactgtcctccataatactactttaaacatttgagaaagcattattatgagataataattattatttgtaataataatacaaatattatttgtatgagttattatttataataataatattgagaaagaaaattgtatcttttaaagactatcagttaacttttgacttgtcagaataacttattgccagagttccaaattaatatggctttgtgattgaagtatactaagactcagaaaaggaatctggtttaggcactaaaaatatattagacaaaataacagtgataaattaaaagctaggcaggctgggcatggtgtctcatccctgtaatcccagcgctttgggaggccaagatgggaggattgcttgaggtcaggagttttaagaccagcccaggcaacgtagtgagagaccctgtctctacaaaa

SEQ ID NO: 253600 - DNA, 456 bp, Homo sapiens
cggggcggtggttcacgcctgtaatcccagcactttgggaggccgaggcaagtggatcacctgaggttaggagctcagcctggccaacatggtgaaaccccatctctactaaaagtacaaaaaattagccgggtgtggtggcacatgcctgtaatctcagcctccctggcccatgtttattccagtggctcttgccctctctctcccacagttgccaatcccaaatgaagatatctctcaggggcagcaagaacccccattctaagcactttaacctcttttcttaggatagccagataaaatacagtaacactcagttaccagcctggacaacacggcgaaaccccatctgtaccaaaaatttttaaaaaagcaacaagtagctgggaatggtggcttgcacctgtagtcctacctacttgggaggctgaggtgggaggatcacctgaccccagg

SEQ ID NO: 253601 - DNA, 303 bp, Homo sapiens
ggagtgcagtggtgcgatgcaccatctcggctctcggcacgctgcaaccttcgcaacctccgcctcccgggttcagtcgattctcttgactcagcctcctgcgattggactacaggcatgcaccaccatacccggctaattttagtagagacgggggtttcaccatgttgggcaggcttgtctcgaacgcctgacctcgtgactcctgacctggtgatccgcctgcctcggcctcacgaagtgttgggattacaggcgtgagccactgtgccaggccaagagtagtaatcttttaaccgctat

SEQ ID NO: 253602 - DNA, 416 bp, Homo sapiens
tgtgagtgacagaatgagactgtctccaaaaaaaaaaaaaaaagtgttttctcttctgctgtaaacttaaaactgctctaaaaaataaagtctatttttttttaaagtgttttctgccatgttaactgaaagttacctcaagggtcaaaagtaaaatctaaggtaattttaaacttcaagtaccaagttgcacttcccttttctcaatgaaaatattttttagacagaataaaaaaccttcagaatgagatgaggaaataaccttagttttaaaaagtacatttagacctggcgcagtggctcacgcctgtaatcctagcattttgggaggccgaggcaggtggatcacttgaggtcaggagtttgagaccagcctggctaacatggcaaaaccctgtctccactaaaaatacaaa

SEQ ID NO: 253603 - DNA, 360 bp, Homo sapiens
ctttatgaatctttcacatttaagtctaagcattaacagccaatttattcagatttatttgcattccaggatagtaaagagatttctccttctcccgaagagattttcaatgcagagtaattaaactattgtgtctctctggaggggaggatgagtgtgggccatcagaagcccctgtataagatcagggacttcctcatcttgggactcctggctggaaacccatctcactacctatgcaggtgacccctggctgtcctcctgtcatcctgtgggaattgaggtttgggcagcttgtgcaaacaaagatgttactctgctcctctgttgctatgagtaataaactctttgtctctgact

SEQ ID NO: 253604 - DNA, 160 bp, Homo sapiens
  misc_feature (18)..(18): n is a, c, g, or t
ggtgctgggcggcatttnaggagagggctgtagatcataagaaactgaggttttgtgtcattaatttggatttagaagtgattgggaaaacgtccttctctgttggttgtactgccttctgatgctgctaaagccaataattaataacatttttcctgag

SEQ ID NO: 253605 - DNA, 435 bp, Homo sapiens
gcgccgggcaaacgtgtgcattaaatgcttgtttatgcctttgtaaaataagagtgttggcaatataaaatgttacccatagagtaaattaatgtgtttttcaagttggaagatggctttaaaaattcatagaagtacaattagtccctttatttaggtgctgaatagtttccaaagccccgtgtctcttatttatcagagtttctattatataacattgtcacccagtgaacaggctatgctaggacattggaaaaaggtaaatattgagaaagccctaatggtcctttcttaaatggccccctctttccatatttaatttctaagtgacattcctaattaagggtaaacaaacataatgaaacaaggctaattttccaataccaaactaaaaaaataaaaaacagtggactggctattactttgttgatgagt

SEQ ID NO: 253606 - DNA, 679 bp, Homo sapiens
gcctgaagtgaatgagaagctggcagtatttagcatagatgtatttcaaagaaggaaatccataaagccataattagcccctgagctggaagccagatgaaattcctttaaaacagagataaggaactaattatcctactttcatctcaggcaaaacaccaagaaatagggtgaagagcaataagaaaaattaattagaggcaaagtaaatatggaaaagggagatcgatgcaaaaaggagggagctcttctcttgagggccaggaaaagcctgccgcccatttcccaaatttcctcctcttttacagactcaacaacatgacttagaaaggcttgtgtggtttgtgcattctagggtggtcttcacggaagtctgtaccctggctgttcaaaatgcatttagaaaaaaaccaaaaaccactaaacagagtccgggatctcacgtgtgacaacttggggagaccctgtctgcacagttttataatgcaggccttctcagagcctttattgtgagctgacaattgatgtgcaagaggagcatagggaatgcaatatttcccaagcatctgaaaatgaaacccatttttcaaagattgtgttgtaggactagagtttcaagagctctgctttgggtcatggtgttctaaagtaaaataaatgcaagggaaataaatccata

SEQ ID NO: 253607 - DNA, 542 bp, Homo sapiens
cctctgtgaccccgaaactgagcacagccaccaccgcgacctttaagatactcacgtttcccacgtggccctgtgaaagagccgagtcggccccacggggccttggggggcacagctagcctccttgccctcttcctttttgtgacattgttatgcaaaactttggccatcttacgatttcgtgaaaatattttaataacgtgcatttcacattcgaaaagcagggtgatcattattagtaggatctggggtagcccacaacagggaaagtctcgaatatcaagtgacaactgtgatcgcatcagtttgatatgacagaaaattggtttctggaaatagtgttaatggtgacgcttagtttgggtttaaggaactaagaaaacactgagaagaacaatgaacaccagtcaaaaggctggatgtgagtctttgctgtgacacccctgtatgaccttggatagtgacttattatgttgaaatagctgtttcttcatatgcaaaattaaggccatgatacctcctctcagagttattatggggat

SEQ ID NO: 253608 - DNA, 413 bp, Homo sapiens
atagatagagagacagataaaacagtgtggagagccagacataaacccaagtatgcagggaaatttagtttgtgatgaagaggacatttcaaattagtgggagaaaaggagattatttaataaatggtgttatgtttagacaaatggtagccatctaacacagagtttagatctcttcttcattccttatgccaaaataaattccagatggagccaagatttaaattttttaaaaaatccataaaagtattaaaagaaaacatgggagatcttatttaaataatatccaaatggaggaagaactttgccttcttaaacgtgatacaaactttagaatccatataagaaaagaaaattgctaacaatcaatattatgatgtcataaaattaaaattttctgcattccaaaaatt

SEQ ID NO: 253609 - DNA, 432 bp, Homo sapiens
ttttttagacagagtctcactctgttgccaggctggagtgcagtggcacaatctcggctcactgcaacctctgcctccctggttcaagtgattctcctgcctcagcctcccgagtagctgggactacaggcttgcaccaccacgcccagctaatgtttgtatttttagtagagacagggtttcaccatgttggccaggatggtcttgatctcctaacctcgtgatccgcccgcctcagcctcccaaagtgctgtgattacaggcgtaagccaccacgcccagcctatccatgacatatttttttaagtaggataaggaagtgaatatacagagcaagtgaacactctcatacatcgctagtgaaagcaatgctacagccactttggaagttacttgtaaagtaaaacatacacctaccttatgacccaattc

SEQ ID NO: 253610 - DNA, 108 bp, Homo sapiens
cttgatcgggagtttgctttcttatacacggaatcccatatttaaaaaccactgttcttaactacggttatggaatcctgaagaggggcagcggtgagaaaagaaaat

SEQ ID NO: 253611 - DNA, 317 bp, Homo sapiens
gctgatgaatggagtcaagtcaaaaatagctttagcactttaagaaaatcattgtgagtaaaccaatggtatgtgctaaaactccttattcttcactccattgtaggcaacctacatgtaagtgtgtcttttccttgtacataagctaggctgcttgaggttcaagaaactgaaatttggagagaccaaagtggaacagcatttgcccatagtgaaaaaaagaggcatttttgaagtttgtatgtatgtatgtatgtatgtacgtatgtatttagttatttatttagttatttatgagatggagtctcgctctgtgg

SEQ ID NO: 253612 - DNA, 662 bp, Homo sapiens
gtacagtaagtacttaagaaataatttattttgaaatagtttcaaacttcttgagaatttacaagtgtagtacaagtaatttccttagccatatttccaaactgttattatttactccatcaccctgtctgtatgatgtacattcattatcattggtctttttctgaaccatttgagaacaacctacagacatgatgtcccatcactcctgtgtactcagtgtgtttcccagaattaaggacactctcctatacaactattactcgatcctcttagtcagaaaatcagcattgatacactgccatccagtttgcattccctgttttagatattttgctttctgtatttcaaagtagcgtgcttttatttttaaaggtttatgtgtttatctataattaaaattactccaacagagcagcccattgctgtgttctaattcttagccctgaagtcctacaaaaataaacccaagcttttacagtaactgtcaatacagaactaaagcgttttagctattaaaaggggtttagttaccaaggtgcttattttcagcaaaacgccctgttactcagaagaacatacgcatatactaaagttctgacccatcgattcatgcaacagtttatatctctgccctccctccatctacctttaaaacaaaa

SEQ ID NO: 253613 - DNA, 2008 bp, Homo sapiens
caaagactcacccgtgagccagctctcaaagaaagcagcttgcgttgacagcctgggggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctggggccacttgcccccacagccgaattccctggactcaggactgctttgccttccttgcccttcctcccactgtcccctggccagtcttagtggctctcaggccctgctctggcctggctgcccactactgtatggcttggaatgaggcaggagtgggaaggagatggcatagagaagatctaataccatcctgcccattgtccttaccgtcctgcccatacagactgtggctccttcctccttcctgtgattgctccctcctgtgtggacgttgcctggccctgcctcgatgcctctctggcgcatcacctgattggaggggctggtaaagcaacacccacccacttctcacactggccttaagaggcctccactcagcagtaataaaagctgtttttattagcagtagttctgttgtccatcatgttttccctatgagcacccctatgcccactctaatattcaacaattatagacaatttgccctatcatttatttacatctatgtatctaccatctaatctatgcatgtatgtaggcaatacatgtatctaaacaatgtatttgtcaatgcatcaatttacctactctatgtatgcatctatatgtgtattatgtatgtatgtgtgcatgcgtgcgcgcacacacacacacacacattgatattatatcatggcattttattcctaaatcttccagcatgcatccccaaaaaacaagaaacttgtcttacataatcacaataatatatccacatctaagaaaatttactgtaacttcttaatctaagaaaattatgtatttttgtcatatgtattttgtcatatgtattttgtatttgcatatgtattttgtatttgcatatgtatttttgtcatagcagcaaacagagtgaaatgccatttttcatattct

SEQ ID NO: 253614 - DNA, 1787 bp, Homo sapiens
caaagactcacccgtgagccagctctcaaagaaagcagcttgcgttgacagcctgggggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctgggactgtggctccttcctccttcctgtgattgctccctcctgtgtggacgttgcctggccctgcctcgatgcctctctggcgcatcacctgattggaggggctggtaaagcaacacccacccacttctcacactggccttaagaggcctccactcagcagtaataaaagctgtttttattagcagtagttctgttgtccatcatgttttccctatgagcacccctatgcccactctaatattcaacaattatagacaatttgccctatcatttatttacatctatgtatctaccatctaatctatgcatgtatgtaggcaatacatgtatctaaacaatgtatttgtcaatgcatcaatttacctactctatgtatgcatctatatgtgtattatgtatgtatgtgtgcatgcgtgcgcgcacacacacacacacacattgatattatatcatggcattttattcctaaatcttccagcatgcatccccaaaaaacaagaaacttgtcttacataatcacaataatatatccacatctaagaaaatttactgtaacttcttaatctaagaaaattatgtatttttgtcatatgtattttgtcatatgtattttgtatttgcatatgtattttgtatttgcatatgtatttttgtcatagcagcaaacagagtgaaatgccatttttcatattct

SEQ ID NO: 253615 - DNA, 1044 bp, Homo sapiens
cgcacctgggatgctgggcgggtctagcctatgggaggtgagtgaggctgagatatttaccccccgaccttggctttcctccttccctccctggctcctctgcaagaggccccagctgttgtcctgggaccttctgctttgacacttttttttttgtttttttttgagatggagtctcgttctgtctcccaggctggagtgtagtggcatgatctcggctcactgcaacctctgccttcaggttcaagcgatcctcaacctcccgaatagctgagattacaggcatctgccaccataccaggctaattttttgtatttttagtagagacagagtttcgccatgttggctaggctggtctcaaacttctgacctcaggtgatctgcccgcctcagcctcccaaactgctgggattacaggcatgagccacctcgcctggccctgacatttcaactatttttgggctccagaaacaggccgtgcctgaggtggtcgcaactcgaggccgtcaccagctgcaggcacttcaccaccctgtctgatgttgcccaaactctgccctcatacccaaaggcagctccttcgtcaagtctccctgggtccccatggagcggaccacgcttcctggaggacggggacactggaaactgctgtcttcttccaccagctcagacttggtctctggaacctactgcgccactccctgcctcacttcccatgaaccagaaggtggctcctgcccgctggccagaaacagagacctttcacaaagaccaggctctcctcctctccacggatgaagacagctttcccagctggggtgcagccctgcactggcaaatttggcagcacagccctctcagggtcactggggaggtgagcccagtgcaatgactcacaaatgatggggtggcctctcggcctggcctgggaggtccatgagtcctgggtggacagtgatatgcccttttgctgtggttttatagatgggaaaagttctctggctgtgcctcagacctgaagccccacatggttagttatagaa

SEQ ID NO: 253616 - DNA, 877 bp, Homo sapiens
aaccaatctgcatctagcacaggagctttacaaaagaaagccagtaagatcagctcttttttaaggagcctcagggccactcctggttcaaaaacaagggtcacatcacatgacagagaggtagatatcgtggctaagatggtggagaagcaaaacatagaggccaaagtggagaaagcccagggtggccaggagctggagatgatcagtggcactatgacatccgagaagacggagatgatcgtctttgaaaccaaatccatttaaagaggagccagggctacaaccgcccagggatctggaagtatccctagaggagcccatcccagctttctttactgcagttcaaataataaaggaaatcgtacaactccaaaagaaatacaatctcctgcttgaatttttctgcccatagcctggtggtgacctcacagtggcttctgtgatggtggctatgctacagctggagaccccagcctccaggcaagtagagctccaccacccgcccacggccagcagagccaacgtgagtgttcagctttgcctcaatcccttttgcttccccgagactgtcaaagccacagactaagagctgggatgcatggccaccaccatgtcccctcgcccattctcctcttttccctgaatgcccctgaacatggacattcagtccagttcttagcctatgcagagacaggattcacatcccctcaggggatattcagggtaggaaggagcaatacagcagtatttgtaggcaattagaataggaaatctattcttctagatcaggaattggcaaatcatgttctgaggtccaaatcttaccagctgcctggatttgtaaataaagttttattggaacatagtcacagac

SEQ ID NO: 253617 - DNA, 441 bp, Homo sapiens
acatggagtctcactcactgtcacccagctggagagcagtggcgtgatcttggctcactgcaacctctgccttctggatttaagtgattctcctgcctcagcctcctgagtagggattacagcacacaccaccacacctggctagttttgtttggtatttttagagagacagggtttcatcattttggctaggctggacttgaactctttcacctcaagtgatccctctgcctcagtctcccaaagtgctgggattacaggtgtgagccattgcccccggccaggattagatacattttctcccccaactttggccctatattcattttccaaaaggtgtctacgacctgaaaatcaaggatgggaagaaccctgaactgtctgagactgtttctactacccacatggaaaagagagttgaaaagaaattaatttgtcata

SEQ ID NO: 253618 - DNA, 677 bp, Homo sapiens
gttttgtcttctgaattatggtacctacaccaaattagttttagttgaaaaacaacagcaaaacagattcattcagaaaagttacaaagaatgggtagaaaaaaaattaccaacagtccagtttagaatttgacttctctgatatatataatactgtagcatgccatgtagagttacagtaatgacttctttttatccttaacttcacgtcccagttcatatgcttcaaatttcagttttgcagagggttaggatcatgtttgacatagtattgatggtcagagtcaaagaatgtgttctgaaaggaaggctttggccatgcataggaatcaagcctttctcaggaaagagacaaggccaaaacaccaccgttagtcatcctctgtttcactatgtctttgcgtatattctccttcgcctctctgtgcttgttgccacctggtacgatggaaacaataacggtacccaccttgttgggaggagtcatgagactacatgccgagtgcccggcacacagtgagccctagagcgtgagaggccagaatgtggaggtattcattgttttatccctagtgtctaagacattacctggtgtgcagttggtgctcaataaatatttgacaaatgaataaataatgttggctagaataataattatggtattagagaaaagataa

SEQ ID NO: 253619 - DNA, 384 bp, Homo sapiens
gagacactggattataggggagaccttgtcattcaagcagaaattgcgaatggccccaacataccaagggagacttgggacaacaggtggagggagggagaggaaaaaaaaaactgaacaagtgtcgttcctgcccagagagtttgcgatgagtgatgagagtgccagagaaaccttttagaaaccctcttaaattccctctttgaaatctttttcatgtctgctctttgaggactgtgaagagaggggagggtagaggcagagttgatcccaactcttaagattctttggcctaatgtttcacttgaaggcagagactgacgaagttcttttttgaacttcttaggacagttccctgtggttacttttttagtataacaatta

SEQ ID NO: 253620 - DNA, 1216 bp, Homo sapiens
gtgtttgcttcaccttctgccaggattgtaagtttcctgaggcctccccagtcctgcggaactggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatg

SEQ ID NO: 253621 - DNA, 1939 bp, Homo sapiens
cgccaggtggtggctcagaggaggacacagtcgctgtgggcaggtggtcagggcgcaggagggaatgagctgtggatttttagtaatctacaacaatcaggcagttccaggacacagggaagtgagtgtgaacagccaatggacccggagccgagagcctgggcaggcgtaggctggactatggacgccctgcaaccctgccaggctgggaaggggaggcttgatcctgagcgcgtgttaggaaggagatgcccaggttcaggtgtatcgtgcattttttttccacagtgcagaaatgacatttctggttggtcttgaatgtctgctctggccaagccacctcctctcatgctagctaaccaagtggcacgtgtgcccacgcaggccgttctaaggaacactgtaattgtctacacaattttctctcaaatactccgtcctggaagcgtctggttggcagaagagggaaggcaggagggtggcagcgtcccggctgagtcctcttgcacatgggagctggagtccagccaggctccagagcggctccggctggcaagggacctgaacaggaagatgagactcgaggttttctgcatgcctggaagtgcacatgctcatctacagctttcttggaagaagaaagaaacaaaaactgagatttagaacaccaggtctgtttccactggcggccactcttgggcactggagaccagcaagagctttgtttttaaaaggctcttccatggcagatattcgcagaggcatcagggctacacttaaatgaagggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatg

SEQ ID NO: 253622 - DNA, 1561 bp, Homo sapiens
gcgaaagcctttgtccttggttcgccctccccccgtatacatcctgtccccttctgggctattatgctgataattggaaagaccatctaagggggaaagatcctccaatgacgaaggcattctttgacacagctgaggagagcccattctgcatgtatcattactttgtggatattataacatggaacaagaatgtaagaagaggggacattaccatcaaattgagagacaaagctggaaacaccacagaatccaaaatcaatcatgaacccaccacatttcagaaatatcaccaagtgagtctacttgcaagatttaatcaagatctggataaagtggctgcaatttccttgatgttctctacaggatctctaataggcccaaggtacaagctcaggattctccgaatgaagttaaggtcccttgcccatccggagaggcctcagctgtgtcggtatgatcttgtcctgatggaaaacgttgaaacagtcttccaacctattcttggcccagagttgcagttgtaactgtggccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcctgggaaggagcccctaactagggcaagtcagaaatagccaggctcgcagcagcgcagcgctgtgtctgctgtgtcctggggcctcccttgttccgacctgtcaattctgctgcctgtcacgcgggtggttctgcccatcgcggctgcgggtcaagcatcttcaagggaaggacggactggaggcctcaccgtggactcaactctgcattctccgtgccacattcctccagttcccacacgtagaagggaacgaaactgacgtctacctcatggggctgctgtgtgggtttgggaggcaaaaatctatgaagggttttttgaaatcccataggtgccacatctatgagatgtttgataaatgtgaatatgcttttacatttgggcttatctaatttgcaataagagagcctctctctatcaacaccagcttctctctcgggctgtttgctcagggaaggcaagaaagccacgtgctggccctctgccttctctaaagtgctgttggagcatggaggagctggaggagatggggatggactgacagctaagagggcggctgctgggactagatagtggatgaagaaagaaggacgaggaagccgtggggcagcctcttcacatggggacaggggatggagcatgaggcaagggaaggaaaagcagagcttatttttcacctaaggtggagaaggatcactttacaggcaacgctcattttaagcaacccttaagaaatgtttatgtttctttattaccaatgtaatctatgattattgaaggaaatttagaaaatgcgtagatacaaaattaaaaaaaaatactgtccacgatcctattagaggtaattaatgtt

SEQ ID NO: 253623 - DNA, 1452 bp, Homo sapiens
tgctctgaggatccccgctccgagagtcaatatcgctgtcatcttctgagctattatgctgataattggaaagaccatctaagggggaaagatcctccaatgacgaaggcattctttgacacagctgaggagagcccattctgcatgtatcattactttgtggatattataacatggaacaagaatgtaagaagaggggacattaccatcaaattgagagacaaagctggaaacaccacagaatccaaaatcaatcagatctctaataggcccaaggtacaagctcaggattctccgaatgaagttaaggtcccttgcccatccggagaggcctcagctgtgtcggtatgatcttgtcctgatggaaaacgttgaaacagtcttccaacctattcttggcccagagttgcagttgtaactgtggccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcctgggaaggagcccctaactagggcaagtcagaaatagccaggctcgcagcagcgcagcgctgtgtctgctgtgtcctggggcctcccttgttccgacctgtcaattctgctgcctgtcacgcgggtggttctgcccatcgcggctgcgggtcaagcatcttcaagggaaggacggactggaggcctcaccgtggactcaactctgcattctccgtgccacattcctccagttcccacacgtagaagggaacgaaactgacgtctacctcatggggctgctgtgtgggtttgggaggcaaaaatctatgaagggttttttgaaatcccataggtgccacatctatgagatgtttgataaatgtgaatatgcttttacatttgggcttatctaatttgcaataagagagcctctctctatcaacaccagcttctctctcgggctgtttgctcagggaaggcaagaaagccacgtgctggccctctgccttctctaaagtgctgttggagcatggaggagctggaggagatggggatggactgacagctaagagggcggctgctgggactagatagtggatgaagaaagaaggacgaggaagccgtggggcagcctcttcacatggggacaggggatggagcatgaggcaagggaaggaaaagcagagcttatttttcacctaaggtggagaaggatcactttacaggcaacgctcattttaagcaacccttaagaaatgtttatgtttctttattaccaatgtaatctatgattattgaaggaaatttagaaaatgcgtagatacaaaattaaaaaaaaatactgtccacgatcctattagaggtaattaatgtt

SEQ ID NO: 253624 - DNA, 1458 bp, Homo sapiens
ggaatcgagctcggtaccgaaggagaacaggtgaggagagccattctgcatgtatcattactttgtggatattataacatggaacaagaatgtaagaagaggggacattaccatcaaattgagagacaaagctggaaacaccacagaatccaaaatcaatcatgaacccaccacatttcagaaatatcaccaagtgagtctacttgcaagatttaatcaagatctggataaagtggctgcaatttccttgatgttctctacaggatctctaataggcccaaggtacaagctcaggattctccgaatgaagttaaggtcccttgcccatccggagaggcctcagctgtgtcggtatgatcttgtcctgatggaaaacgttgaaacagtcttccaacctattcttggcccagagttgcagttgtaactgtggccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcctgggaaggagcccctaactagggcaagtcagaaatagccaggctcgcagcagcgcagcgctgtgtctgctgtgtcctggggcctcccttgttccgacctgtcaattctgctgcctgtcacgcgggtggttctgcccatcgcggctgcgggtcaagcatcttcaagggaaggacggactggaggcctcaccgtggactcaactctgcattctccgtgccacattcctccagttcccacacgtagaagggaacgaaactgacgtctacctcatggggctgctgtgtgggtttgggaggcaaaaatctatgaagggttttttgaaatcccataggtgccacatctatgagatgtttgataaatgtgaatatgcttttacatttgggcttatctaatttgcaataagagagcctctctctatcaacaccagcttctctctcgggctgtttgctcagggaaggcaagaaagccacgtgctggccctctgccttctctaaagtgctgttggagcatggaggagctggaggagatggggatggactgacagctaagagggcggctgctgggactagatagtggatgaagaaagaaggacgaggaagccgtggggcagcctcttcacatggggacaggggatggagcatgaggcaagggaaggaaaagcagagcttatttttcacctaaggtggagaaggatcactttacaggcaacgctcattttaagcaacccttaagaaatgtttatgtttctttattaccaatgtaatctatgattattgaaggaaatttagaaaatgcgtagatacaaaattaaaaaaaaatactgtccacgatcctattagaggtaattaatgtt

SEQ ID NO: 253625 - DNA, 1553 bp, Homo sapiens
tgctctgaggatccccgctccgagagtcaatatcgctgtcatcttctgagctattatgctgataattggaaagaccatctaagggggaaagatcctccaatgacgaaggcattctttgacacagctgaggagagcccattctgcatgtatcattactttgtggatattataacatggaacaagaatgtaagaagaggggacattaccatcaaattgagagacaaagctggaaacaccacagaatccaaaatcaatcatgaacccaccacatttcagaaatatcaccaagtgagtctacttgcaagatttaatcaagatctggataaagtggctgcaatttccttgatgttctctacaggatctctaataggcccaaggtacaagctcaggattctccgaatgaagttaaggtcccttgcccatccggagaggcctcagctgtgtcggtatgatcttgtcctgatggaaaacgttgaaacagtcttccaacctattcttggcccagagttgcagttgtaactgtggccaggacacatggccataaataatagaaagaaagctacaaccacaggctgtttgaaagcttcacctcacctttctgcaaggcagaaaaagtatgaaaaaaaccaaggcttttttcagtagcgtcctatggatgtcacattgtacatcaaacaaccttgtgattataaaacgatcctgggaaggagcccctaactagggcaagtcagaaatagccaggctcgcagcagcgcagcgctgtgtctgctgtgtcctggggcctcccttgttccgacctgtcaattctgctgcctgtcacgcgggtggttctgcccatcgcggctgcgggtcaagcatcttcaagggaaggacggactggaggcctcaccgtggactcaactctgcattctccgtgccacattcctccagttcccacacgtagaagggaacgaaactgacgtctacctcatggggctgctgtgtgggtttgggaggcaaaaatctatgaagggttttttgaaatcccataggtgccacatctatgagatgtttgataaatgtgaatatgcttttacatttgggcttatctaatttgcaataagagagcctctctctatcaacaccagcttctctctcgggctgtttgctcagggaaggcaagaaagccacgtgctggccctctgccttctctaaagtgctgttggagcatggaggagctggaggagatggggatggactgacagctaagagggcggctgctgggactagatagtggatgaagaaagaaggacgaggaagccgtggggcagcctcttcacatggggacaggggatggagcatgaggcaagggaaggaaaagcagagcttatttttcacctaaggtggagaaggatcactttacaggcaacgctcattttaagcaacccttaagaaatgtttatgtttctttattaccaatgtaatctatgattattgaaggaaatttagaaaatgcgtagatacaaaattaaaaaaaaatactgtccacgatcctattagaggtaattaatgtt

SEQ ID NO: 253626 - DNA, 474 bp, Homo sapiens
atgtttaatctctgacatcatctagcccagtgcccaacatataaaaggaactaaatgactgttaggtaaatattgatatttgaccaaaatcaattttgcttgtttcacaaacgttatgattgaaataaacctttttttttttttccagtttatcatgatccaaatcacaaaattacccattttggacttttggtttttgtctttgactttctcacatctacttccacgagtccttttgttccaccgaaacacttgttattcatggaaaacaatgtcctacggtgactaattatgtaataaatgagaatgacccaacatggtctttttcacacgcactctagtaccaagtgttttctcttgtaatccactgcactcaaaacacaaaataattgtattaactgggggctgttgagggtatttttttttatttaaaagaaatgttaatttgttattaaatctcttgttgaaagaaaa

SEQ ID NO: 253627 - DNA, 535 bp, Homo sapiens
aagaccctgcctcaacaaactaaattaaaattttatttttgaattgacaaataataattatacgttttcatggagtacatagtaatgctttgatatgtataatgtgtagtgatcagatcagggtaattagcatatcatcatctcgaacatcatttctttgtattgggaacgtacaatattctccttctagctatttgaaactatatattattgttaactatagtcatcctacagtggtattgaacactagaacttattcctcttatctagttgtaattttgtatcctttaacaaatctctccctctccttcccttcccccactcattgtggttttaatttacatttctcaagtgactaatgatgttgagcatcttttcaagtgattatttgccatgtatatatctttgattaagatcttttgctcatctttttactgggttgtttgttttctcaatgttgagttttaagaattctccatattttctggatacatgtccattatcaaatatatgatttgcaaatattttctctcaa

SEQ ID NO: 253628 - DNA, 429 bp, Homo sapiens
ttcacctagcccatggccaagtcagggtctctgaagaacccccacgaaaagtgccaactggaagagccaacatttggatcttaccatttggaaggctttcaacagtcaagagagcatcacagccagcatctgcctccatctctcatccctccacagctattatattggaaaatccatcagcagttaggtcacataggagagtgatcagcatatcttgggagcacagtagacacaggttaaggagatcccctgcctgcagtgtcccaatcaaatcataggaacactgtgagactctggggtgagcttgcatttgcagacaggaactgaagggctggagaggttacactcacccaggtgcagttgcccagcatgtgaaagaggagacattctaaaccctgcacttaaaaaataaataaataaataaagtta

SEQ ID NO: 253629 - DNA, 340 bp, Homo sapiens
gagattgggggtcaggctcaggtcagaccaggagtctgtgcctgagccctctccatctcagcatgacccctctgagaccctccctccctgcctcgcttgaatgttcaagccaacagcgagcttgagtcctaccggctgcgtcttggtaggtgtcagatactgaattttaaagaagcaatgacaccccctacccaagacacccgtgcctatgaatatgggaatgtgacccgcgaatattgttgccttggaatactcatgggattaggtgcaatatgccaccaggacaagaaagacatgctgcagcctaggaaagagagaaaagagggtttgggttcacacg

SEQ ID NO: 253630 - DNA, 381 bp, Homo sapiens
acggtattctgtcaaaatacctctccaccctgagcccttgatataggaggaaccctcaaataagggtgacattctagagaagatcacaaaaaagatgagagtcacattgatttcctgacaaaggggtagtagtgaggaaggggccagtgtaagcaccatccataggcaccttggatttgtgctcttgtctcctggtggcagaggccatctcaggtttttgaaggccttgcaggacaggtgtcacaattagtcacaataataataatgattcagccgggcacggtggcacacacctgtaatcccagcactttgggaggccaaggtgggtggatcacttgaggtcaggagtttgagaccagcctggccaacatgacgaaatcc

SEQ ID NO: 253631 - DNA, 150 bp, Homo sapiens
gcagaagaaacagatggggaattgaaaagaacaatcctttttcctttctctcattctgatttgtcaatcaaaattttggagaaaattatcaaagaaaaaaatttttaaggtcaatatgttagaaaagcaaaaaggaaagaaaaacagtga

SEQ ID NO: 253632 - DNA, 705 bp, Homo sapiens
ttttatagcgaaggactctcgccatgttgcccagactcatctcaaactactggacccagacaatcctcacactttggcctcccaaaatgctgagattacagcttacctaaagttaacatctgatgacatgatcgcaactccatatcctgagttgatttcaacctatgatgttggaattttccacatggagataaacactgggaagcagctaatcattctctctggatttataaggaacaaatggataagtgaaacttgaaaacaatggccagagtactaagaactaatgtttcttcaacaaaacaaatacttttactttaagaacagaagataaaaggccaaagttgtaatataagacaaattacggaaatatacacttatacatataaaaccactcctctttttaaaaaatcatgctttttaagaagaatcttctcatatcagtgagaaagaaagttatcttaacaaacaaaaagtatcttgaaaaaaagcgttcacatgtataagaaagaaaatgaacaaataaataggaaaaaagatctctggttcaaccatatcgaagcttcttcatgtttgttattttactgtaaaggacacctccctgatcttgaactgataatacagttaaaagaattaacagaaagagagagggatagaaatggtcacgtacagaatgaaaaataaaggaaatttttttcttaaaat

SEQ ID NO: 253633 - DNA, 2507 bp, Homo sapiens
  misc_feature (1358)..(1358): n is a, c, g, or t
atcaaatggtacctgacatggggcaggcattcagataatgtgtgttgaatgagtaggtgaatgaacatgaaacatcagtaaaactgtcctgtaagtcccatgatagaaataatcagcattactaccacatcagcttcttgtttctcaggtcactggactgaggggagggaaatccaaataatttgtctgcaattaaaaggcagaaggtcaggtgcagtggctcatgcctgtaatcccagcactttgggaggtggaggcaggctgaccacttgagcccaagagttcaggcccagcctgagcaacatagtgagaccccatctcaaaagaaaagttaaaaaacaaaaaacaaaaaaaaacctccaccaacaaaaaaccagccaactgaaattccaaaggtctctagtccacaggtggcactaggggtcactcagaaaataaaaattaaaaagaaaattacttaggaaagtctaaagcactatattgggtacttcattatatctgaagcaagttgatgatggtgcccagaaaaacaaggtagggaagctgcacatttataaagcgtattagaatattctttgatttatgcactattcgaagcttgagcctgggaactaaggccatacaacaaagcaaggattaaactatcaacatgtgggacccagtcagctttcccagcaatcattgaggccactgtgactttccttattgttataaaatgtagatatttagccctacctcttaagacaagatagaactcaccacaaccagttttcactactgtagtatctagtggctttcaaatcaggtaaactaggtgttttatcccagtctggcctcatgctaacttcaggcaaattacacaacttttctcagtttttaacttgttaagtggaaataatagtcattgtcccagaggttattgagtagataagataacatggaggagtgtttaataagtgttccctccctccttcccctgccttttagacaaagcaatcattggagtaaaaactggctttggcatgatgtgggaagagcagagaaggcgtgggatgttttaaattatatgtaaaatacatttttttatttttttgagacggagtctccctctgtcacccaggctggagtgcagtggcgtgatctcggctcactgcagcctctgcctccaggttccagcgattctcctgcctcagactcccgggtagctgggattacaggcacgtgccaccacacccagctaatttttgtatttttagtagagatggggtttcctcatgttggccaggctggtctcaaactcctgacctcaggtgatctgcccacctcagcctcccaaagtgctgggtttacaggtgtgngccactgcaccaggcctaagatacatgttttttaattacttgtggattgaaaggattattattgccctcaacagtgctgtgaataactggccaaaatatggacaaaagaccgtccgtaagttactagctgggtgctaggctggaatcgattcttatttaagatggcctagtaggcaggcctccaaatttgttttcattcctttaccttctacatcttgcctttgaatacacgtttaaaatgttatttctcccaactcaaaccccgtcactgcaataaaacttcctttacttttagaaggatctaagttccaagaaaaaaagaaggaaaaaaagagagttactctcattttcctatttcatagacagttttgaaagcctttagtgtttgggtggggcccagtcacaccctttgcaatctgcagaccagtggtttaaatttgtcatccttgtgggctgtaaaatgaaaccatgtaccaaagaaaaatagtgaatgactcactcacatgtgatcttccagcgaagggaaggattcagtaggaatgtgccacaaggctggcaggtcccttcataataggctcaggtggcctgttctgggatgtgggtcaatgttaggaacctgaatggaggccgccaagttgtggtggggtctgaaggagagcttcagttaccggggtgaattcaccacaatgcaacatccagcagacccagagaaactctctctcagcacgacaagaaagggaggattcctattcaccaggctcattaaacctgtacgcacacacacatgcaaacacacacgtgcagacacacacacgtgcagacacacacatattgctaatttatttatattaagaaatacagtgccaggcatggtggttcacacctgtaatcccagcacgttgggagggtgaggcagacgatcgcttgagcctaggcattcaaggccagcctaggcaatgcagcgaggccttgtctagaaaatttaaaaaaaaaaaaaattagctgggcgtggtggcacgtacctgtagttccagctactcgggaggctgaggcggcaggatctcttgagctaagtagttcgaggctgaagtgagctatgactgtaccactgcactccagcctgggcaacagggcaagaccctgtctcca

SEQ ID NO: 253634 - DNA, 659 bp, Homo sapiens
  misc_feature (612)..(612): n is a, c, g, or t
  misc_feature (652)..(652): n is a, c, g, or t
gtgatactctatacttcttgttgctttacatccggaggctgataatgtctgcttttctctcttttctaattatttgtgaaaggaaaaatgtggggggttgggagaaaaaaacccttaagtacatactcgctaaatcacattgctacaggtaacttccattaagaacttgaaagcaaaggtagctgcattttcccctagggaacacaatgatagccaggagccttagtctacagcttgaaggattgtaattatacctaagcaaccctcctggaccaatttaatgttattagctgtgatgtatccctacctttgatgtcattatccttacttagctcccttaaagcagagatcaagatgaaaagggcttcagctgcagcatggcacatggagattagagtggggcttttggatgctgaggagcagacctagaatgggaaatagatgggagccacagaagtgaaggtccccctccctcattgctcaacctactccacatctccaggtctgcacatctgttcagttactgaatcctgtgtaagctaccttctttttcttttttcttttatttatttatttttttttttttgagatggagttttgctccaaccctgngtgacagagtaaaaaccctgactcttaaagaaaaacaganaagaaaa

SEQ ID NO: 253635 - DNA, 516 bp, Homo sapiens
gagatgaaagagaagagctttgtaggaagagggaagaaaggaagccatgtccagcaggcggttgttcctctggcctagagaacaggagtgagggctgggctagggaggcagggagagctgaagaggatggtcacaaatggtatttacagctgggactgaatgagataaaatattcataagtggatggcagcaacttcttattctaatcctcacacagcctgaggaggtgggcaaaatctccattttgcacaagaggaaattaaagtgctgggattacaggtgtgagccaccacacctggcctggttttattttttgaggaactgccagactttttcaaaatggctgcaccattttgcattcctgtcagcagtgtatgagggttttgacacttccacatcctgtctaacatttcttttttattgtagccatatagaaggtgtacagtggtatctcattgtggctttgatttgcacttccctggtggccaataatgttggacacttttttgtttttgg

SEQ ID NO: 253636 - DNA, 391 bp, Homo sapiens
gagatgaaagagaagagctttgtaggaagagggaagaaaggaagccatgtccagcaggcggttgttcctctggcctagagaacaggagtgagggctgggctagggaggcagggagagctgaagaggatggtcacaaatggtatttacagctgggactgaatgagataaaatattcataagtggatggcagcaacttcttattctaatcctcacacagcctgaggaggtgggcaaaatctccattttgcacaagaggaaattaaaggccgggcatagtggctcatgcctgtaatcccagcactttgggaggctgaggcgggaggatggcttgaggccaggagtttgagatcagcctgggcaatacagggagaccccatctttacaaaaagtg

SEQ ID NO: 253637 - DNA, 486 bp, Homo sapiens
tggagccggtctttcatcggtgatgctcatgtacacccaggccatgcgttgtctaagtctgcccctttaggaaaatgctccagctgcattttcaagggctgctttttctctgcaccaagcaccttgcccactggagagccatcttcaggcagggctcacgagccccatgccctgtaccctgagctgctctgcccggggtgtggcaggtcatgatagagttaagagtcactttgccactggacaatagttcatgacacgtggctcctacctccctgatccctaaatccttcttgcctcctccctaaaggagagctcctgagtgaatttgttggaagcaacactagaaaactgcaagtctcaatcttcaactcacagaatcaaatgttcctgtgaggtcctaaaaccaggtctgtcccagcaggtgaactaaacagggcacagcaggatgagtttgcaggaattttatatatagcaccgattaaggca

SEQ ID NO: 253638 - DNA, 738 bp, Homo sapiens
tgctgggattacaggcgtgagccaccgagtccggcctgattgcttctctaatgctcagccacccaccctgtcttgccaagtctgcccctttaggaaaatgctccagctgcattttcaagggctgctttttctctgcaccaagcaccttgcccactggagagccatcttcaggcagggctcacgagccccatgccctgtaccctgagctgctctgcccggggtgtggcaggtcatgatagagttaagagtcactttgccactggacaatagttcatgacacgtggctcctacctccctgatccctaaatccttcttgcctcctccctaaaggagagctcctgagtgaatttgttggaagcaacactagaaaactgcaagtctcaatcttcaactcacagaatcaaatgttcctgtgaggtcctaaaaccaggtctgtcccagcaggtgaactaaacagggcacagcaggatgagtttgcaggaattaggaatcgacttctatacctcgattacccgtgccctatttgaaaaactgaatgccgatctgttccgtggcaccctgaacccaatatagaacacccttcgagatgccgaactacactagtcacagatccatgatattgtcctggatagtggttctactcatatccccaagattcagaagcttctccaagacttcttcaatggaaaagaactgaataatagcatcaaccctgatgaagctgttgcttatggtgca

SEQ ID NO: 253639 - DNA, 730 bp, Homo sapiens
gatctgagttcaagtaattctcctgcctcagcctcctgaggagctgggattacaggcatgcgccaccacacctggctcacagggtgagaccctgtctctaaaaacaacaacgacaaaaatgacacaatagtgagggcacaggccccaggtcactgacttagattctaatcccagctcttccaactgctgtttcttcacctgctgagcctcagtttccccatctgtcattggggataccagcccctgcttcacgggtgcctaggggattcccaggagattatggaggtgcctcaaggtgcctggtagggctgagggtggagggtatgggggttcagggccgtgtccctggctgagctgaccccacaggtttcagcgggtgggcccacctgacggaggttgaccctgatgaggaggtgcagggcgagatccacctgcggctggaagtgcgcccaggggcccgggcctgccagctacgctgctctgtgctggaggccagatcatgaagaagtcatgctacccacgctggaatgagacgtttgaatttgagctgcaggagggggccgtggaggcgctgtgcgtggaggcctgggactgggaccttgtcagccgaaacgacttcctgggcaaagtggtgatcgatgtccagagactgcgggtggcgcagcaggaggagggctggttccggctgcagcccgaccagtccaagagccggcagcatgacgagtaagtg

SEQ ID NO: 253640 - DNA, 367 bp, Homo sapiens
gggtgttctgatccagactccaagagagggttctcggatctcatgtgagaaagaattcagggcgggtccacagagtaaagtgcaagcaagtttatgagagaagtaaagaaacaaaagaatggctattccacagacagagcagcactgagtgctgctgcttggctatttttagggttatttcttgattaaatgctaaatatggggtggattattcatgagttttccaggaaaggggtggggatttcccttcttttctatcatgtaaggtcacttctggacatttttatggcccttgtaagctgtcacatgctggtagaagtgtcttttagtatgcgaatgtaatacaattggcgtttaacgagcagtg

SEQ ID NO: 253641 - DNA, 387 bp, Homo sapiens
tattttcagcagctgacagtcattacggcttatctccaaagacaccctttccttggagattcacctttttagagtgaattttataacacggtatttggatgagaatatattccacatatgctggatgaacaaatatatgtacactaatatcaatcacttgccccaatttgttcaattcctatattttccgtagagtcctctttctcattcatcctcccaaatagtcagtcaacctcccatcgattctaactcttaaaattggtctcaaatactctcaaatacttagttctctctgctatcatatcgtaattcacttcccacttaagcatggattggaggtcaaagataaacaaaataccaaaatacagctataaagatcacactatc

SEQ ID NO: 253642 - DNA, 942 bp, Homo sapiens
ttccctcttagggggctttcctctgcctcacggtggccccagttcctcgttcctcgactctccttttctctcaggcctgaggcacagcccaggggcctccctgcaagggaacagacgtttcctttattggatcgtgactgtggacttttttctgtaattttgcgagagggtggtggttatgttgcgacatatcaaaaagcagttattttaccgcctttagcagttggggctcaccccatccccccatttgtagatataattggggttagtttagggcgagtcacttcctggtcaggatggcctcttaacttcccttttgctcctccttcctcaggaagtgattttgctgtcacgactcttcgacaaggagaggtcccaaatgttgtccatctcactacacatgcactacttttctcctgtactgtcgcctgtctgattcgctataataaatctgtgagcctcagggcatttgcttcagaatttgaacaccagtctttccctatagacacatcccttttaacgataatttttgaaaattttgtttcttgttaacaaatctagaatagctgatggattttcttaacctccagaaaggttttctgtaacacataataaaccttatgttaacacgttcaagactgaacaaagcatcctgccttctttgatgctccactgtggagtctttgatcagttgaatttgtcagtgtgcattttgtatgctcatttcttgaaaagggtcttaaatacaagagcacattctaaggtggaataacttttcttctgacagttgcacagtttcataacagtttgtcaggcttttcagtaagtacatggttttagggcacgtagaacttagaatgacctcacaaggcaacttattagacaagaattatgacatttgtctcccactgtggctattagaaaatgtgtccccttgagtgc

SEQ ID NO: 253643 - DNA, 400 bp, Homo sapiens
tcctgctcaagaaaaaaaaatttttttgaaagaacaaataacatcaacactcaatactcatttattcacatatttaagacatttttcctgggtatcccattttaattcatccttaaaatggaactgatcttgcctccttagcctaagttcaggggaaatggatgcaaagctctgaaagtcactgatctgggtgctgtgaggtgacatcatcacaggtgacatcaccagccagccatggagaggtttgaacgaaccttccccctttctcccagacagatgtgaccaggctttatgaaaatttgtctgtaaagaggcacttttcaccacattattttaatacacttgtgttattaccagaaaaatgggaaagaaggaaataaaatttgcatcgactttccgc

SEQ ID NO: 253644 - DNA, 363 bp, Homo sapiens
gtaaatcctctgcactgcacgaaagccctgctacacagtagataattcccagtatttgctgaatgacaaaaattgatttatgactaaagatgcatgctcacttggaaaggaaatagggagaaaagcaagaaaaaaattaagaaaatttacatttatcaagcggccataatgtgtcagaaggagagtcagaaagtgatgttacaaaacagttgtcaaagaaagagttgatcaacgagtatggaatcaactaaggtagaaaagaaggtgtattgggcattttataaataacaaattgttatatttctggatctttttgatgtttgtatttgccagctttcataaattattaatttgttgtgaaat

SEQ ID NO: 253645 - DNA, 522 bp, Homo sapiens
ccatttgtatcacaattccagctgcctcttttgcaaaaatgtttaagctgatcctaagatgtgtatggaaatgcaagggacccagaatagccaaaacaatcttgaaaaaaatgatcaaagttggagggctcacatttccccatttcagtacttactacagagctacaataatcaagacagtgcatattggtatgaggataggcatgtaaaacagtaaaataggatcgagagtctagaaatagaccctaaatttacggtcaaatgtttttcaacaaaagtgccaagataattcaatggggaaaaaaagccttttaacaagtggtacagggtcaaatggatagacacatgcaaaaaaaggagttggatcccttctttaagcattcaaaactcaaaagggggtgtagaactaaatatatgagctaaaactataaaatttttagaagaaaaaaatagaagtaaaccttcatgactttagcttagccaaagccttctcatatatcgcaccaaaagcacaagattaaa

SEQ ID NO: 253646 - DNA, 370 bp, Homo sapiens
aaaacaaacaagcaaacaaataagggtcttaggacgagctgcctaatatttcatctttgtcagcaagaaaagaaagtagaatagaatatctttgggtatgggccctgtttttgaatttggtgtagggtgttttgagagaagatacagctaagatcaccagtccttgataagacagggtttcttttctcatatgtgcttcaaaagtcacaaataatcatcctgactctccttggcccacctcaaaccactctatccccattggtttggatatggtcaagtccagacatgtccctctaagcagccagggcagcagaatctctacttaactaacattagttcttaatagactatgggatattgaacataaaat

SEQ ID NO: 253647 - DNA, 336 bp, Homo sapiens
acccatcctcctcatattcttcgaaaaaattgaaagggaggtaacacttccacacttactctgtggggcctacattaccctgataccaaagctagacaaagacgcaataaaaaactattgactaataccttgataaatattgatgcaaaaatcctcaacaaaatagtaccaaactgaattcaacagtacagtcatgtgttgcttaacaataggaccacattctgagaaatgtattgttaggtgactttttgtgcaaacattgtagagtgtatttacataaccctaggtgatatagcctactaccagcctaggctatattaggtagcctgttgttcc

SEQ ID NO: 253648 - DNA, 192 bp, Homo sapiens
agcaggggaatggtatcgtgcaggatgaggtgtttttgtttttgagatgattctagaacagaatttctcaactgtggcattaatggtatttggactagataattttttgttgtcaagggctatcctgcgtgttgtggtatgttgttatagcggcatccctgagctctacctactagatgccagtaggaccct

SEQ ID NO: 253649 - DNA, 441 bp, Homo sapiens
taggtcctgattttcccctctcttccattctgggggaactgcatttataaaaagtttaacattagtagtgataagaacaacaaaatcaatatgactggcagctaacttgttttgagcatcggttctggtctggcacagtgctcaccattttacatagcatggagtcggtatgggtcagtttcccaaatgtgcttttttaaagaactggaaacccagaggcatttgaaatatgtgtcttttgaatcaaagaaacatagaggatttgaagatggaggagaccgcattttattttatggccctggataaagtcactacgcctatccctctgagactcagttatccccatctgtaaaatgggtggttggatgaaatgaacactcgaggtcttctcagagctgacattctacagattcatcagtgagtttcctctgactctccttg

SEQ ID NO: 253650 - DNA, 378 bp, Homo sapiens
ttctactaataataccaaaaattagccgggtgtggtgacacatgcctgtaatcccaactactcgggaggctgaggcacgagaatcattagaacccaggtggtggaggctgcagtgagccgagattgcgtcagtgcactctggcctcggcaacagagcgagactctgtctcaaacaaacaaacaaacaaacaaacaaaaggactctatattcaagttaaaataagaagtgtaacagaatcatggggtcttttttgctttttaaattttgatgtggctcacacctgtaaatcccagaactttgggaggccaggggaggaggattgctagagcctgggggttcaagaccagcctgggcaaagtggttaggacccattctca

SEQ ID NO: 253651 - DNA, 650 bp, Homo sapiens
tttaaattgggcagccattaggctgagacagctggctccagtgcctagtaagcaaactgaagcccaatgtaaacataaaatgaaacttaagcttaaccaatcaaaaacaaacctctaactagggactttccactggatcatatccaaataaggcaagtgcctagctacagccaatcaagtaattcctttactttgctacagcgttcagcctataaaagcctgcttctaaagcagagctctctgaacttcttccagttttgaatgctgcctgaatcctttaatgctcacctaaattctgctaaatgtctgtctaaagtttttatttaaacaattctgaacatttttaagttgttattttttcttatgtaatattcattttaatacctataatgggtactctgacattcaatctaaattaatagaaaacagaaaaataattctacaaatacacttgagatgcagacatctgagtttgatttatcagatcaaatctctcatctagcacataaaaatgattctagactttcaaacaacgttaaaaaagaaaaacagccaggcgcagtggctcacacctgtaaccccagcaatttgggaggctgagatcactccactgcactccaacctggacaacaaaagcgaaactccatctc

SEQ ID NO: 253652 - DNA, 1033 bp, Homo sapiens
  misc_feature (1003)..(1003): n is a, c, g, or t
  misc_feature (1032)..(1032): n is a, c, g, or t
cagcagagcccctggaggggcacaggggcccccagagccctgcccacagaaaagggaggcttgagctcaaggggctccacccaccagggcccccaggtgaggctgagggcccagccccagagattccaggtgagcagcaaggggcggtggaggacagagccccccgagccagccctcccactgcctgcccatcccaccgaacccctaggactaagcggcccggaacctgtggcccctcccctgagcccccggcagcagacggcagggccggcgaccgcgggatgagcgagggctttcttggagaggcaggaagaggggcccactgcccgaccgagagagcaaacaagggccgtctcctccccagatgccggaaggctcttccactgcagggctgctgggctggaggggctctgaggcagagccagggagcccgagtccagggggcttccccgggtcctcctcacaacccgggcaggggcagctcacagcgggtcctggcgggggcaggcctaggtgcttctgcgcaggccctagccaagccccttccaccccggggggctctggcagccctagggggcctggcagggaaggagagaggctgctaaagtgccatggaaagcaacagcctgaagccgggctgggtttgggcaggacaggaagagtcatgggggtcaagagactgggtccctccaagcttgggcacccccgctgccagggacctcgccaccccgctcagccccacaggccctgggtaggctgtctcccagcacacatcagggaacctcagctctaatgactacaaagccagcacgtttatttctggataaacagtgagggtgtgagctgctgcacctgctcctggctgtggggcttctccgggacccctcctggcctccgcagggccctgagctttatgagggacgccttccagcgcagccaccccacagcgatactttggtcatgaatgtatatagccacttctgcaggagcaccaagaaatacntgggactacattggaatcttagtacatant

SEQ ID NO: 253653 - DNA, 4473 bp, Homo sapiens
cagcagagcccctggaggggcacaggggcccccagagccctgcccacagaaaagggaggcttgagctcaaggggctccacccaccagggcccccaggtgaggctgagggcccagccccagagattccaggtgagcagcaaggggcggtggaggacagagccccccgagccagccctcccactgcctgcccatcccaccgaacccctaggactaagcggcccggaacctgtggcccctcccctgagcccccggcagcagacggcagggccggcgaccgcgggatgagcgagggctttcttggagaggcaggaagaggggcccactgcccgaccgagagagcaaacaagggccgtctcctccccagatgccggaaggctcttccactgcagggctgctgggctggaggggctctgaggcagagccagggagcccgagtccagggggcttccccgggtcctcctcacaacccgggcaggggcagctcacagcgggtcctggcgggggcaggcctaggtgcttctgcgcaggccctagccaagccccttccaccccggggggctctggcagccctagggggcctggcagggaaggagagaggctgctaaagtgccatggaaagcaacagcctgaagccgggctgggtttgggcaggacaggaagagtcatgggggtcaagagactgggtccctccaagcttgggcacccccgctgccagggacctcgccaccccgctcagccccacaggccctgggtaggctgtctcccagcacacatcagggaacctcagctctaatgactacaaagccagcacgtttatttctggataaacagtgagggtgtgagctgctgcacctgctcctggctgtggggcttctccgggacccctcctggcctccgcagggccctgagctttatgagggacgccttccagcgcagccacctcacagcctggtacacgccccagcagttcatgggcaccaccttgccaggcgccatgtccttgatgaagacccgcggcctcaccagggatgggagcgccttccagctgcccagcggcgtccgcgggccctcctcactccacagccggagcacactctcccacagggtggccatctcctgcgtgcgcagccgggcctcagtgttgaacctgaggttctggatggtcttgttggcctggacgcagttttccagcttcattatttggttctgaaactggccttgccttcggcggaaatcctgaggtctgagtcgctcttatgaagcaggcacttgtcggagacactctctatctgctgggggaggccatccaccttctcccgcacccctcgcaggtgttcggtcacctccttccgccacctggccaggtcctccagggacttcctctctgcaccttcccattcggtctttgcctggggtacagatgcccagtgagggacaaagccaagagaggggggacagacagatggaaagacggacacggggagctctggggagcaggcggcccccacccccacttccagctctgagacatttgtgcacaggcctgcaggcggctgggatggcctggccgggcacgctctggagacacacatgccaaggcagggcctgggcagccgagggcccgtgggggctgttccgaccacacaggtgcccgagggaggcagggcaggccccggtgggacccagccccgaaacgcagggtgtcgcccacgtttgcagccgcgctcgcgtgtcggtggatgagcgggaaccggggggcggcgcctacgcaatgcacgttacgccgcggtggaaggggtgaagctctgcgcacgaggccccgaggagcgggaaacgggatgcccgtgggtgtcaccgccacagcggccgcaccgtgcgtggctctgtttcctggaaacgtccagaacaggcagcccccgagacagggaggggcccagcggtcgccaggggaagtggggatgggaatgagtgcggatggggctgaggttcttcctgaaggatgaatgctctgaaactgtgaatagacacacggaactgtgcacgttcacgggtgaaccgtgtggggagtgaatccatctcaacagagctgttacacagtgaacaagagcacgaggggtggaggccgcttgtctgccccgccgtgagctgcccgcatggccgggccgtgggccgaggctccagctcgggcctcacgggctgcagatgctgggccgaggctgctcagcggctgtcctgccccacacaggagtctctggggctcggggtctcccaggccctggggacagtcgctgggtgggacgggaggcttgggaccggcctgtcaggcctctaccctgggggcagtggtgggctgagagctggaggggtggggactccccatagccccgcctgcccccgcccgctgcctggcgcacctcggacagcctgaggcccagcatctgctcctgcagatcgagccggctgctcagagccgggagatggccactcagctcctttaactgcccggccagctgcgccacggatgcctccagagcccggctcttctctcggagctgcaggggacaggtgggcacggggaggcctggctgagcgcccatcccgtgtgcgtgggagaccccgttggggacatgttgcgctaccccctcaccagcaccagctctccatgcatctcctgccgggccagctcgccagccagctgtgcggcctccaggttctcctgcacataggcggccagctccccagcccggctttcctccaagcgccccttggcgtccctaggggttggggacacatagacaccctcagtggagcctgcccacctctcagccctgggccagggaggggagcttggctgctggctccagaacctcccaggagaccctgggatcggaagatggggtgcggtcacagtgccaccaacacgggttcactccccatggccaccaagatgggcgttcactccccacggccaccaagacaggggttccctccccatggccacagctgagtgccccagggagggcaggctgggtgagggacaggaggccccacaggagggaggagggttcgcaccatccagctgcagccctcggggtcgagcactctgctcgggggaggcaaggtcattccctgctgagtcggccactgcggccccctcctgagtgggacatcaggggtccccccgcctgacagcacctgaggccccaggacacccaccaggctttctcctcggccagtaggacacggttcagcgacgcctggttctgctgcacaaacttggtcagctgggccacggcagcatccaggccctggcactgctccaggaggtggctctcctgccagggggtggaggccgccctgagacctgcaccccggccccggccccacctgcccgccgcccgcccggccccacctcatgctgcccctgcagggcccgcaggcgctcctccatcagcccccgaagcttctcccaccggctctccagctcgccccgcaggctgccctccagcttcagccgtgagctctccgaggccttcattctctgtggggagaccccactgtcagctgcaggtctgcgtctgggaaggggggcagggcaggccagccgcgggcaggctcccaccttctccagggccaggaagctcttctgcaggaagccgtcacagcttggcctccctcttcaggaagcgcaggctcacctcttcgccgagcttggtcacctgggcctggggcggaggcacattgtcccgtgtgcagcctctgctggacacgcagccggtccccctcctgcccatggtctccatcagagttggagtcccctgctgtccccaagccctgagcccggctgagctgggcctgtcacaccctcagccggaagaaagccacggcgggcaggaccactctgtacccagacgaccaaccaggcatgggtttgtgaagcatgagaaggccacactcaggtggggtccagacacacttggcacccaccaccgaggctgcccagggaaggccccccagccgccaccaggcccggcagggaagcaggagtgtcgtgcaggtgtccccatgcacggggagccaggtgggctgggcagagccttggggccttgtctccacaccaacagctgctttcctgccgccctgaaggggaggggaggggggaggcgcagccggccccatccctgcatctcatacacgcaaagggtaggcaggcggcacaggcccttcatcagccacggagaggcgcctcccgggaaacttcccctccacccaagcccctgctggcctcctgccccccaggaggtcaccttagagtagatatttttctgtaaaaagccagatggtacatgttcccacctcatgggatctctgttgtaaccctctcagcatggcggttacagcccccacagtagacattgacaacatgtaaaaaatgttcctgtgtgccaataaaactttatttacaaaaacaaa

SEQ ID NO: 253654 - DNA, 3468 bp, Homo sapiens
cagcagagcccctggaggggcacaggggcccccagagccctgcccacagaaaagggaggcttgagctcaaggggctccacccaccagggcccccaggtgaggctgagggcccagccccagagattccaggtgagcagcaaggggcggtggaggacagagccccccgagccagccctcccactgcctgcccatcccaccgaacccctaggactaagcggcccggaacctgtggcccctcccctgagcccccggcagcagacggcagggccggcgaccgcgggatgagcgagggctttcttggagaggcaggaagaggggcccactgcccgaccgagagagcaaacaagggccgtctcctccccagatgccggaaggctcttccactgcagggctgctgggctggaggggctctgaggcagagccagggagcccgagtccagggggcttccccgggtcctcctcacaacccgggcaggggcagctcacagcgggtcctggcgggggcaggcctaggtgcttctgcgcaggccctagccaagccccttccaccccggggggctctggcagccctagggggcctggcagggaaggagagaggctgctaaagtgccatggaaagcaacagcctgaagccgggctgggtttgggcaggacaggaagagtcatgggggtcaagagactgggtccctccaagcttgggcacccccgctgccagggacctcgccaccccgctcagccccacaggccctgggtaggctgtctcccagcacacatcagggaacctcagctctaatgactacaaagccagcacgtttatttctggataaacagtgagggtgtgagctgctgcacctgctcctggctgtggggcttctccgggacccctcctggcctccgcagggccctgagctttatgagggacgccttccagcgcagccacctcacagcctggtacacgccccagcagttcatgggcaccaccttgccaggcgccatgtccttgatgaagacccgcggcctcaccagggatgggagcgccttccagctgcccagcggcgtccgcgggccctcctcactccacagccggagcacactctcccacagggtggccatctcctgcgtgcgcagccgggcctcagtgttgaacctgaggttctggatggtcttgttggcctggacgcagttttccagcttcattatttggttctgaaactggccttgccttcggcggaaatcctgaggtctgagtcgctcttatgaagcaggcacttgtcggagacactctctatctgctgggggaggccatccaccttctcccgcacccctcgcaggtgttcggtcacctccttccgccacctggccaggtcctccagggacttcctctctgcaccttcccattcggtctttgcctcggacagcctgaggcccagcatctgctcctgcagatcgagccggctgctcagagccgggagatggccactcagctcctttaactgcccggccagctgcgccacggatgcctccagagcccggctcttctctcggagctgcaggggacaggtgggcacggggaggcctggctgagcgcccatcccgtgtgcgtgggagaccccgttggggacatgttgcgctaccccctcaccagcaccagctctccatgcatctcctgccgggccagctcgccagccagctgtgcggcctccaggttctcctgcacataggcggccagctccccagcccggctttcctccaagcgccccttggcgtccctaggggttggggacacatagacaccctcagtggagcctgcccacctctcagccctgggccagggaggggagcttggctgctggctccagaacctcccaggagaccctgggatcggaagatggggtgcggtcacagtgccaccaacacgggttcactccccatggccaccaagatgggcgttcactccccacggccaccaagacaggggttccctccccatggccacagctgagtgccccagggagggcaggctgggtgagggacaggaggccccacaggagggaggagggttcgcaccatccagctgcagccctcggggtcgagcactctgctcgggggaggcaaggtcattccctgctgagtcggccactgcggccccctcctgagtgggacatcaggggtccccccgcctgacagcacctgaggccccaggacacccaccaggctttctcctcggccagtaggacacggttcagcgacgcctggttctgctgcacaaacttggtcagctgggccacggcagcatccaggccctggcactgctccaggaggtggctctcctgccagggggtggaggccgccctgagacctgcaccccggccccggccccacctgcccgccgcccgcccggccccacctcatgctgcccctgcagggcccgcaggcgctcctccatcagcccccgaagcttctcccaccggctctccagctcgccccgcaggctgccctccagcttcagccgtgagctctccgaggccttcattctctgtggggagaccccactgtcagctgcaggtctgcgtctgggaaggggggcagggcaggccagccgcgggcaggctcccaccttctccagggccaggaagctcttctgcaggaagccgtcacagcttggcctccctcttcaggaagcgcaggctcacctcttcgccgagcttggtcacctgggcctggggcggaggcacattgtcccgtgtgcagcctctgctggacacgcagccggtccccctcctgcccatggtctccatcagagttggagtcccctgctgtccccaagccctgagcccggctgagctgggcctgtcacaccctcagccggaagaaagccacggcgggcaggaccactctgtacccagacgaccaaccaggcatgggtttgtgaagcatgagaaggccacactcaggtggggtccagacacacttggcacccaccaccgaggctgcccagggaaggccccccagccgccaccaggcccggcagggaagcaggagtgtcgtgcaggtgtccccatgcacggggagccaggtgggctgggcagagccttggggccttgtctccacaccaacagctgctttcctgccgccctgaaggggaggggaggggggaggcgcagccggccccatccctgcatctcatacacgcaaagggtaggcaggcggcacaggcccttcatcagccacggagaggcgcctcccgggaaacttcccctccacccaagcccctgctggcctcctgccccccaggaggtcaccttagagtagatatttttctgtaaaaagccagatggtacatgttcccacctcatgggatctctgttgtaaccctctcagcatggcggttacagcccccacagtagacattgacaacatgtaaaaaatgttcctgtgtgccaataaaactttatttacaaaaacaaa

SEQ ID NO: 253655 - DNA, 4114 bp, Homo sapiens
cagcagagcccctggaggggcacaggggcccccagagccctgcccacagaaaagggaggcttgagctcaaggggctccacccaccagggcccccaggtgaggctgagggcccagccccagagattccaggtgagcagcaaggggcggtggaggacagagccccccgagccagccctcccactgcctgcccatcccaccgaacccctaggactaagcggcccggaacctgtggcccctcccctgagcccccggcagcagacggcagggccggcgaccgcgggatgagcgagggctttcttggagaggcaggaagaggggcccactgcccgaccgagagagcaaacaagggccgtctcctccccagatgccggaaggctcttccactgcagggctgctgggctggaggggctctgaggcagagccagggagcccgagtccagggggcttccccgggtcctcctcacaacccgggcaggggcagctcacagcgggtcctggcgggggcaggcctaggtgcttctgcgcaggccctagccaagccccttccaccccggggggctctggcagccctagggggcctggcagggaaggagagaggctgctaaagtgccatggaaagcaacagcctgaagccgggctgggtttgggcaggacaggaagagtcatgggggtcaagagactgggtccctccaagcttgggcacccccgctgccagggacctcgccaccccgctcagccccacaggccctgggtaggctgtctcccagcacacatcagggaacctcagctctaatgactacaaagccagcacgtttatttctggataaacagtgagggtgtgagctgctgcacctgctcctggctgtggggcttctccgggacccctcctggcctccgcagggccctgagctttatgagggacgccttccagcgcagccacctcacagcctggtacacgccccagcagttcatgggcaccaccttgccaggcgccatgtccttgatgaagacccgcggcctcaccagggatgggagcgccttccagctgcccagcggcgtccgcgggccctcctcactccacagccggagcacactctcccacagggtggccatctcctgcgtgcgcagccgggcctcagtgttgaacctgaggttctggatggtcttgttggcctggacgcagttttccagcttcattatttggttctgaaactggccttgccttcggcggaaatcctgaggtctgagtcgctcttatgaagcaggcacttgtcggagacactctctatctgctgggggaggccatccaccttctcccgcacccctcgcaggtgttcggtcacctccttccgccacctggccaggtcctccagggacttcctctctgcaccttcccattcggtctttgcctggggtacagatgcccagtgagggacaaagccaagagaggggggacagacagatggaaagacggacacggggagctctggggagcaggcggcccccacccccacttccagctctgagacatttgtgcacaggcctgcaggcggctgggatggcctggccgggcacgctctggagacacacatgccaaggcagggcctgggcagccgagggcccgtgggggctgttccgaccacacaggtgcccgagggaggcagggcaggccccggtgggacccagccccgaaacgcagggtgtcgcccacgtttgcagccgcgctcgcgtgtcggtggatgagcgggaaccggggggcggcgcctacgcaatgcacgttacgccgcggtggaaggggtgtcaccgccacagcggccgcaccgtgcgtggctctgtttcctggaaacgtccagaacaggcagcccccgagacagggaggggcccagcggtcgccaggggaagtggggatgggaatgagtgcggatggggctgaggttcttcctgaaggatgaatgctctgaaactgtgaatagacacacggaactgtgcacgttcacgggtgaaccgtgtggggagtgaatccatctcaacagagctgttacacagtgaacaagagcacgaggggtggaggccgcttgtctgctcctgcagatcgagccggctgctcagagccgggagatggccactcagctcctttaactgcccggccagctgcgccacggatgcctccagagcccggctcttctctcggagctgcaggggacaggtgggcacggggaggcctggctgagcgcccatcccgtgtgcgtgggagaccccgttggggacatgttgcgctaccccctcaccagcaccagctctccatgcatctcctgccgggccagctcgccagccagctgtgcggcctccaggttctcctgcacataggcggccagctccccagcccggctttcctccaagcgccccttggcgtccctaggggttggggacacatagacaccctcagtggagcctgcccacctctcagccctgggccagggaggggagcttggctgctggctccagaacctcccaggagaccctgggatcggaagatggggtgcggtcacagtgccaccaacacgggttcactccccatggccaccaagatgggcgttcactccccacggccaccaagacaggggttccctccccatggccacagctgagtgccccagggagggcaggctgggtgagggacaggaggccccacaggagggaggagggttcgcaccatccagctgcagccctcggggtcgagcactctgctcgggggaggcaaggtcattccctgctgagtcggccactgcggccccctcctgagtgggacatcaggggtccccccgcctgacagcacctgaggccccaggacacccaccaggctttctcctcggccagtaggacacggttcagcgacgcctggttctgctgcacaaacttggtcagctgggccacggcagcatccaggccctggcactgctccaggaggtggctctcctgccagggggtggaggccgccctgagacctgcaccccggccccggccccacctgcccgccgcccgcccggccccacctcatgctgcccctgcagggcccgcaggcgctcctccatcagcccccgaagcttctcccaccggctctccagctcgccccgcaggctgccctccagcttcagccgtgagctctccgaggccttcattctctgtggggagaccccactgtcagctgcaggtctgcgtctgggaaggggggcagggcaggccagccgcgggcaggctcccaccttctccagggccaggaagctcttctgcaggaagccgtcacagcttggcctccctcttcaggaagcgcaggctcacctcttcgccgagcttggtcacctgggcctggggcggaggcacattgtcccgtgtgcagcctctgctggacacgcagccggtccccctcctgcccatggtctccatcagagttggagtcccctgctgtccccaagccctgagcccggctgagctgggcctgtcacaccctcagccggaagaaagccacggcgggcaggaccactctgtacccagacgaccaaccaggcatgggtttgtgaagcatgagaaggccacactcaggtggggtccagacacacttggcacccaccaccgaggctgcccagggaaggccccccagccgccaccaggcccggcagggaagcaggagtgtcgtgcaggtgtccccatgcacggggagccaggtgggctgggcagagccttggggccttgtctccacaccaacagctgctttcctgccgccctgaaggggaggggaggggggaggcgcagccggccccatccctgcatctcatacacgcaaagggtaggcaggcggcacaggcccttcatcagccacggagaggcgcctcccgggaaacttcccctccacccaagcccctgctggcctcctgccccccaggaggtcaccttagagtagatatttttctgtaaaaagccagatggtacatgttcccacctcatgggatctctgttgtaaccctctcagcatggcggttacagcccccacagtagacattgacaacatgtaaaaaatgttcctgtgtgccaataaaactttatttacaaaaacaaa

SEQ ID NO: 253656 - DNA, 3500 bp, Homo sapiens
cagcagagcccctggaggggcacaggggcccccagagccctgcccacagaaaagggaggcttgagctcaaggggctccacccaccagggcccccaggtgaggctgagggcccagccccagagattccaggtgagcagcaaggggcggtggaggacagagccccccgagccagccctcccactgcctgcccatcccaccgaacccctaggactaagcggcccggaacctgtggcccctcccctgagcccccggcagcagacggcagggccggcgaccgcgggatgagcgagggctttcttggagaggcaggaagaggggcccactgcccgaccgagagagcaaacaagggccgtctcctccccagatgccggaaggctcttccactgcagggctgctgggctggaggggctctgaggcagagccagggagcccgagtccagggggcttccccgggtcctcctcacaacccgggcaggggcagctcacagcgggtcctggcgggggcaggcctaggtgcttctgcgcaggccctagccaagccccttccaccccggggggctctggcagccctagggggcctggcagggaaggagagaggctgctaaagtgccatggaaagcaacagcctgaagccgggctgggtttgggcaggacaggaagagtcatgggggtcaagagactgggtccctccaagcttgggcacccccgctgccagggacctcgccaccccgctcagccccacaggccctgggtaggctgtctcccagcacacatcagggaacctcagctctaatgactacaaagccagcacgtttatttctggataaacagtgagggtgtgagctgctgcacctgctcctggctgtggggcttctccgggacccctcctggcctccgcagggccctgagctttatgagggacgccttccagcgcagccacctcacagcctggtacacgccccagcagttcatgggcaccaccttgccaggcgccatgtccttgatgaagacccgcggcctcaccagggatgggagcgccttccagctgcccagcggcgtccgcgggccctcctcactccacagccggagcacactctcccacagggtggccatctcctgcgtgcgcagccgggcctcagtgttgaacctgaggttctggatggtcttgttggcctggacgcagttttccagcttcattatttggttctgaaactggccttgccttcggcggaaatcctgaggtctgagtcgctcttatgaagcaggcacttgtcggagacactctctatctgctgggggaggccatccaccttctcccgcacccctcgcaggtgttcggtcacctccttccgccacctggccaggtcctccagggacttcctctctgcaccttcccattcggtctttgcctggggtacagatgcccagtgagggacaaagccaagagaggggggacagacagatggaaagacggacacggggagctctggggagcaggcggcccccacccccacttccagctctgagacatttgtgcacaggcctgcaggcggctgggatggcctggccgggcacgctctggagacacacatgccaaggcagggcctgggcagccgagggcccgtgggggctgttccgaccacacaggtgcccgagggaggcagggcaggccccggtgggacccagccccgaaacgcagggtgtcgcccacgtttgcagccgcgctcgcgtgtcggtggatgagcgggaaccggggggcggcgcctacgcaatgcacgttacgccgcggtggaaggggtgtcaccgccacagcggccgcaccgtgcgtggctctgtttcctggaaacgtccagaacaggcagcccccgagacagggaggggcccagcggtcgccaggggaagtggggatgggaatgagtgcggatggggctgaggttcttcctgaaggatgaatgctctgaaactgtgaatagacacacggaactgtgcacgttcacgggtgaaccgtgtggggagtgaatccatctcaacagagctgttacacagtgaacaagagcacgaggggtggaggccgcttgtctgctcctgcagatcgagccggctgctcagagccgggagatggccactcagctcctttaactgcccggccagctgcgccacggatgcctccagagcccggctcttctctcggagcagcaccagctctccatgcatctcctgccgggccagctcgccagccagctgtgcggcctccaggttctcctgcacataggcggccagctccccagcccggctttcctccaagcgccccttggcgtcccaggctttctcctcggccagtaggacacggttcagcgacgcctggttctgctgcacaaacttggtcagctgggccacggcagcatccaggccctggcactgctccaggaggtggctctcctcatgctgcccctgcagggcccgcaggcgctcctccatcagcccccgaagcttctcccaccggctctccagctcgccccgcaggctgccctccagcttcagccgtgagctctccgaggccttcattctctgtggggagaccccactgtcagctgcaggtctgcgtctgggaaggggggcagggcaggccagccgcgggcaggctcccaccttctccagggccaggaagctcttctgcaggaagccgtcacagcttggcctccctcttcaggaagcgcaggctcacctcttcgccgagcttggtcacctgggcctggggcggaggcacattgtcccgtgtgcagcctctgctggacacgcagccggtccccctcctgcccatggtctccatcagagttggagtcccctgctgtccccaagccctgagcccggctgagctgggcctgtcacaccctcagccggaagaaagccacggcgggcaggaccactctgtacccagacgaccaaccaggcatgggtttgtgaagcatgagaaggccacactcaggtggggtccagacacacttggcacccaccaccgaggctgcccagggaaggccccccagccgccaccaggcccggcagggaagcaggagtgtcgtgcaggtgtccccatgcacggggagccaggtgggctgggcagagccttggggccttgtctccacaccaacagctgctttcctgccgccctgaaggggaggggaggggggaggcgcagccggccccatccctgcatctcatacacgcaaagggtaggcaggcggcacaggcccttcatcagccacggagaggcgcctcccgggaaacttcccctccacccaagcccctgctggcctcctgccccccaggaggtcaccttagagtagatatttttctgtaaaaagccagatggtacatgttcccacctcatgggatctctgttgtaaccctctcagcatggcggttacagcccccacagtagacattgacaacatgtaaaaaatgttcctgtgtgccaataaaactttatttacaaaaacaaa

SEQ ID NO: 253657 - DNA, 2220 bp, Homo sapiens
cagcagagcccctggaggggcacaggggcccccagagccctgcccacagaaaagggaggcttgagctcaaggggctccacccaccagggcccccaggtgaggctgagggcccagccccagagattccaggtgagcagcaaggggcggtggaggacagagccccccgagccagccctcccactgcctgcccatcccaccgaacccctaggactaagcggcccggaacctgtggcccctcccctgagcccccggcagcagacggcagggccggcgaccgcgggatgagcgagggctttcttggagaggcaggaagaggggcccactgcccgaccgagagagcaaacaagggccgtctcctccccagatgccggaaggctcttccactgcagggctgctgggctggaggggctctgaggcagagccagggagcccgagtccagggggcttccccgggtcctcctcacaacccgggcaggggcagctcacagcgggtcctggcgggggcaggcctaggtgcttctgcgcaggccctagccaagccccttccaccccggggggctctggcagccctagggggcctggcagggaaggagagaggctgctaaagtgccatggaaagcaacagcctgaagccgggctgggtttgggcaggacaggaagagtcatgggggtcaagagactgggtccctccaagcttgggcacccccgctgccagggacctcgccaccccgctcagccccacaggccctgggtaggctgtctcccagcacacatcagggaacctcagctctaatgactacaaagccagcacgtttatttctggataaacagtgagggtgtgagctgctgcacctgctcctggctgtggggcttctccgggacccctcctggcctccgcagggccctgagctttatgagggacgccttccagcgcagccacctcacagcctggtacacgccccagcagttcatgggcaccaccttgccaggcgccatgtccttgatgaagacccgcggcctcaccagggatgggagcgccttccagctgcccagcggcgtccgcgggccctcctcactccacagccggagcacactctcccacagggtggccatctcctgcgtgcgcagccgggcctcagtgttgaacctgaggttctggatggtcttgttggcctggacgcagttttccagcttcattatttggttctgaaactggccttgccttcggcggaaatcctgaggtctgagtcgctcttatgaagcaggcacttgtcggagacactctctatctgctgggggaggccatccaccttctcccgcacccctcgcaggtgttcggtcacctccttccgccacctggccaggtcctccagggacttcctctctgcaccttcccattcggtctttgcctggggtacagatgcccagtgagggacaaagccaagagaggggggacagacagatggaaagacggacacggggagctctggggagcaggcggcccccacccccacttccagctctgagacatttgtgcacaggcctgcaggcggctgggatggcctggccgggcacgctctggagacacacatgccaaggcagggcctgggcagccgagggcccgtgggggctgttccgaccacacaggtgcccgagggaggcagggcaggccccggtgggacccagccccgaaacgcagggtgtcgcccacgtttgcagccgcgctcgcgtgtcggtggatgagcgggaaccggggggcggcgcctacgcaatgcacgttacgccgcggtggaaggggtgtcaccgccacagcggccgcaccgtgcgtggctctgtttcctggaaacgtccagaacaggcagcccccgagacagggaggggcccagcggtcgccaggggaagtggggatgggaatgagtgcggatggggctgaggttcttcctgaaggatgaatgctctgaaactgtgaatagacacacggaactgtgcacgttcacgggtgaaccgtgtggggagtgaatccatctcaacagagctgttacacagtgaacaagagcacgaggggtggaggccgcttgtctggtcctgcggattgagccgggtgtcagagccggagatggcactcagttcctttatgccggccagtggcacggtggcccagagccggctcttccgggcgggggacggggcccgggccggcaccccccccgggtggggacg

SEQ ID NO: 253658 - DNA, 3863 bp, Homo sapiens
  misc_feature (2019)..(2019): n is a, c, g, or t
  misc_feature (2621)..(2621): n is a, c, g, or t
  misc_feature (2790)..(2790): n is a, c, g, or t
  misc_feature (3023)..(3023): n is a, c, g, or t
aaggtggactagacaaagttgtatctagacccttatcatatatgtgatttgcaaatattttgattgtgtgggttgtctttttacttttttaatagcgacctttgcagcacaaattctcattttgatgaagtcaaatgtatctaactttcatttggctgcttatgctttcagtgtcatctaggaaccatagcctaatcgaaggtcattaggatttgcacctttgttttcttctaatgattttataacattggctcttatttaggtctctgatacatctgctgtgaatttttatgtatggtacgaagtgggacgggggaggggtgtcccactttaatcttttgcacatggatgtccagttgttccagcaccatttgttgaaaaaactattctttcctcatgaactgtcgtcttgcctctgttgttgaaaatcagttgactgtaaatgtatggatttacttcagaactgttaattttattccattgagctatatctattatgctagtaccatacagtcttgatgactgcatctttgtaatatgttttgagattggaaagtgttcttgggctgagaaatgtaagaattttccatggtgtttgaccttgagattagatcattccagttcataagtatttgtatatgtcttagtcagttttgtattgcaataaaggaatacctgaggctgggtagtttatttaaaaaaaaaaaaataaagccaggccgcggtggctgatgcctgtaatcccagcactttgggaggccgagatgggcggatcacgaggtcaggagatcgagaccatcctggctaacacggtgaaaccctgtctctactaaaaatacataaacttagccgggtgtgctggcacgtgcctgtagttccagctacttgggaggcagaggcaggagaatcgcttgaacccaggaggtggaggttgcagtgagccgagatcgcgccactgcactccagcctgggcgacagagcaagactccatctcaaaaaaaaaaaaaaaagaagggggagaaagagagcaaggttaatttggctcatgtttctacaggctgtacaagaagcatggcgcaccagcctctgcaactagtgaggtctcaagcggcttccgctcgtggtggaaggtgaagggtagcctatgtgtgcaggtatcacagggtgagagaggaagcaaggagagggtgtgtgtcaggctcttttaaacagccagctcttacagcacctaataatacaggaagaactcacccctgaaggaaggtattgatctatttatgagggatccaccttcatgacccaaacccacctcccattaggcccccacctacaacattgggggatcatattttaatatcaggtttggggagacaaaccaaaccgtagcaatgcagctttatatttttacatatagtaaatgatggtgataatatcaatgacaggaaagacctcagttgggcattctttaataggagttgatcaccatcttggctttaaagaattttcattaactatactgtgctttcccttgactgaccaactgagaactcaaaccgtgttgatttttgctggtaagtatttgaattgttagttgacagtcaagccagtagctgtttgaaaaacctttctttgggacaactacaaaagcaaaaatataagtacctacaaatgcaaagaaaaatactactacctgaaatcctactgtatatggataaccactgttaatatttgatgaatgtgctttcacttagtggtctatgcaaatgcaattttacgtaaatgctgtcataccatacgtgctgtctttcaacctgcgccctcaagagaacatcattaatatatttgtcattaaatgtgggtctacttcattattttgatgacagcattaaaccactattgaactatactatttcatataatttcattaatagttttttactattgaaattttaagttgtttctagtttatactctcaccaacagaacgtgaattaaagtttcctcatacttgaggcaaancagagttttgtcacccttttaccatctttgctatactataagcaaaaaataagtttctgttgcatttcttttatgatgactgtagttgaatgtctttcattagtgtcctggccatgtgtatttcctagtgaattacttgcttatgactattgcctgttctttttttccttagtgatttatttttatatatttttagtgttagactgttaatatatgttgcaaatgtgtttctcagtttgccatttatcttggaatcttcatggcagtgtattttcttgtggtgtttttgggtattttgttgctgtccaatatttttgccttcttataaaagtaatcacacttttcaatctttgctgtatgtttttgaactttgtggtcatgcttagaaggattttacccatctcaagtttacataaactttcacttgtattttctcctggtacttttatatgtggttcatatttaaaaacatttaatccatccattataacagcagctttttaaaactgcagaactttttattctgcccaatatgtttgagagatttgtgtcttagcaagtggatttttgctttaaagtcccattgaactagtgctggaatnagaactaatagtgagatacagttttttgtattataatatttatgctcttcctccacatcttcatttggctggctctttctttgttcagacctctgcataaatctcacacctcagaaaggccgcctgtggccaccccatctttataaaatagcctctctctgatcattcngtctaaagaagaagaccacccccattgttctgcatcctgttccctgttaaacttcttagcacttagcactgcctacctcatcatgtttgtttccttgtttatcttatctcccttctcccactagaatgaggactcgatgaaagcgagatttttttctgtcttgttcattgcagtatcccagaacccagaaaagattctgacacaaaatagtcatctataaatatttaagtcantgactgaatatttagaaaattattgtggtattttttcagagtgttaacttcttttgaagtgttgtgtgaaagacatccattagtatctctgaaattatgaattaaaaagaaggcaataggctgggcgcagtggctcatgcctgtaatctcagtactttgggaggtaggaggatcacttgagcccaggagtgcaaaagcagcctgagcaacatagtgagaccccatccctataaaaaatttaaaaattagccaggcattggtggggcatgcctgtagtcccagctattctggaggctgagatgggaggatcacttgaacccaggaggttgaggctgcagtgagtcatgattgcgccactgcactccagcctgggcagcagaggaagatcttgtctcgaaaaaaaggcagtaggcgaatataattcaatataaaataaaactttgtggagtcatctaatgccagggacataggtggaccgcacctaatgatgatgaaaataagactattaatgaagcagttcacatcagccttttgatactatgcttttatcaagtttgtgtaaatgagattatgcaaataatagtgatggctctcactttgggaggccgagatgggcggatcacgaggtcaggagatcgagaccatcctggctaacacggtgaaaccctgtctctactaaaaatacataaacttagccgggtgtgctggcacgtgcctgtagttccagctacttgggaggcagaggcaggagaatcgcttgaacccaggaggtggaggttgcagtgagccgagatcgcgccactgcactccagcctgggcgacagagcaagactccatctc

SEQ ID NO: 253659 - DNA, 1361 bp, Homo sapiens
atggcagtacctcttcagtaacactgatactttgtggaggggttatgagagaattgcaggcagggccccagcacctagagcccatgggccagctgacccacaggaacaaacagagaatggcgttgagtggcagatgctgaggcacttggttcctggtgtggtctgcttcctcccgtgcatggagcagtgtgtgcattcacatggtgtgatccatatggccctcttcacacctaaatggtgggcaaatccgtcttcagtttctgacagtcactttggatttgcacagcaccagctcatagcagacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtgggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatgtaggaaccacacacggcaaggccagcccttctctggggccccatcaccagctaccccaactcagccccagttcttccttcaggattgactgtgggccaggcccaccttgaagattttggtctttcatccctgtcctgaattttctgactctgtgggggctgtgggcagagttctggacccaggaaatgaaaatatgaaatttattctaaactctactccaagctagctggtgacaacatgtagagaacctaacctctcgagggttcagattcctcatctgcagcatagagataataatgcaggatgatagcaatatccaaaaggaagaaagataaaggtctaactgaggaatcattatcaa

SEQ ID NO: 253660 - DNA, 1394 bp, Homo sapiens
aggagtcctcgtcagaggaggaggagatggaagaagaggaggaagaggaggagtttgggccggggatgcaggaggtgattgagcagcacaagttcgaagcccaccgctggctggcccggggcaaggaggacaacgaacttgtcgtggagttggtgccagctggcaagccgggtcctgagcgaaacacctatgaggttcaggtggtcacggggaatgtgcccaaggccggcactgatgctaacgtctacctaaccatctacggcgaggagtatggagacacgggcgaacgacccctgaagaagtcagacaagtccaacaaatttgagcaggggcagacagacaccttcaccatctatgccattgacctgggggccctgaccaagattcggattcgccacgacaacacaggcaacagagcaggctggttcctggacagaatagacattactgacatgaacaacgagatcacgtactactttccatgccaacgttggctggcagtggaggaagatgatggccagctgtccagggagctgttgccagtggatgagtcctatgtgctgccacagagcgaggagggtgggggaggcggtgacaacaaccccctcgacaacctggccctggagcagaaagataaatctaccacattctcagtgaccataaagactggggttaagaagaatgcgggcacagatgctaatgtcttcatcacactctttggcacacaggatgacactggaatgaccctcctgaagtcctccaagacaaacagcgataagtttgagagggacagcattgaaatcttcacggtggagacgctggatctgggagacctgtggaaagtccggcttggccatgacaacacaggcaaggccccaggctggtttgtagactgggtagaggtggatgccccatctcttgggaagtgcatgacgtttccctgtggccgctggctggccaaaaacgaagacgacgggtccatcatcagagacctcttccatgcagagcttcagacgaggctgtacacaccatgtaggaaccacacacggcaaggccagcccttctctggggccccatcaccagctaccccaactcagccccagttcttccttcaggattgactgtgggccaggcccaccttgaagattttggtctttcatccctgtcctgaattttctgactctgtgggggctgtgggcagagttctggacccaggaaatgaaaatatgaaatttattctaaactctactccaagctagctggtgacaacatgtagagaacctaacctctcgagggttcagattcctcatctgcagcatagagataataatgcaggatgatagcaatatccaaaaggaagaaagataaaggtctaactgaggaatcattatcaa

SEQ ID NO: 253661 - DNA, 575 bp, Homo sapiens
gaaatagattaagctctttcccactacacccagccgagatgcaaaaatcaatgcatgcaaactgcataagtcccataaaccattcccagttccatggatgctggccagaatgccccagaaaaagcagtgagcaacgctacagtaaaggagagtaagagatacttctgactctagggagaatccatgaaaaacacattttgagacagtcttcttccttttcctaccaagtgttaccatcaatgtcagtggcaacactgaagtgttaatgaaatttatgtttccttaatacaaaccccatcaaccactgcacgcctagctgctgccttttccctagcgtgagtattcctgccagtctcttcacacaggctgaggccaaaagtctccacccctgtaaagtgacagatgggacatcacattcctcagagaatgtgggtgaaaaagaacattaaaaaaaaaaaatctcttctccttaccccatgcacacctccctctgctgcctctaaaagtctagttactttttttttttccttgagacagagtctcactctgttgcccaggctggagtgcagtggtgc

SEQ ID NO: 253662 - DNA, 456 bp, Homo sapiens
aagaattgacataggggtggggccaccacaaaaagcctccactaaggctgtgcttggcagagtcataggagcaggcctaccctctgaccatagaccagtagagccactagagggcatttccagcctggcatgtggctctaatatgtaagtgctgtcatgtgggctgggactgggacacccagagccttgggggcccaacgcctgcccaagtgtgcctggaagattggaagatggggcatcaaaaggagattattctggagccttaagatttatcgtttactttgttgttgttgttgtagtattccttcctacttctcccttttggaatgggaatgtcgattctatgtctgtcccaccattgcattttggaagctctttacctatttgattcacagaatcacagatggagagcaatttctctcagaataaacataccttgagtctcacctaaaaaaa

SEQ ID NO: 253663 - DNA, 497 bp, Homo sapiens
accttcttcactcgatgtcattgctgtagagtgtacccaggatgggtatttcatattttgtttttagtttattaaattgatgagcaatgttttgtttttattttttccattacagacatgtggcaatgattggggaaggggctaaagtgatacacactgattgatagtatttgttacatctcatgggtacgggatgagtccttcagaataatttcctggccgggcgcggtggctcacgcctgtaatcccagcactttgggaggctgaggcaggtggatcacctgaggtcaggagtttgagaccagtctggccaacatggcaaaaccccatctctactgaaaatacaaaaattagccaggcgaggtggcagatgcctgtaatcccagcctcaggcggctgaggcatgagaatcgcttgaacccgggaggcggagtttgcagtgagccgagattgcgccattgcactccagcctggtgacagagtgagactccatctca

SEQ ID NO: 253664 - DNA, 633 bp, Homo sapiens
  misc_feature (573)..(573): n is a, c, g, or t
  misc_feature (614)..(614): n is a, c, g, or t
aagagtcagttttttttctcctgtaaagtaagtccagtctcaacaatttaggtgccatagaattacaagattctcatttattgaggcttctgttttggtacaaactagaacaaattgtagaatttataaacaatttgtttttacatctttttgtcttttttttttttttcattttgattgttaaactatcagtctttcaagggccagaatgtaatttaaaaacagctgtatttgaagccaggtgcagtggctcacacctgtaatcctgatgctttgggaggctgaggtggagaaatcacttgaggctagcagtttgagactagcctggggaacatagtgagaccctgcctctacaaaaaaattttaaaaattagctaggcatggtggtgcatgcctgtagtcccagccactcaggaggctgatgcgggaggatcgcttgagcccaggaggttgaggctgtagtgagctatgatggcaccattgcactccagcctgggtgacagagcaagaccctgtctcttaaaaaaaaagatagatggatggatagatagatagataatgttatttgaattntttttttttttctttttttttttttttttttggtttttttnttttttttttttttttttc

SEQ ID NO: 253665 - DNA, 337 bp, Homo sapiens
  misc_feature (182)..(182): n is a, c, g, or t
  misc_feature (249)..(249): n is a, c, g, or t
  misc_feature (304)..(304): n is a, c, g, or t
tgggattatggtgctgctgtcccttagacaaggtcacaggaggtgggacatgctggtaggccacatggagagtcagggaggcctgtcaagtttctggtgtctccagtccctaacggttgagttgcagatacagagccaacattcagctttgaagacagatcccggctttgaagacagacccnagggtaatcatgaggacaggggatgagaaggctgtgaccaaacatgtgagcatgcaggagttcagancaagggcagggcacaggcaggggaaggaagagcttcaaggagacaggaagggtcnttgtgtgctaaacctgatgcagagggaaggggg

SEQ ID NO: 253666 - DNA, 466 bp, Homo sapiens
aacacgctctcaaaattcactccaggcatttgcgttttgactccatgcatccccatcaaacagttcttagcctacagtcctgacggaggcccatctgagcagccatcttattctcaatgtctagctaacccctcctttcttctcactcagttattgccaaaatagaaaaatcgccatgtgcacgtactgtacgtggctgtggatacacaggcttcaaatgaatacattgaagttaacacattctttaatgtgggatgtcccaaatatttctttttaaatttgtacatattttgttttactaatagtttatttgatttattaagatgctatttactgagaacagcaatttctaggacatattgggaacgaagagtatagccatcttgttttatctgagctgtgggtccctgctcttgcagagagatgtggaactgggtcttgctgtgagatcttgtgaagtcaccgc

SEQ ID NO: 253667 - DNA, 459 bp, Homo sapiens
gcccatcgggatcactggtatgttctggaagctctgccgggaaagctcataagggctcaggtgctcttttctggggcccctttttatctagaaagtggcttctcttaaaggccagttatcaacttgctttcattgttggcacaaaagaattacagtgaggaacctcaagcccttgatctaaatgacaatttcttctctatttaaaatgtgtgtggttgatatcaactgacaccaacccaccgtctctttctccctgggttcacttcttcatgctgtttgtaggggtgactccacaccccgcacagaaggagcagagcctcacatctgctttgaacactctgtggacctggtggcactgattctgtcttaccagcccactgaacacaaaggaagagggttgcagcactccataggttaatttggaatccttttttgttaacaacaaatcttgtaaaagta

SEQ ID NO: 253668 - DNA, 683 bp, Homo sapiens
tactattatcccatattgttgaatagaaaattgaggcatagagtggttgaataacttgtcttggatcacagagctaacaagtgttaaagccacatcttgaaggtcagagcaagtactcttactcatcacaccctactcccctgcttccattccctatctcccttactgatgtttgagaaaattattagcctttctggttacacaatgcctcttgagcagaggatctcaaggtatcaggttgtgtcttgaaggctagagttgtactgtaattccaacccagaaaagccttcccagatcttatttagtcaacaaaattatactacctctacagatgaggcctatcattatatgagggtattatattatcatattaatagttgcttccaaatttatcaacccaatttttaatataaaaaagccaatagtgtctggcattaaaaccaatggagaaaccatactccaaggtcttcaccaagtgacttaatctattgataatcagcatgggagtaatccatggtgcaacatatctgcttgctcatcaagtgttttaagataaaagatttggctgggcgcagtggttcatgcctataatcccagcactttgggaggccaaggtgggtggatcatgaggtcaggagatcaagaccatcgtggccaacatggcgaaatcccttgtctattaa

SEQ ID NO: 253669 - DNA, 625 bp, Homo sapiens
agtgactcagagagatgggggcagacgctgagatgagggttggccaggcaggaaggaaggtgagaaggtctcatggcctcacgtgccagtagggctgggccaccacgtgtgggagggaggacacccaggcaccaggccatggtcatgacacgggtctctttgtccctcccggtctgccaacctcctgagtcactcctgacggagatgactgatccatccctggcccgcctcccaccctgtccctgggacagtgcctggggcaggcagctccattatcctccttgatgaaagagctcccagccagcactggccactccagagcctcctccccaggtgggtgatcatgcagggctgggctcttgcgactggccgggggtagagatgcaccgcactgctgagaagtgctttctaggagttcaagaccagcctgggcaacacagcagacattgtatgtagaaaaaaaaatgtttaaaaataagctgggcacagtagtgcatgcctgtcatcccagctactcaagaggctgaagcaggaggaccacttgagcccaggagtttgaatctgcagtgagctatgagtgcaccactgcatgccagcctgggcaacagagtaagactcagtcact

SEQ ID NO: 253670 - DNA, 472 bp, Homo sapiens
agaccggagatctttaacctaacctaacattccttaaggcatcggtgccctcccactcaaagtcagcctgggttttgtttctaagggtcgccaataaataggtttcacgggcatttaaggctctgggagtctttttctgtctgttacaggtagcccggctcttaaaaacgatcacacacaacgttcacaagcatgtgcacattcatacacacgtgtgcacatatacatgcccacatgcgacacacgcgtacatcatacagcatgcacgtgtccataaatgagctcacacggacagccatgtcccgcgcccaggcccccagcgacacaggccccaagcagggcctccacctgtgtggagggagcggctcagacggggaagccccagcgccttgcaatgttcacctcaccggcggcttctggcgtggccacggctccttccttttctggtaataaataccagatttggggaaac

SEQ ID NO: 253671 - DNA, 210 bp, Homo sapiens
tgtgctgtcggcttcggagaagatgaggcacctgcgggtttgagccatatctctggggtgctctatcacccctggtgctcttggtggggggtataagaggtgaggggagatgcacagtgccccaggacagaccgcgcacagcccccagctgctctttgaatggctgaggctaaactgctttgatttgctttcttaggaaggaacaaaaaa

SEQ ID NO: 253672 - DNA, 695 bp, Homo sapiens
tctccccagggccctattcttcccccaacccaagtggactttggggcacccagttaaaagtggccctcctaaggggaacctttccaaattgccccgagaagaaaaaactatttccaggttttttcttataggggaattgagtttttaatttctttttcttttcttttttttttttttcaggcttaattcactttatttttcttgtataaaaaccctatgttgtagccacagctggagcctggatcctctgcgcggagactctggtgtgggtcttgacgaggtggtcagtgaattcctgatagggagacttggtgaatacagtctccttccagaggtcgggggtcaggtagcagtaggtcttagagatggcatcaaagtgggtagggccacactttctttccgacccaatcaaagcccaagatttcttctgttcactcttcccggcttccattcttgccctcttcagtccactctctccactgagaccagagtcatttctctaacatgcaaatctgatagctccaaagcacaaggcccacttggagcacagggccctgtgtgatctagctaaagccttctctcccatagttccctcacatcagtgttccctcgttcctgcctttgtacatgttttggtccttttgtcttggcagataatcttcaaaaactgaacttgaatcacccccaaaacccac

SEQ ID NO: 253673 - DNA, 268 bp, Homo sapiens
gccaatatgcatggaaaataacaaacaaatgaaccaacccaaagaaagcacacaaaaagaataagcatttgtctgtaactcttactgtaagttcgtaatataccatagttgtacattttattcttatcctcttgctctaaggttataatgtcttttcagagtactaaagattcctgaaataaaattcacttgtaatgaagtgcaataaaaactgactacacatttacttttgtaaacattctaaaatttaaattactacgtatggcca

SEQ ID NO: 253674 - DNA, 1314 bp, Homo sapiens
ggatctgaggcctgcggtgggccttggtcccttctctccccgccccgaagccgcctgctcaacctgagggccaccggcctctatccgtcggtgccgatgctccttgcttcccagccagagcgtctcatctctgggcccggagccccaggctcgttctcctcagcccctgccggcggcggcgctcttgcagccattcctgtgaggtcgtttttcggagcagccgggccggccgaggagtaagtaggcgccagagttctagctcgggcatctgcctcggggccctgtcgccgccgcgccccggatcctgcgttggtcctgtccgataaagcggaggtcggccctgcttgctgacgagaccgtaaaaaccacggcgcttggcgccctgccgccgccacaccacaccaaagtgtacctgcccgaggctggcttcgggcgcgagcttgcatttgtgactttctcttaccgtctttgtttgcttcgttttaagtattacttccagataagggacacattctcgaaatactttgaaaacagttttgaattttgttcctcccgttgaaacggattaaatttggacctttcaagctacactgtgcaatcatcaatctcaataagctcttaataggctcattcttccgtaggctacaaacaaaataaagatcataacatcctgcggaggaagccattggtccatgtagagtcgccagatgtcaattaagagtagatcgcttttcagagaatacttaacgactctggtttagacctagacttggaactttgaggtgtttggaacactgggcagaattttcctttgttacaaaacaaagtttatgagaacgtaatttgtttttgttgtttttgttgttagtattgaagcaattttggtgcaaaccaaaggataacaaagcaaaacaatgaaaatcacccagagttccattacccacactgaaccaacttgaatatattggtttattttggcttttttccatatgaaatgttaaattttcttgtactcacgtgtagaatatgatagtttgctctttcatgtaacatgtctcccaatttttacatacataattctagtttcagtaagcatttttataactacactctttttcctttgttattgtatgtctaggttatttcaactttgcactgttgcttgtaactactatgtgatgaggcagtagctagattagtatttagaacgtgagcattcaagtcaggcagacctgggcttcacaacttactgtgcaatttcaaagagtttaacttttttgagcctcattttacacagtaacatggggataatgg

SEQ ID NO: 253675 - DNA, 652 bp, Homo sapiens
attttccaccttcctgtacaaaaccagaatcctctcacctggcagaaatctttctctccagatgctgcaaagccagcacagatcatcttctctgtgatccctcctggatgggcagaataaaagaagaggggctgaagcggatgctgcttgatatcatttacatgacctattttcaaaaataacaactggcattaatgtttatgcaacaaaaatatgcttacctgcactgatgcttccccatccggtcacagcacagatctccgaggaaaatagaggctctgcgctgtgtgggagacatactggcctcaccaccgagttgtactccagaggaaagcttagttgtattagggcaatgtcagagtcataacttagtgtgttaaagtcttcatgcactattatgtgtttggcccttctcacctgtatcggtggcaagtaagcaaattacaacgtaagaaagtcaaagaatccagcaacttccttgttgatggtccaaaataatcctaaatttctgcacttacatacataaacaatgcagaagactttctattaaatttaaaagagcaatattggtttacaatttgcagggggctatgaaccaccttctggataaaggtggtgctggagaaataaagctttgaaaacctgaaaacat

SEQ ID NO: 253676 - DNA, 2781 bp, Homo sapiens
tgagtgcaatggtgcgatcttggctcactgcaacctgcacctcccaggtgcaagcgattctcctgcctcagcctccggagtagctgggattacaggcgcccgccaccacgcccagttaatttttgtatttttagtagagatgggggttttgccatgttggtcaggctgatctcgaactcctgacctcaggtgatctgcccgccttggcctcccaaagtgctgggattacaggcatgagccgccacgctggcccggtctggaaatcttatctaaaaagtagcaagtgctggaaaaagggcctggggggcgggggtggttcttgtcgaagcccccaggctcctgtctcagggatgaatgtggcgtctcattgggattcttctcttgcccgaaagggctgcttttgaggactatcaatactggggagtgggggtgaagccggacctcactcagggtgaggatttcagggccccggcatcctgaacaccccccacaccccaacattctcctcgctctgtcccttcctcttctcccaaccccttttgtgctggggctgcgagctccccgagttctgcggtgactaaatcgaggccgagaagggaggctgccccccaccaccctgtgggtcagtacccctccccctggcttggagaaagtggggtcaccgcagctgagctggggggttattttggctggagctgctggagcagaaaggctgggtctgaaatgcccagcagggtctggggacttcgttggacccgcgtggtgttgggcggggctgtcgtgtcctacacgggagctctgggctttcatttctcttggggtgcagtggggattaactcagctattcccagggtaagcctgggtctctaattgggccctgggagccctgttaggccaccggcatgggggcttggtgaggaaggggactccccagctccccccactcccaaccacctccccattgccttggagacccctggggagggggctggggggcttctgagcccctgagtctaggttcactttcccgtcgggctgtgggaggggactgtcactttcctgtgtctttggggaggggacccccacttccttctcggatctcagggccgtggacacacaccccctttccaggagggggtggtgggcgtctaggttttccttgtcccttcctggggccagcaccgtagcagcacaatcaccccgggaagggggtgtctgtttgcctccagacacaatcgggccccactcgcagaaccacctggactctgtccgtgtctgtcccccggcctccagggctcctctcccgggacccccgtcccacgcctgggccccgcgccgggggaagcgcctgctgcctatctctgtctacctcaggtctgacttttgatgccaaaatctgagcccctggggtgcctctcccccgcctcccgtgcaccagggtctgcagcagccactggggcctggctgcctgctgcatctggcggccctggacccctggggcccccgtgcacctgcccacctcggagcctggggaggggctgtgcagggtcgagggctgggtcgtctccctcgggctgcgtgtgcgtgtcgggaatcctgcgtgtcgtgtctgtgggcgatccggcctcccggcggtgggtggacctggattctaactcagaggacttgagcctgctgttaactccgatgattgtagggacaggcggggtgggtggggggtgggcgcgaggctgggtcccggcccaggagaaggaagtcgctgaaggcagtggccatgctggccgtggaaatgggaggcggttgcagagggtctatggggcccggtcctggatactcggcaggaagccgtgtctgcagaggctcctccctgcctcaggtggccccgttcaaccccagccgtgcccatctcctgccaccgcctgtcggtgggggtttaaattcggtgtggctttctggggtgcagctcagcacccccccttatgcagactgggagggggtcgggcagtcccctcagccacgaggaccctggatgggttctagttcacttgggaccgtggggcctggctgcgtactgagtgggtgccccacagtcaaggccaacgggggctccccctgctctgagatgttgggagaaaggcggcttctggaaccttccgtgggacccgtaagtggctgtccagaaaggcgggagggtgggcacggggcacggggggcagctggggtcgttgttaagggtcacgcatctgtacagttgaatttcctttctcttatcatgttttacccaccttgtcccttttttccccaattgtgcttttgcatttttttccttggcaaatgtaaactcagcctttcattcatgacgtgtgaaatttcagtttctctggagtttgtcagacggcgtgggaaccacgcctgaaactcaggtaataggaggaaaaaaaaaaaaacttaaaaaaatttttaaaaaacataaaactactctctacctctggctgggcccagcctgtctcgccctggccgcggcagggtggcctgtaacaatttcagttttcgcagaacattcaggtattaaaaggaaaaaaaaaaaaaaagacaaaaagaccaaaaaaaaaaaaagtgtgattttgaaatttaaaagaacactgaaagtttacattttatagtaacattattatgcagattgtatttaaacttcagaaatatttaagacgattgtaaccctgtaaagctgatgagatattaaaacgagacaaaacacttctgacttttaacaaaaaaaag

SEQ ID NO: 253677 - DNA, 2498 bp, Homo sapiens
cagcctgcagtgaggtgtagaccaccttaccatcaggctgcggagaacagaggctcctgtctcagggatgaatgtggcgtctcattgggattcttctcttgcccgaaagggctgcttttgaggactatcaatactggggagtgggggtgaagccggacctcactcagggtgaggatttcagggccccggcatcctgaacaccccccacaccccaacattctcctcgctctgtcccttcctcttctcccaaccccttttgtgctggggctgcgagctccccgagttctgcggtgactaaatcgaggccgagaagggaggctgccccccaccaccctgtgggtcagtacccctccccctggcttggagaaagtggggtcaccgcagctgagctggggggttattttggctggagctgctggagcagaaaggctgggtctgaaatgcccagcagggtctggggacttcgttggacccgcgtggtgttgggcggggctgtcgtgtcctacacgggagctctgggctttcatttctcttggggtgcagtggggattaactcagctattcccagggtaagcctgggtctctaattgggccctgggagccctgttaggccaccggcatgggggcttggtgaggaaggggactccccagctccccccactcccaaccacctccccattgccttggagacccctggggagggggctggggggcttctgagcccctgagtctaggttcactttcccgtcgggctgtgggaggggactgtcactttcctgtgtctttggggaggggacccccacttccttctcggatctcagggccgtggacacacaccccctttccaggagggggtggtgggcgtctaggttttccttgtcccttcctggggccagcaccgtagcagcacaatcaccccgggaagggggtgtctgtttgcctccagacacaatcgggccccactcgcagaaccacctggactctgtccgtgtctgtcccccggcctccagggctcctctcccgggacccccgtcccacgcctgggccccgcgccgggggaagcgcctgctgcctatctctgtctacctcaggtctgacttttgatgccaaaatctgagcccctggggtgcctctcccccgcctcccgtgcaccagggtctgcagcagccactggggcctggctgcctgctgcatctggcggccctggacccctggggcccccgtgcacctgcccacctcggagcctggggaggggctgtgcagggtcgagggctgggtcgtctccctcgggctgcgtgtgcgtgtcgggaatcctgcgtgtcgtgtctgtgggcgatccggcctcccggcggtgggtggacctggattctaactcagaggacttgagcctgctgttaactccgatgattgtagggacaggcggggtgggtggggggtgggcgcgaggctgggtcccggcccaggagaaggaagtcgctgaaggcagtggccatgctggccgtggaaatgggaggcggttgcagagggtctatggggcccggtcctggatactcggcaggaagccgtgtctgcagaggctcctccctgcctcaggtggccccgttcaaccccagccgtgcccatctcctgccaccgcctgtcggtgggggtttaaattcggtgtggctttctggggtgcagctcagcacccccccttatgcagactgggagggggtcgggcagtcccctcagccacgaggaccctggatgggttctagttcacttgggaccgtggggcctggctgcgtactgagtgggtgccccacagtcaaggccaacgggggctccccctgctctgagatgttgggagaaaggcggcttctggaaccttccgtgggacccgtaagtggctgtccagaaaggcgggagggtgggcacggggcacggggggcagctggggtcgttgttaagggtcacgcatctgtacagttgaatttcctttctcttatcatgttttacccaccttgtcccttttttccccaattgtgcttttgcatttttttccttggcaaatgtaaactcagcctttcattcatgacgtgtgaaatttcagtttctctggagtttgtcagacggcgtgggaaccacgcctgaaactcaggtaataggaggaaaaaaaaaaaaacttaaaaaaatttttaaaaaacataaaactactctctacctctggctgggcccagcctgtctcgccctggccgcggcagggtggcctgtaacaatttcagttttcgcagaacattcaggtattaaaaggaaaaaaaaaaaaaaagacaaaaagaccaaaaaaaaaaaaagtgtgattttgaaatttaaaagaacactgaaagtttacattttatagtaacattattatgcagattgtatttaaacttcagaaatatttaagacgattgtaaccctgtaaagctgatgagatattaaaacgagacaaaacacttctgacttttaacaaaaaaaag

SEQ ID NO: 253678 - DNA, 2624 bp, Homo sapiens
tgagtgcaatggtgcgatcttggctcactgcaacctgcacctcccaggtgcaagcgattctcctgcctcagcctccggagtagctgggattacaggcgcccgccaccacgcccagttaatttttgtatttttagtagagatgggggttttgccatgttggtcaggctgatctcgaactcctgacctcaggtgatctgcccgccttggcctcccaaagtgctgggattacaggcatgagccgccacgctggcccggtctggaaatcttatctaaaaagtagcaagtgctggaaaaagggcctggggggcgggggtggttcttgtcgaagcccccaggctcctgtctcagggatgaatgtggcgtctcattgggattcttctcttgcccgaaagggctgcttttgaggactatcaatactggggagtgggggtgaagccggacctcactcagggtgaggatttcagggccccggcatcctgaacaccccccacaccccaacattctcctcgctctgtcccttcctcttctcccaaccccttttgtgctggggctgcgagctccccgagttctgcggtgactaaatcgaggccgagaagggaggctgccccccaccaccctgtgggtcagtacccctccccctggcttggagaaagtggggtcaccgcagctgagctggggggttattttggctggagctgctggagcagaaaggctgggtctgaaatgcccagcagggtctggggacttcgttggacccgcgtggtgttgggcggggctgtcgtgtcctacacgggagctctgggctttcatttctcttggggtgcagtggggattaactcagctattcccagggtaagcctgggtctctaattgggccctgggagccctgttaggccaccggcatgggggcttggtgaggaaggggactccccagctccccccactcccaaccacctccccattgccttggagacccctggggagggggctggggggcttctgagcccctgagtctaggttcactttcccgtcgggctgtgggaggggactgtcactttcctgtgtctttggggaggggacccccacttccttctcggatctcagggccgtggacacacaccccctttccaggagggggtggtgggcgtctaggttttccttgtcccttcctggggccagcaccgtagcagcacaatcaccccgggaagggggtgtctgtttgcctccagacacaatcgggccccactcgcagaaccacctggactctgtccgtgtctgtcccccggcctccagggctcctctcccgggacccccgtcccacgcctgggccccgcgccgggggaagcgcctgctgcctatctctgtctacctcaggtctgacttttgatgccaaaatctgagcccctggggtgcctctcccccgcctcccgtgcaccagggtctgcagcagccactggggcctggctgcctgctgcatctggcggccctggacccctggggcccccgtgcacctgcccacctcggagcctggggaggggctgtgcagggtcgagggctgggtcgtctccctcgggctgcgtgtgcgtgtcgggaatcctgcgtgtcgtgtctgtgggcgatccggcctcccggcggtgggtggacctggattctaactcagaggacttgagcctgctgttaactccgatgattgtagggacaggcggggtgggtggggggtgggcgcgaggctgggtcccggcccaggagaaggaagtcgctgaaggcagtggccatgctggccgtggaaatgggaggcggttgcagagggtctatggggcccggtcctggatactcggcaggaagccgtgtctgcagaggctcctccctgcctcaggtggccccgttcaaccccagccgtgcccatctcctgccaccgcctgtcggtgggggtttaaattcggtgtggctttctggggtgcagctcagcacccccccttatgcagactgggagggggtcgggcagtcccctcagccacgaggaccctggatgggttctagttcacttgggaccgtggggcctggctgcgtactgagtgggtgccccacagtcaaggccaacgggggctccccctgctctgagatgttgggagaaaggcggcttctggaaccttccgtgggacccgtaagtggctgtccagaaaggcgggagggtgggcacggggcacggggggcagctggggtcgttgttaagggtcacgcatctgtacagttgaatttcctttctcttatcatgttttacccaccttgtcccttttttccccaattgtgcttttgcatttttttccttggcaaatgtaaactcagcctttcattcatgacgtgtgaaatttcagtttctctggagtttgtcagacggcgtgggaaccacgcctgaaactcaggtaataggaggaaaaaaaaaaaaacttgccctttaaaaaagaaaactctagggggggcccgtgtcccaaggagtcctatggggagtaagataacgcgcgcttactgaccgtcaatttacagcgattagaactgtaacaccctggcgttacccaacataattgccttgcattgcattcaacttgcgtctggtggagaaagac

SEQ ID NO: 253679 - DNA, 1485 bp, Homo sapiens
tgagtgcaatggtgcgatcttggctcactgcaacctgcacctcccaggtgcaagcgattctcctgcctcagcctccggagtagctgggattacaggcgcccgccaccacgcccagttaatttttgtatttttagtagagatgggggttttgccatgttggtcaggctgatctcgaactcctgacctcaggtgatctgcccgccttggcctcccaaagtgctgggattacaggcatgagccgccacgctggcccggtctggaaatcttatctaaaaagtagcaagtgctggaaaaagggcctggggggcgggggtggttcttgtcgaagcccccaggctcctgtctcagggatgaatgtggcgtctcattgggattcttctcttgcccgaaagggctgcttttgaggactatcaatactggggagtgggggtgaagccggacctcactcagggtgaggatttcagggccccggcatcctgaacaccccccacaccccaacattctcctcgctctgtcccttcctcttctcccaaccccttttgtgctggggctgcgagctccccgagttctgcggtgactaaatcgaggccgagaagggaggctgccccccaccaccctgtgggtcagtacccctccccctggcttggagaaagtggggtcaccgcagctgagctggggggttattttggctggagctgctggagcagaaaggctgggtctgaaatgcccagcagggtctggggacttcgttggacccgcgtggtgttgggcggggctgtcgtgtcctacacgggagctctgggctttcatttctcttggggtgcagtggggattaactcagctattcccagggtaagcctgggtctctaattgggccctgggagccctgttaggccaccggcatgggggcttggtgaggaaggggatcgttgttaagggtcacgcatctgtacagttgaatttcctttctcttatcatgttttacccaccttgtcccttttttccccaattgtgcttttgcatttttttccttggcaaatgtaaactcagcctttcattcatgacgtgtgaaatttcagtttctctggagtttgtcagacggcgtgggaaccacgcctgaaactcaggtaataggaggaaaaaaaaaaaaacttaaaaaaatttttaaaaaacataaaactactctctacctctggctgggcccagcctgtctcgccctggccgcggcagggtggcctgtaacaatttcagttttcgcagaacattcaggtattaaaaggaaaaaaaaaaaaaaagacaaaaagaccaaaaaaaaaaaaagtgtgattttgaaatttaaaagaacactgaaagtttacattttatagtaacattattatgcagattgtatttaaacttcagaaatatttaagacgattgtaaccctgtaaagctgatgagatattaaaacgagacaaaacacttctgacttttaacaaaaaaaag

SEQ ID NO: 253680 - DNA, 435 bp, Homo sapiens
ttctccccaaattgacgtttagatacaattcaattccaatcaatagctcaacaagattttttaaaaagagtttgacaagctgaggctaaaatttacatgggtgagcaaaggggtaaagaaagccaagacactcttgtagaaattaataagaaggatggacttgtcctgtcaagtatcaaatcttattataaagatatgaaactaaaatgcgtggtgttggcacaagaataaacaaaacgaccaaaggaacagactagagagtccactggggaaactattcaataaatggtgcagggaccacatggaataaagatgaaattagtttcctgcctcctatgcatacaaatgtatacatcaatttccgatggataaaagccaaatgtaaaaagctttgtggagaaaatatagactatccttatgacttcaggatagaga

SEQ ID NO: 253681 - DNA, 259 bp, Homo sapiens
aaaccattattttccaaatgacccaatgcataatgttacacagtcttgcatgggtaaaagatccatttacagtataaaacagaccattggatcttactgtaacagtacaaaaaattcatcgatgcagattgagtcaacagtggaacttacctttaagaaattgctgtttccagcacttggggaggctgaggcaggaggactgcttgagccccaggagttcataaccagcctgagtaacatagcaagaccccatctcaaa

SEQ ID NO: 253682 - DNA, 469 bp, Homo sapiens
tccagatttccctcttcttatacggataccaggaatactggagttaggccccacccccatgcagtgtgacctcatcacaacctgatacatctgaaatgacccaaataagctcacactcacaagtaccagggatgaggacgcgaacgtatctttctctttttttttttaagggacaccggaaatagggccttattcccggtgtcctaaggctgggctcgactgctgcaggagtctcaggcagccttctacaattgctagagtgactcatttaccacctttaaaccctaggatacttgcaacaaagcaggactctttcctccagggaatgtgccgatttcagatgacacagcacccatggcagaaaacgctggaatttctcctgggaactcgacggtgatgagaggtgcttgacttgaccatttgctatatgtctctcttttttttttaagggacccgggaattagggggg

SEQ ID NO: 253683 - DNA, 4756 bp, Homo sapiens
  misc_feature (781)..(781): n is a, c, g, or t
  misc_feature (817)..(817): n is a, c, g, or t
  misc_feature (1092)..(1092): n is a, c, g, or t
  misc_feature (1965)..(1965): n is a, c, g, or t
  misc_feature (2446)..(2446): n is a, c, g, or t
  misc_feature (2793)..(2793): n is a, c, g, or t
  misc_feature (3006)..(3006): n is a, c, g, or t
  misc_feature (4037)..(4037): n is a, c, g, or t
tgaagcttttaattttttattgttcaatctgtctctcttttccattgtaatttctcgcttttgtgtcatgcttagaaagcctttttcaacttcagtttatgtctttatccggaatttatttttggttatgtgaaatgagattttttttcagccatatagctagttgtttcagtgcttttttttttttcgaatggtcagttctttgcacagtgatgtaaaagctaccctttatcatcagctaaatgtctatatgtctttttctactctactgatctatttctatatcaatgtcacagtattttaatgattatagattttaatgtttttctcttactgatatagggaattctaattagtttttcctttcaaaaggtatttggccttttattcatttggaaaagtaaatacattaataaaaggccaaatacaggattttgtcagttgccttttcagcatgtactgatataatcattttgtttttaccttttaatctcttaatacagtgtcataatgatgttgtattaaaatatttattcatttctcccaagtcacaaaagtaaagccaggaaacttaaatatagcaggtcattgaaaatacaaatttgttctttgcagtattcttaaagccttagaattttttgtgttttgtcatccagcataccgaccttgtgctcatctttttactctgcttatctactttcattttacaaaacatcattttggaatttcccaagatacttaaatttttattatttattaactatgtgcagaaaaacttggngtctctcttcatgccagctaattacactactgctgnaaaatgaagatgcaattagggaaagcaaggcagcaacttactaccatttattctatgctgtagtcagatgatgatggtgaactctgattttgttataaatgactgtagatctttgataaacctttgatgttactgttgttgaattaatttctcctgtcttacagcggcctctgttgaccccaaaccttaagatctttttagcgtatgagaccttaataaatgatagaagaagaaaaaaaattgtgtttgcaattttgtgatttttttaacatatngactcacagattatataagcttcaggtcccacaacacatgagtctgcctctgggtgtaaggggtgaagagtgggggttttatttaccccagttcttgcccacaattgtgctatcactgctagaaagctgatctctatgatggggagccaatcgttgtttactttactttcagtaattaaagttaatttaatctacttgattaaaattttatctcatatcctatttaactccacccccaaccccaccatggagtaggagatagccagccagttctttcactcctccacccctgctctaccctcttcaacttctaacccttctggcattggagtagggagacaggattggagaaaaggtgttctggtctgatgccacagtttttacttagccagacatgaaattacaagcccctgttggttattgttgcttctctagctaacattggccgtgaatttgaatgccttctgcgtgtgttccagtgctggttctgttacaggtagaagggtgcaaactcttcagaggggcccataggaagcttccctactgaatagttctttggtgttggagatccagcatccacgatatagacctggttctcttttttggtgtctacttagctcatagtaatcaactatatctttcctttgcattcttgttcttccagtcagcaaggttacaggctgctccactgcagcaccttgttcagggttttattttaccagggctgctataacaaagaaccactgactgggtggcttagacaacagaaatgtattgtttcacagttctggaagttagaaggtgtcaacggggttgtttccttctgagggctgtgagaacgaatctgttgcatgccttttcacctcgcttccngtgggttgctggcaatgtttggtgttccttggtttgtaggtatgggtgggaagaaaataatagagttttatccctttggtttttatctgaaataaggaaaagtgtacttcactaatatttgctttatagatttggagcccatgtatgtcatttatgaataaatatactagagatatgaagttaaattttctattgatataatatttaagaagtatagaccatgagcttcttgagaacaaatctttttctaatttgtctctatattccacaaatgtgatgtattttattgtaatgttaatgaatttctgaggtagataataatgtagttctgtaaaatagttctgccatttaaactcatttaagatcaaatagggcatgctttacatatctgttgatgcaactgttttgtccaactacagccgaatttacaacagattcaaatactaaccagaaggaaattaatgagttgattgtggtattnttttttcaatcagaagtgttttctggatacatctagatacagtgttgtaacaatccaggtgataaatgtattgaacattttttataattgtggtttttaatgtaaaaaaagaaaggtatgaaaacccttgacttttttttgagttgccaaaacatttctgtaataatgtatacattctccatagctattagtacccgttagctttttttaattgaacagttggcccttcatatctctgggttctgcatatgtgtggattcaaccaaccatggatcaaaaatattcttaaaaaaattgcatctgtactgaacatgtacagacttttgttctcatcactattccctaantaatatagtgtaataactatttacataggatttacattgtattaggtattacaagtaatctagagatgatttaaagtacatggaaggttatgcataggttatatacaaatactgtgccctcttttatcagggatttaagcatccatggattttgatgtctgtaggaggtcctggaaccaatcccccatggataccgagagattactgtgtatnacttaaggtctataacatgatgttttgatatacatagtgaaatgattactacagtccagcaaattaacatatctgttatctcatatacttctctccctccctccttccttctctccctccctccctccctctcttcccttctcttttccttcatagtaagagtatctaaaatctactcccttggaaatttccagtataaaatattattaaccatagtcctcatgttgtacactagatctctagatttagcctacatagctgcaaactttataccctttgacctaattcttcccattttctctgccccaggtaaccagtattctgctctttgttgctatctgtgtatttgttgttgcattttttggtttttcattatgttttttttttaattccacatataagtgagatcatgcagtgtttttctctgtgtgtctggcgtatttcacttagcataatgtcctctaagttcattaatgttttgcaaatggcaggatctctctctttttcaaggatgaatatttcattacatacacacacacccacatcatagtttctttattcgtcaacaggcacttcagttgcttccataacttgtattgtgaataatgttgcaatgaatatgggaatgcagatttttttaataagattgtgatttcatttcctttgagtagatactcagaagaggcgggattgcagggtcatattactagttctatttttaattccttaagaaacctccatactgttttccacacgggctgcacaaatctgcatttccaccaacagtgtacaagggttcccttttcctcccactcttactaacacttgttatctcttgtttttttgataatagccatcctaaaaggggtgaggtgatatcttattgtggttttgattttcattttcctgatgattagtgatgttgagcatcttttcatatacctgttggccatttttatgtcttttgagaaatgtttattcaggttctttgcccattttttaattaggttattcaattttttggcattgcntcgttatatatttttgatattaaccccttatcagatacatggtttgcagatattttctcctaatgcgtaggcctccttttcattttgttgattgtttcctttgctgtgcaaaaaaaggctattaacttttatccggtaccacacgtccaaagttagatttaaattaacatagttttcattgtaaaattagcaatggtaaatttgtcgaagcattaaacagcctcattaaatgttcataggagcaaataaccatgtcaaataccctgttcagatatggaaaaattttgctcatttaacaaatattaagcacttactatgtgcccagcattgactaatgttcagtgaaatccttttgttaagagattcttttgaaaaacaatcagactataaatattatttattggtggaaaagagtaaaacatctatatgctataaaaaggccgggtgcggtggctcacgcctgtaatcccagcactttgggaggctgaggcgggcggatcacgaggtcaggagattgagaccatcctggctaacacggtgaaaccccatctctactaaaaatacaaaaaattagcggggccaggtggcaggcacctgtagtcccagctactcgggaggctgaggcaggagaatggtgtgaacctgggaggtggagcttgcagtgagccgagatcgcgccactgcactccagcctgggtgacagagcgagactccatctc

SEQ ID NO: 253684 - DNA, 388 bp, Homo sapiens
cagagataaccaaataagcaaagagaaaagaatgaactagatgaaagtatggaactgtgtactgcattaactctcttaaagtaatattatttttagtctcctacccatcttttactggcaggttagggcagtatcatatatcaggttgataaagccaaataagaatataaatggaaaccatttttttctgttaaaaagaaaaaagaaaaaaggaaaaagtccagccctatgctttatatgaactctgtatattttataaaaataattatttcatattactaattatatcactgtttaaggtattctttttaaaaaaattagttatgctacatgtattaaatttttatatgcatagatgtcttacattctagaatgttttaaaggattg

SEQ ID NO: 253685 - DNA, 404 bp, Homo sapiens
ctgcctctccctgggcaaaatctgaaccactgacttggatctgggatggggtgaagacaagggggactgtctctcaggggtgccctgcctcaaaagctgggtgcctggtgtcaaagccatctctggtcttctgggtttgctgctatcagtgtgaaacccaccagcaagctgggtcagggccacctgcctaggaagctcagccctcagcctgggaggagcttctgccctacaaagcggggctggctgagggaaagagctgcatcctgcgatggaagtcgcctgggacttagctcagggacatccagccagggggagtaaggaagctggtgccctgctcctcccagaaaatcaccaggacccgaaagaccatgaggagagggagcctcctcctgaccctgcggccg

SEQ ID NO: 253686 - DNA, 547 bp, Homo sapiens
cgtggtatccgggagagtggagaagaggctggagaggaaggtggggacagacggcattaagcttccttttataccatgttaatggagtgggtcagagcatgacatatgcagaaaattatctgagagagaagattctaagacatttttttaaaacagccaaaaaagtccccctcaaacaaaactaattttatttcccactattttatgtgggacttttagaagggggatatctcactgatgttgtacactgttttacttaatattttgggaagtaactgcctctgacttcaactgaagaaaacacttttttgttgcaaatgtaatgtttttgtaatggtgtcagcaaataaaaggatgcttagtatttaaaaaaaaaaaaagaagggggatgtctcaaaataaaacaacttcaataatttactctaaggtgtcacaactccaaaaaagtaaaccattccttccgaattttaatagcgctttgtatctcccttttagcacttgtcactttctgcctggaagtatattgtctgtgtcttatctctgttgg

SEQ ID NO: 253687 - DNA, 299 bp, Homo sapiens
ggcaggtcgcgtcctcccgaagcctgcacttcagccccagggttttccgaccgcctctgctcccagaggggaccctcaggggcgaagaggccgaagacagcaccgagacctcagtgtcgggcgcgggtgctcccaaagcgcagcgggcccacctcccccggcagaggatcgtgcggcagtcaaagtcgcacacggggcttctgagatgtgcggcccgggcctaagagctgcatgtgttgaagccgctccgggttggaaaatgtatgtaaagtaaaataaacacggctctcgctgggagg

SEQ ID NO: 253688 - DNA, 535 bp, Homo sapiens
ctggtctcgaagtcctggactcaagtgatcctccctgcctcagcactcccagagtgctgggattgcaggcatgagcaaccatgcctggtgttttatcttttgcagaaatccaatttagtaaagtcatgttgtagcaagcatcactttaatataaaaagtgtacagcttatattattagcaattgtactgtttaattttatattagttatggtcttgaaggacattgaaaatctgttcagaaagactatgtttttcaaccagagatgacatcactctaactttcctttggtttaaatgcttgattcttcgcttacaaaacttctgttttgaacaactatggtgagaaagtatatttgtgatactgttttcttagaacactgttgtcagatagatcagccataatgttaacacatttctgatctctattataaggctgtaattttccaaaataatacagaaaaggagaaaagggtagtacatttcataattagagataaccctgtactagtgagaaaataaaaatgtcaagtttatt

SEQ ID NO: 253689 - DNA, 491 bp, Homo sapiens
ggtcaggaggtggcagttagggtagaattagatagtggagaggaagtggaggatcagagagagggaaagggacaaggggatgggggaagggtaggtaagtcagagtcacagataattcatggggggagactcagagagaatagaatcacagccctccctgagttggaagatgatgatagaaatgcaagggagatgacgggcgcagtggctcatacctgtaatctcagcacctcgggagggcgaagccagtggatcactcgagttcagttcgagaccagcctgggcagcatggtgaaaccccgtctgtacaaaaaatgcaaaaaaattagctgggtgccctggcatgcccctgtagtcccagctacttgggaggctaaggcaggagaattgcttgaggctgggaggtggacatttcagtgagctgagttcacaccattatactccagcctgggtgacaggagtaaaaccctgtctcaaaaacaaaacaaaat

SEQ ID NO: 253690 - DNA, 545 bp, Homo sapiens
  misc_feature (178)..(180): n is a, c, g, or t
  misc_feature (183)..(183): n is a, c, g, or t
  misc_feature (199)..(199): n is a, c, g, or t
  misc_feature (217)..(217): n is a, c, g, or t
tttctggttactatgggcaacggccgtgttttctttttgatgtcctttgcagtggatcacagctacctgctgaggtgaggattcaggagataattctgcgaacagaaattcctgagaactgagatgggggaaatcgctggtattagaagagtgaaaagaaactcctggagggcagagnnntgnctgccatcttcatcantgcattaccaccacccancactatcgggggacctgccctgataatcagttcctcccactgaagaatcggagtatatttctccagtccctaatgttgggttttgaattgtgtctagctctggccactggaatattaatctgtatgaccaaaaacttggaaagtgtgcattcatttgtgctcgctcactcctgctatcaccatgagaacaaacccagtccagactgctgcttccagcagaagataagagacaccaagagcaaagtcgagcttcccagacatgctcatgctagattgactaatcctcagttgacccatagatccatgaaaataaacgattgttgtatta

SEQ ID NO: 253691 - DNA, 356 bp, Homo sapiens
  misc_feature (149)..(151): n is a, c, g, or t
  misc_feature (154)..(154): n is a, c, g, or t
  misc_feature (170)..(170): n is a, c, g, or t
  misc_feature (188)..(188): n is a, c, g, or t
ctcagcagatgtcagtgtcatgctccctgtacagcctacaaaactgtgaggattcaggagataattctgcgaacagaaattcctgagaactgagatgggggaaatcgctggtattagaagagtgaaaagaaactcctggagggcagagnnntgnctgccatcttcatcantgcattaccaccacccancacagtgcctggcacaaaagagttgctcaataaatagatcaggatgaatggataaatacatggataggcactttgaactacagaagagtttaaatactttgtgtttttcttagtcaaacatgtgcaattaagcatgtgataaattatatgatgaccacaaaaaaaaaa

SEQ ID NO: 253692 - DNA, 368 bp, Homo sapiens
cgaccatcccatcccctggaaacctactgctttacttcctgtctccacagattattttgcattctttataattttacagagatgggaatcatacagaatgtactctttttataaggattcttccaggataattattttgaaatttattcattttgttgtgtgtacaattttgatctacattttcccagtgactaacaatgttgaacatcttttcatgtgcttattttccaactatatatctgtacaaatcttttgcctgttttttattgagttgtttgctctcttaatactgaggtttaatttctattttaagtgtattctattttaaaagattaacatccaataaaattaactttttggtgtacagt

SEQ ID NO: 253693 - DNA, 314 bp, Homo sapiens
gcattaggaaaaatacctaatgtagatgatgggttgatgggtgcagcaaaccaccatggtacgtgtaaactatgtaacaaacctgcacgttctgcccatgtatccccgaacataaaaaaaaaaaggtggggttcctgccgcaggtggttgctgatggagacgattgtctatctgtcttcttctgcagttggttcagaaccaagatcacctctgtaatttcctgcttatgaagattattgtcttcaaccactgggtgttggggctggcccatctacatgtgtagatgatggctgaaaaataaaataagtaaaaaa

SEQ ID NO: 253694 - DNA, 432 bp, Homo sapiens
cccagagtcctgacacagaagctctttcctgttttcttatcccagtgcttcgttccctggcccggctgaagcccactatgaccctggaggagggactgccattggctgtgcaggagtgggagcacaccagcaactttgaccggatgatcttttatgagatggcagaaaggttcatggagtttgaggctgaggagatgcagattcagaacacacagctgatgaatgggtctcagggcctgtctcctgcaacccctttgaaacttgatcctctagggcccctggcctctgaggtttgccagcagccagtgtacattccgaagaaggcagcctccaagacacgggccccccgccggcgtcagcgtaaagcccagagacctcctgctcctgaggcacccaaggagatcccaccagaagctgtgaaggagtatgttg

SEQ ID NO: 253695 - DNA, 667 bp, Homo sapiens
gttgctgggaatcaggcctgagttcagaatcacagctctagtgatggtggccttgggcaagttactgcacctctgtaaagctcagatttttaatctgtgaaatggtgataataattattttcagttatgaaaaagagctattgtaggtcatggctctactgctacacctacaaagtgcagagagcttattaattgacttgtctggggttcaacaacctgacactgacaaacataaatatttgttttacaagttgactggacttcagatattagcctgagaggtcggcaaagcttggacttcagatattaccctgagaggttggcaaagctactgccacaatcatgccattcttgtgggtacaagaaacatcaccaaacccaggtagtgggagagtgccctttccaatatatcctgccacctctctggaaaaatatgtataaccggaagtttagcaaaccacgttgcatttttctattcccatattaccatttaagaggtgtttaatctattgcattattgatttttaatcaattctaatatggtagaattgctttattattgctccctccatttttgctcctcttcagtgtaattaacacttcatgaaaaaacatgttaatgaaatattggaagaatttttatgagatatatttaatatattatgtt

SEQ ID NO: 253696 - DNA, 327 bp, Homo sapiens
tagaactgggctagatgtgtgtattttgatgtcatcagctgatagatagtttttaagctgcaggagggaatgggataatcaaaagagtgaataagacaaagaaaagaagaaatcaaaagctttgcgggaaatctagcattattcagaggtcagggaggtagagaacaaagcagcaaaggagactgacaaggagcaaagccaagggatatggtaccaatgctgccaagagagaggttcagtaagatgaggacttagagttgaccgttggatttagtggtgcatgggtcactggtgaccttaacaagagcagttttgttttttttttct

SEQ ID NO: 253697 - DNA, 292 bp, Homo sapiens
agcgtataaagcatattatgcccacaaatttgataatctacatgaaacagactaattccttgaaagacacaatctgtcaaaactcaccaagaataaacagacaatccaaacaggcctgtatctattaaataaatggaatcaataactattaaccttccaaaatagaaagcatcaggcccagatgggtttactgattaatgctcccaaacatataagaaagtttatcaattctctaccctctcttctagaaaaaggaaatattccctaactcagtctatgaggccagcattat

SEQ ID NO: 253698 - DNA, 375 bp, Homo sapiens
tagagtttaaaattgcagtaatttttatgtaatttttaactaagttgtgtatacaatattcatcgataagccacgaagttgaatttataatgaaaatcttctactcttaaaatcacaactctcctgatttgccctcaacccatatacacttccagaagaatacatataaaacatgtatgtttatgttgtagcatttaatgtggttgtaattttacatttatgtttctttgattaatatatgctccccttaagtacatgataaactccccaaagcaagaagtctgtctttgcttactatttttttaatcattgtattcacagtgcacagttgtctggcatatagcaggtactcaataaaaattcattgaaagaatc

SEQ ID NO: 253699 - DNA, 1074 bp, Homo sapiens
gtgggccatttcattctcttccactctcctctcattctccgaagatgcccaaatctctaatattattttgaaaaatattgaggctaaccaggatgaatgcatttaaatcctatcaccaccactgccccctcctatctctaaatctctccatctttagcctcccatttattcactgactacatcattcattgtcttatttgattcttcagtcactactttcatccttttatctcaggctttcaatagcatctcaacgtttatctccgggaacttccaccctccagtaccctctcagtcacaacgtcaatctctccagttcaaaggctccttttccctctaatctcttcttccccccaccccatccatcaatttgccccatttctctcgaaccatgtcaactcccttctcctttcccctggctaaaccctttcactcttcctttacctagtctatcacaaaatctaaactcctcagcctggaattcaaggtttcccacccatcacagacatatcccatcatattgccacagcctacgtattcagctatatgttctactaacttcttcggttgcctcatgtacccattaaactgagctatggtcattttatcttaacccatttccccctcctctatacacttacctataacaccctatccacctggaatgttaattctcctaaccacaagacttgtatattctatctacttattaagagacaggtcaaattccaccccctctaggacagccttctctcatttcccctgctggaaactctttcttctctgaatttccgtaacccttgattcacttactggtttctaccccataataggaatgaacatgtttgacacccctaccaatctggaagcattttgagaaaagaaccatgttttacacaactttataagacccaaagaatttaacagcatctaacgtggttggtatttaatgtgataaatgaatttttaaaaatcaaaggaacacttgtcaaagagcaaatttagtatttaactataaaatttccccataaatttagttcaaatattaataaatgattgtattctgaaatatgt

SEQ ID NO: 253700 - DNA, 549 bp, Homo sapiens
aaaggtgttagaagttgttcaaagtgctgttgcattcttttaagcgccggagtatcattttctatttgcttttaactttttcattgtgaaacatgacaaacatacagaaaagtgaagcccactgagttaccgcaaaatgaacccccatgtaaccaccaaccaggtcaaatttggaatgttgccagcacccagaagccctctcatgtttcttctcaataccagtctcctcactctccacacaaaggtaaccactgcccagaattttatggcattcacttccatacttctcctatggttttgccgtggaagcatacatccaaataccataggctagttttgcatggtttttttgaattttatagacctaaacaatttatcttctttgtgcctggcttctttcacttaacattataattatgatatttgtccagactattgaatgtagctgtagtttattcatttttattgttttattgtattctgttgattgacttataccataatgtatttatccacatttgagcactaataaaacttggattgattcca

SEQ ID NO: 253701 - DNA, 670 bp, Homo sapiens
ggccgggagtgaggaggatatgggagcatcctccagaaaagcagaagaaagggctccagcaaccatggataatgagattaccaagctcttctgggaagacaatgtgttccaacaatggcccgttccacatgctttctttatatgagtgacactcctctttacccacaagatgtgtgccctgagcaacagcaaccatgctgtgaagaagcacgaaccagcctagactgatagatggcatacaaaggctcacatggagtggaactgaggtccccagccagcagccagcagccagcagccagcctcaactaccagcccagtgagtgaatgaagcttcaaatgattctaccactcagcttttgatccacttcagctgttgcaatgtagcgctaagacaagttatccccactaaatcctgcccaaattacagattaatgagcaaaacaaatttgtcttgtttgaagttactaagcatcagaacaattcttttttatactaaaggtaactgttactgagaaacaggtctcaggtgcctgacattactcacacaaaatgatataaatctattttgagatcatcaaaaatgactctaattttgcttcgttgttaacttggaattatctatgacctctttaactccatgccttctgccccagtaaattgcaaataaatg

SEQ ID NO: 253702 - DNA, 369 bp, Homo sapiens
atggcaccactgtactccagcctgggtgatggagcgagactctgtctggctcacccctgtaatcccagcagaggtgggagcatcacttgagcccatgaggcggaggttgtagtgagccaagattatgccactgcattccagcctgggcgacagagtaagaccctctctcagaaacaaacaaaaacaccaaaaccctcagaatacatttaacaaggtaaaaagcctatatgaagaaaaaactcaaatatattaaaggaaaaaatgcaaaaacataccacgatcttggattggaagattgagtgattctaaaggctatgggaaaatataaattgccaagaataccagatattacaatttaaattggatata

SEQ ID NO: 253703 - DNA, 528 bp, Homo sapiens
ctaatgacctagttgtattttctcatcttttattgaagttatctattcataaataatttagtatttcatttttcagcatttaaaaatattttttatttttttatagagatgggggtcttgctgtgtagaccaggctggttacgaactcctggcctcaagcgatccttccatctcgggtctcccagagtgctgggattacaggtgtgagccccacagcgcctggcccatttttcagcatttttataggtgtatgtactttgcgacctgggtttaagaaagtgattattgacactgccacatattgtaatcaactcggtagattttagaacatcaagctaatggccctaccctagaccaattaaaatgcacttctaggatcatctttaactgtaaccctgaaagcggagttctgaactagagaaatgtgctacttgtcttactgatttttaaaaatgcattaaactgaatactgtaaggaatgctctttaaaaatggtggaaaataaagtggaaattttaaatttgtcat

SEQ ID NO: 253704 - DNA, 270 bp, Homo sapiens
tgcaggacgagatcagatgcccagaagaggatgaggcaggtggccacagaggcatagacttgagtgatgcaaccacaggccatgcatggtggcacccaccaaacgctggaagatccggggagggattcttccctggagcccctgggggagcagagcccacctagtaccctgatttgggtccagggaaattgactttgggcttctgccctctggaaccatgagagaataaatccctgttgcttttaagccatccagtttgtggtaatttgt

SEQ ID NO: 253705 - DNA, 83 bp, Homo sapiens
tgccaccctatgggtccaatacctaaatccctaggaaacacacttcgcactagagggtcaaattctaagtattgctcattgct

SEQ ID NO: 253706 - DNA, 451 bp, Homo sapiens
agtcgtctccttttgtgctggactgggttgagagaagtgtatacctaggacagcttcggatccccagggacttcaaaccctaagaaagatcatctgaattaggcaggtataagaattgcttgtattcatgtgggagctaatagctcagcacaagtcatgcatggagtagctgaaagatgactaggttggtgagcaagggaatagtgatcaaacaggttggagttcctggtagctttatgtctgaatatttttgcttctttgggaaagcttcaggaaggactaggagaattacactactttgcaaacattttcagacaggagctaatctcttttatctgtcatggacaggtagacagaccttcaatgccttttgtaatgacttaaaccaaatgatgaaaaataaaatgctcaaatagacaaaaagtagtagtataaaataaaggtaataaaa

SEQ ID NO: 253707 - DNA, 7958 bp, Homo sapiens
gcaggagagacactgcatattgtaacataaaatattacaaatatcatttttagagcaaaggtagaagcacattttatataaatctagaagtatcctttgatacaaattaaggcataatgtaaaaatcggattcttggaggaactaggtgatatgatacaagtatactccagtgaagtaataataataacatcaactaaatttactgagctcttactctgtgccagctactctgtctccaggctacctatgtgcaaattccaactcagtcacttattaactgtgtaaccttgggcaattctgtagctctctttgtaaaatgaggaaggtattaattgcattagtacccacttcctagagttactgtgagcttttaaagtatgggtctggtgtgcatgagtgtgcacgtgtgtgggcatgagagagagagagagagagagagaagattatattcttatataaatgaatcttgcctcttcctgttttctattccattcatttatctaccataagggattccactgtgatgaaaaaaaaagtatcttgtttcctcagaaagacatttagaaatatgtaaacattttgctttcatctttatatttatggtaattctaaggatattataaacttgcagtggtaattctgaagtataatatatattcagggtcacaaaacagggcggcaaggatgataactctattagcatttaaaaagcataaaaatactaataagcacaaattttcctactatagtaactgtagcctgaagttaagaataatagcatagtgattgtaattaataataatatatatttgaaaattgatgagagattaaaactcaaatgttcttatcaaaaaatgataagtatgtaacgtattggatgtgttaattagctttaattatttcacaatgtatacacatatcaaaatgtcacattgcacaccataaatatatacactttttatttgtcaattataccctaataaagcttgaggaccaggagaggaaaaataagaatatacaaaaatggaaccagcatgatagttcacgtctgtaatcccagcgctctgtgagaccgaggcagaagaatcatttagcccaggagttccagaccagcccgggcgacacagcaagatcccatacctactacacgttaaaaagttagccaggcatggcattaaaaaattagccaggcatggtggcacacttcctcctgtagtcccagcctgtcgggaggctgaagcaggaggaccactcgagcccaagagtccaaggctgcagtgaaccataactgtgccgctgcactccagcctaagcaacagagcaagatcctgtctcaaaaaaaaaaaaaggaagaatattattgaaaaatgaggtctgcaagaaatggcatatcacagtggctagaagacacagtgatacgccctcaggacgttccctctagctggagttctggacttcaacagaaccccatccagtcattttgattttgctgtttatttttttttttctttttctttttcccaccacattgtattttatttccgtacttcagaaatgggcctacagaccacaaagtggcccagccatggggcttttttcctgaagtcttggcttatcatttccctggggctctactcacaggtgtccaaactcctggcctgccctagtgtgtgccgctgcgacaggaactttgtctactgtaatgagcgaagcttgacctcagtgcctcttgggatcccggagggcgtaaccgtactctacctccacaacaaccaaattaataatgctggatttcctgcagaactgcacaatgtacagtcggtgcacacggtctacctgtatggcaaccaactggacgaattccccatgaaccttcccaagaatgtcagagttctccatttgcaggaaaacaatattcagaccatttcacgggctgctcttgcccagctcttgaagcttgaagagctgcacctggatgacaactccatatccacagtgggggtggaagacggggccttccgggaggctattagcctcaaattgttgtttttgtctaagaatcacctgagcagtgtgcctgttgggcttcctgtggacttgcaagagctgagagtggatgaaaatcgaattgctgtcatatccgacatggccttccagaatctcacgagcttggagcgtcttattgtggacgggaacctcctgaccaacaagggtatcgccgagggcaccttcagccatctcaccaagctcaaggaattttcaattgtacgtaattcgctgtcccaccctcctcccgatctcccaggtacgcatctgatcaggctctatttgcaggacaaccagataaaccacattcctttgacagccttctcaaatctgcgtaagctggaacggctggatatatccaacaaccaactgcggatgctgactcaaggggtttttgataatctctccaacctgaagcagctcactgctcggaataacccttggttttgtgactgcagtattaaatgggtcacagaatggctcaaatatatcccttcatctctcaacgtgcggggtttcatgtgccaaggtcctgaacaagtccgggggatggccgtcagggaattaaatatgaatcttttgtcctgtcccaccacgacccccggcctgcctctcttcaccccagccccaagtacagcttctccgaccactcagcctcccaccctctctattccaaaccctagcagaagctacacgcctccaactcctaccacatcgaaacttcccacgattcctgactgggatggcagagaaagagtgaccccacctatttctgaacggatccagctctctatccattttgtgaatgatacttccattcaagtcagctggctctctctcttcaccgtgatggcatacaaactcacatgggtgaaaatgggccacagtttagtagggggcatcgttcaggagcgcatagtcagcggtgagaagcaacacctgagcctggttaacttagagccccgatccacctatcggatttgtttagtgccactggatgcttttaactaccgcgcggtagaagacaccatttgttcagaggccaccacccatgcctcctatctgaacaacggcagcaacacagcgtccagccatgagcagacgacgtcccacagcatgggctccccctttctgctggcgggcttgatcgggggcgcggtgatatttgtgctggtggtcttgctcagcgtcttttgctggcatatgcacaaaaaggggcgctacacctcccagaagtggaaatacaaccggggccggcggaaagatgattattgcgaggcaggcaccaagaaggacaactccatcctggagatgacagaaaccagttttcagatcgtctccttaaataacgatcaactccttaaaggagatttcagactgcagcccatttacaccccaaatgggggcattaattacacagactgccatatccccaacaacatgcgatactgcaacagcagcgtgccagacctggagcactgccatacgtgacagccagaggcccagcgttatcaaggcggacaattagactcttgagaacacactcgtgtgtgcacataaagacacgcagattacatttgataaatgttacacagatgcatttgtgcatttgaatactctgtaatttatacggtgtactatataatgggatttaaaaaaagtgctatcttttctatttcaagttaattacaaacagttttgtaactctttgctttttaaatcttaaaaaaaaaaaagttgctgaagtactgtacagggttgtacaatgagaacccaatgccaaggcaaaaagaacgagtgatttttccttaggatacacatcaaccactttgctgttgaagctgtcagaataaattcctggtggtcagatgaaagggcagattaaatggactcatcagggtaagaggaataatatgggtaaaacaagaaatggcccgatagtttcacactattcctatacctccaggtccggaagacaggtaaaaaaattctataatgtaagaatggaggtagttaccctgatttgaccctgtgtgggaaatgctgaaagcaccaggaggaagccggttcccgtgagataagttaacccggcctgacagaatcaagaaaattgagatgagatttgaaaggacccgaaaatgcaggggttggctttctgactgggaacttaaaaatcactcttcatgcttccctggtcctatgtgataacagagttagagacttgagtctgatttcagtcatcttcagggaccagtctgatgttgtagcaagaagactccctttaaaagtgttactgttcaaatcatatatcaggttgaatcacattcaacagagatatattctagaatacttttttagaagaggctaataaagggaagaattatattgaatggaattatttttgataatgagaattatttgggtagattcactgaggctatgtcaacatgatatttagaccaacaggtgatcaatgtttggaaaatacaacaatgacttatttaaaaattacccttcctgctatttagacaaaaacaactgatcagtggttctgttatgtcagctgactttgttagtatcatgttgaaatagcttgaagtaatatcttttatccccttgcaaattcttgtcttccaatcatctcccatatattttcataattagttgtttatgacacctttgtttttctccctctgttcagtatttcaaggaaaattatggatgccagtcttggctgcacaagatatccattacgtacttatacattttaaaatgagtactaattttcactgctaataattctgtaaggacacatcaaagctggccaaaataatgaattttttttaaaaagcaatacctggtttccaccttggactgactttgatcctgttccacttttgaaattttatttgttccttttccatcgtggatgttcctctactttggcaattgtggagggctaatcaatcttatgttagcaggacaacccatgaaaaacaagtcagagagtgaaggctttttcccctaatcctggcagagcagggcgtagaaaagagaggatgtccatgcttaattctagatacttttgagacaacaccttcagaaaacacataatttaatctttgccatccttagatagagaagggctatagatcacatacgttatcaaaaactactcccttggaaaaaatatctttcgaaaatcaaatttaaacatttcactctgtgctgcatatttcttttaccattgaccattattatagggacccatgaagtaaatgtcacaatcatcttactagctctctctctctcagcaaaataaaactgtgatgtgtcttctttgtaaaagtttaggtataaaatgctatgcaactttttctttatagtaagagctttattttctttaataatatagcccaacttatatgttttaatctcccttgtccctcagaataagcagaaaatataactgcagctgtatgtcgtagacacaagaattgaaactgtgcagtcagtagagctgaacttagctatgaattaatttaaattaattctaaagtgactctggtttccattagtctattagctagagggttttggctgttgctttttttaaagttaggtccacacagtgaagggaaaagagtctgtgaaggtgatcagtgtagcagtaagacatctaaaatcaagacaatgacatgggggctttgtgtacttagctggataattcccttctactgtcctcttccccttggctgtgtagataaaattgtgcattcaaatgatggtactttgacttttgagggtttttatttctgttattcacaaaatactcattctcatttatgtatattgtatgtttaacccccagtgggatttctggctgctgaaaccactttgggccaggaagaacaaggatgaagaggttcctgtcatttcttatggggttcacagaattatttggggcttaaatggtacaatggagacagtcatgtgcaatgcttaagatggtctgacagggtcccttttgctggaggtgttcctgaagagattgaacctagtaacaggctttattttcaccttgtgtacaacatggcaaagactgctaagattaaaatccgtctcccatttgttacagcctcacctgcaccaggatagaaagcacgtgatggaatctgtgatgtctaatgtgtcttatgaaaattgccaaacaactgtccctggggattctgctttgattggcatttttagtcatgggaatgtatatttgctgatatatctgctctgtgtttgggcctctcttgctgtcattatgatgtattttgagatgattagtcaagagtcaaggttgcgagtacaggccaagaccatgggaaaaaagccatgctcactggccaataaagagcttgatgctgcctggccaaatgaggtgactcagatagaatctgatcccattcagagcttggtaaatgtcactgtacagaagacattgaaaaggaagaggcatagtcatgatcaaaaggatatattgacagttatctatagccagggtagttgttaatacctgcttgtttggggagatatgtttgattatagagagactctgggccaccctcaaacaccgtcagatgcattagcagcccactgcatgggacaatcgcaggcagatacgaggaatgtatcccctgcctattttccttgtgtaacaaatggaaaacattctcccctgtgagaaataatgcaatttctaattatctggatgttcgttgaaaatatattagacattctccctgaggttaaaaacaaaaagtacgtgaccagtctggtaagaagtattaatgaagtagctaatattacagcttcattttctactagcacctatcataatggtcttagtcatttcacacaaatcagaacttccttccccaccagggaggacaacatcttcatgctgtgattgaagcatccattcagaacacgaggcaatattgcagtccacagggaatggatgcttcacttgatctccggaccttggctgcagaggccatcgcagcttttgaaaagtgaaggggttaattcccattggtgtctttgcttatagcatttttctctaacctataacaaggagacattacattttactttagaacatgagaatagcagttttgctcatgacttaccattccagctgcatgggaaagcaaagcagaaaacagtgccccaaatggaaaaaagatactcacacagaacaaaacagttcttggtcttgttcttggtcttgtcaaaccttgcctgatgctctttctaaagtcaaaatatgaatgctaagaaggcataacctacatccttctctgatttcttcagcagggtcaaaagacagttactagcaatggggaatgcttgtcactgtggagaaagagttttgtatatgtctgataccgttgttataacaaaacaaatttttttactatagttttttgttttctacctgcacacccaccagaagagcacaaagcaaggccattgcaacaggcatttaaaaattattatcaaacatgcacatgcttgtacacacacacacacacacacacaaacaggggcatttgtaaaggtgtccctggaatgtaagatttataatgtttaaggcaaggtgaaggcattgccaagtgtgtgtcgctcataggactagtgtatattcactgaaagttaacctgatgatttgttattgtttgaaccatatgctgatttgcttctggtttctgtttagtgtgttctctctgataaggggctgaaagattctgcatcacacatcctctgagacctaccatgtcgcacactttgttaatgacaaacttcactctacactatacagtaccttgttgatatattcagtaaagtcttattttaaaag

SEQ ID NO: 253708 - DNA, 375 bp, Homo sapiens
cacattggaggtaacagaggagctggttttgagggacgtgtagaagtccaccagctgttgaagatgaggccaggcgtcctcagaggagagaacagaaagtgccaaggccaggggcagcggtaaggagcacacggcacactggggaagagtcaaatgctggagcccagggtgtgggcggagcggtgggagatgaggacacccagatggcttggggtcaggttctgaagaatgttgggtactaggctcgagtttggactctatggtgggggaaatagagagcccctgacagtctttaaagaggggagagatggatcaggcctgtagcatttcctcagggaggttataaagcagatacagaggtacagacacatcttc

SEQ ID NO: 253709 - DNA, 106 bp, Homo sapiens
gcctttttcagcttccgagagctattagtattacttaacttgtggaggcaaaattccagtttctgcatccatctgcacagtgtctcctcctcttctgtgttttctc

SEQ ID NO: 253710 - DNA, 138 bp, Homo sapiens
gctttctaacactaattgcaggctcaaaaggagcggaatttattgcgaaggccaaggcggcttgtttataatttatgaagttttaaatggctgtgccgcgggccccaactttctcctgggctggcagccgcgcggaaa

SEQ ID NO: 253711 - DNA, 376 bp, Homo sapiens
tgcttaagtctctcggtctgtggtactttgttatggcagccctaggagacttatattacatccagttgttctagtctaaagaatcacaggtggccaagcacagtggctcacgcctgtaatcccagcactttgggaggctgaggcaggcagatcatttgaggtcgggagttcgagaccagcctgagcaacatggagaaaccccatctccactaaaaatacaaaattatccaggtgtggtgacacatgcctgcaatcccagctactcgggagtctgaggcaggagaatcgcttgaacctgggaggcggaggttgtgatgagccaagatcactatcattgcactccagcctgggcaacaagagcaaaactctatctcaa

SEQ ID NO: 253712 - DNA, 361 bp, Homo sapiens
ctgaaaggggtctggcagtcacatcatgagagaccttatgaatggtgtaaagatccctaatataatttaaatgtgtgtcctcacccaaatctcagattgaaatgtgatccccaatgtcggagttggggcctggtgggaggtgactgaatcatggggccagttactcccatgctgagattctcacgatagtgagtgagttctcacgagatctgatggttttatgaggggctttccccctgctgctcagcacttctcgttgctgccaccatgcgaggacggatgtgtttgctttcctttctaccatgattgtaagttttctgaggtcttccccagccctgcagaactgtaagtcaattaaatc

SEQ ID NO: 253713 - DNA, 407 bp, Homo sapiens
aattaaaagatctgaggtcagcttgctcctttctgcccgtggatgccgccgaagaagcattgttaaagtctctcttctccctgctgtcatgtctaagtcagagtctcctaaagagcccaaacagctgaggaagcttttcactggaaggttgagttttgaaacaattgatgagagcctgaggagccattttgagcaatggggaaccctcacgaactgtgcggtaatgagaaatccaaacaccaggtgctccaggggctttgggtttgtcacatatgccactgtgggggaggtggatgcagccgtgaatgcaaggccacagaaggtggatggaagagttgtggaaccaaagagagctgtctcaagggaagattctcaaagaccagttgcctacttaactgtgaaaaaga

SEQ ID NO: 253714 - DNA, 334 bp, Homo sapiens
aattttgggatggtatatccttcagtcccttagctactttgaagtatttggtggtgatattgaattattgtggtttatgtgttttaattatcttgtataattatctcatataatttctcatatgaattattacttgcctgacagatgcatgtggtcttttagcattttgttagcatttgcaagttggcaactgttctcttatatacatcattctctccattaaatatcagtgcaagtgattaaagctggtaaagaataaaacaggtgtcagtataattaaagtgggactttaaaaaccaaaccaaataaagaagaatgtaacaaaaatcatttt

SEQ ID NO: 253715 - DNA, 434 bp, Homo sapiens
gaaaatgctcttgttcttagaagatacaggctgaagaattaataggtaaaatatcgtgacgtcctacctgcgccgactttaacacagttcaacatttttgggaggtacctctgagcattgtgccccttgcagcacagtgggtatgctgagggctccctccctgggtttcccagacctcatgtccccgtcttgtctgctcatcatactggaggtactacagtgcgtggacagatggagagagagaccgacaaaatgtgaggatggacaaatatcagcattgatatatttaattgaaatatattggccagggtggggagactcacgcctgtaatcccagcactttgggaggccgaggcgggtggatcacctgaggccaagagtttgagaccagcctggccagcatagagaaaccccatctctactaaaaatacaaa

SEQ ID NO: 253716 - DNA, 568 bp, Homo sapiens
aaacaaaaaaccccagaaaacagaacacaacaatttggatgaatattacaataaattaaaagtttccagatatgagaaaatacatatcatgtatactcatatatatttacataaaatttttaaataggcagaattaatctatggtattagaagtctgcaaggggtaggggggcagtgactaccggaagcaggtactgttggggcttccggggccctggtgtgttctagttctggatctggatgtgtgtgttcaccttgtgaaaattcactgaaatttatgctcaagatttgggcacttttccttgcatgttaaaataaagatcaagaatgaaaaagaggctgggtacagtagctcatgcctgtaatcccagcactttgggaggccaatgcagcagatcacttgaggtcaggagttgaaaaccagcctggccaacatggtgaaaccccatctctactaaaaatacagaggcacaagaatctcttgaaccccggaggcagaggttgcagtgagccaagatggctctattgcgctccagcctgggtaacagagcaagactctgtctccaaa

SEQ ID NO: 253717 - DNA, 622 bp, Homo sapiens
aaacaaaaaaccccagaaaacagaacacaacaatttggatgaatattacaataaattaaaagtttccagatatgagaaaatacatatcatgtatactcatatatatttacataaaatttttaaataggcagaattaatctatggtattagaagtctgcaaggggtaggggggcagtgactaccggaagcaggtactgttggggcttccggggccctggtgtgttctagttctggatctggatgtgtgtgttcaccttgtgaaaattcactgaaatttatgctcaagatttgggcacttttccttgcatgttaaaataaagatcaagaatgaaaaagaggctgggtacagtagctcatgcctgtaatcccagcactttgggaggccaatgcagcagatcacttgaggtcaggagttgaaaaccagcctggccaacatggtgaaaccccatctctactaaaaatacaaaaattagccaagcatgatggtgcatgcctataatcccagttacttgggaggctgaggcacaagaatctcttgaaccccggaggcagaggttgcagtgagccaagatggctctattgcgctccagcctgggtaacagagcaagactctgtctccaaa

SEQ ID NO: 253718 - DNA, 383 bp, Homo sapiens
atagaaactgtaatttaaaattttttcacaaatctctaatcttggcttcactagtgaagtgttaaacatttaagggagaagaaataataccactattacattaactcctaggaaatagaatagaaagaaacacactttatggggccagtatcatcttgatactaaagccagatatagacaatataatatatgaaaattacagttcaatgtccttcatgaatataggtgcaaaagtccttaacagaatgctagcaaattgatcccagtaatacataaaaaggataatatgtcatgttgagttgttttttttttttttttgatacagagccttgctctgttgaccaggctggtgtgcagtggcgtgatctcggctcactgcaccc

SEQ ID NO: 253719 - DNA, 577 bp, Homo sapiens
cagcaaccacaagagacctgctgggagccctcaccacatcctccctccacccaccctgagtctgcactctgccccctccactgccacgaggaaaggactgctcccacctgccacagacccccattgtgcacatgtcacatgagcctgtggacaagccctgccacgcaggccccttcctgttgtgtttgtattgctgacagcacaccattcctgactggttcctgtatgtacccattttacagataagaaaaccgaggctcagtttaaggcacagattaagattatacaatcagccgggcatggtggctcatgcctgtaatctcggcactttgggaggccaaggtgggcggatcacttgagctcagaaattcaagaccagcctgcccaacatggtgaaaccccatctctactaaaaatgcaaaaattaaccgggcgtcgtggtgggcacctgtggtttcagctgctctggaggctgaggcaggagaatgacttgaacctgggaagtggaggttggagtgagccaggattgtgccactgcactccagcctggacgacagagcgagaatccatctcaaaa

SEQ ID NO: 253720 - DNA, 347 bp, Homo sapiens
tgctcctacgctgtttatacatcattgtattcaatttctgtcccagttcctagtgtgggccttgtctcaagactctgctgcaaggtttctgtcctagttcttagtgtgggtcttgcgtcattactctgctgtaaggttctttggcttggggagggggtatggagccgggtaggcagggaagtggagggaggtgctcactctcagctttatttggattcctggaggaaggagagttgctgttaccaggaaaagtcagtgttgatcagacaagaagaggatctgctgccttcctttggtgggtgggtactgttaggttgagggagaatttgcctggaggaggctctgtg

SEQ ID NO: 253721 - DNA, 661 bp, Homo sapiens
gtataggagaaaaataataaagaggatatttttaaaaagtagctgagaactccctagatgacaaggtaattaaacaagaagaaatcatgctaaacaaaaaccttcaactggaataatttcacttcagaaaaaaaagttaagcatttccaaaacaaataaaagttgagtgtgttactgaccactggaacactgctaaaggaaatgtaaaagaaagtctatcacgtccaaaaatgacaatatatgctgcacagcgtcataaaagcatatgaaaatagaaagctctctattaaaggtaaatacataaacagctatagaaacctctactgtcataatgatggtgcacaaaactttcacgttattgctatggaatttaaaaaatgaagcagaaagctgcataaatatgggttcatagatactcaataagaaaagataacaagtgatattaataacaaagtgggggtataaagaggtaaagctttgcattccattgaaatatagtcattatatattgtcataactttaagatgttttatgaagtctttatttctcaagatgattacaaaaaaacctgtagatggtatgcagaagcaaatgagaaagaaattgaatcatgtcactacaaaatcaatgaagaaaaataaagcagtaagagaaaaaaaaa

SEQ ID NO: 253722 - DNA, 326 bp, Homo sapiens
ttgttggcaagctagagccttgctaggctctgcagtttacagaccagcagcactggcttcgacttccggcttgttaggaaggcagaatcccacgacccactccagaaataccgaattggaatctgcaattgaactagatccccaggtgactctctcacacacacacacgcactcacacacgcacaacacacacacacgcatgcacacacacatgcacgacacacaggcgcgcgcgcacacacacacaaagtttgaggactgagctggaggcctgtcaatcctggtagcattatttctaagagctggtacgtgagcaagaggaccca

SEQ ID NO: 253723 - DNA, 376 bp, Homo sapiens
tgtgcttctagctctcaacctcacaggtcagacggatcccccagagtcaccaatcatctcacccgcaaattaaactgttcctaaggtacttacttggatttattgagcacctactgtgtagcaggtactgggctaagcatagatcatgcattacattatttaaccctcacagcacccttgtggaacatctatcatgtttatggccactttataagaaactgaggctctggagtgacttgctcaaggcctacagcttggaagagagaagcaggatgcactccgaggccctccgaccccagtgaatgggctcataagcaccacgcagctgaccctgctgtgcaacttcttcctatgtgcttggttcgctcactgggca

SEQ ID NO: 253724 - DNA, 521 bp, Homo sapiens
aacccagagttgatctctacaccacgccatcactgccaggggtgaggaaattctggcaccagtgattcagcactgtttttttctctctcttcagtgcctctttcagtgatatgaagttaaaaccagatacccagccgtgggattgctagatcagacagagccaattgatgatcagcagggcctgaaaatgccaaaaccctgaaacaactgaccttcgaaaacttcaacatccctgaacgaaacgtccaaacacatttatccaccaatcaaagaccctttatagtctgtgctctgtgcatctcagaagtctctctttaccacactgtctatatactgcatgagccattatatgaaactccaaggcatcttatactatatattcaaccatgtatccctagtacctagtacagtcctgccatatagtttgctactaaacatttgcagaatgaagtaattatcttgtatccaggttccaagttttaaggtgatttctcactaaaaataaagcattacagttcgca

SEQ ID NO: 253725 - DNA, 576 bp, Homo sapiens
ggagacacatcgcctctgcctcccactgtcccagactgtctgcgggctgatgtcagggttcctccttctgagagccaaaaatgttccttctatttagcagacaagaatatcacccacggcttcctctatcctcctggttagtagaactcttttttagagcagtagcttagaaagctctcatcagctggatgtgggcatgtgccttaaacatatactccccaccaaaactacctgcttgggtaagctagctgcctgagaggcttccagtggttgtggctggccagagcagcacagcggctgtaataaagactaagacattttgcagtgggacccacacagcagctctcatctggcccagatgtttagagagttcggcaggtttaagtttaattttaaaactggagattctttgcagaaggacacaaacatctaaaaacccatttcttctgactcctgcccaagctaaggtccacctggagaatacagctgtgcccgtgaaaagaaatcaggctgggtgctcgctttggcagaacatgtactaaaataggaatgatacagagaaggtcacctagtaaa

SEQ ID NO: 253726 - DNA, 552 bp, Homo sapiens
gtgattgcgctcttaaaaaaaaagaaaaaaagagagaatacaaccaatatgctaatataatatcacttgagcctaggagtttgacgctgcagtgaaccacaatcaccccactgcaccccagcctgtgtaacagagcaagacctggtctcgaaaaataaataataaagtatgtgctaatattatgtaataattacatataacattagcaaaatttgttgagtatctctgtgacaggcctataaagctaggactacagtgccagttagagtttaggccaggctcactgatgtatgcctgtaatcccaacactttggtagtttgaggcaggaggatggcttgagcccaggagttcaagaccagcctgggcaaaatagcaagaccccatctctataaaaattttaaaaaattagctgagcatggtgatgtgcacctgtggtcccagctactcaggaggctgaggtgggaagattgagcctgggtgatcaaggctacagtgagccataatcatgccactgcattccagcctggacagtagagctagaccctgactca

SEQ ID NO: 253727 - DNA, 680 bp, Homo sapiens
aagtactagagaagttaaggcaggaaaaatcacttgaacccaggagttcgaggctgcagtgagccatgatcacaccactgcactccaggctggtcaacacagtaagacaaggctctctaaaaagaaacataaaaataaaataaaataaataaaaaataatttataacactgtaaaaccatggaggcatattgcccccatttgcccatgtggagcatggaagcagccagccacagaaaagggtcccagcatgagccgagagcaactctcagggcacaagaggagccacatctcttctgtctttttctacccaaagctctgatggagaactatctcagagcaggccccaaggcagtgggctggcacctggaagttatttggaggcggggagccaggcaagatagcaagacagcagcagtcccattccatttgagaatttaatactcaaggttccaacaactcaggagcatgctgaaggatgtttgagcaagcgtggggtgggaagatgcagagtgcaggtagccgtatttgcaaagccacatattagactcactttctcttgaagacaggactatctcagcatgaatgaggtcttctcagctcctggttgcctatgaagaggagccctgtagagatgtcaagccaaacttagcttctttacggggaaaaagccattgacggt

SEQ ID NO: 253728 - DNA, 1358 bp, Homo sapiens
  misc_feature (4)..(4): n is a, c, g, or t
  misc_feature (6)..(8): n is a, c, g, or t
accntnnngggaaagcccacccaagaatgacaccaacacagagggaagtaaacatagccaagaggtcagcagaggtggttcctggtgccattatccagcacccagctacagaccaggtgaagttggccgggcacatagtcacaggcactggagtgatccataggtcacacacgaaagtgtgcagagcaactccagctgtgctctttcgttttcacagttagcaacgtttttataggtagcattcttggttagcattcctagttaggatttgtagctagaaggttaccatgtggcagggccttacgaccatctctgctgatgaggagacccttactgatcattataggctcctcgagatcatcagccaggacagcttcaccagggtgaatgaagttcaccaagtaccttctcactgggcagcagtgagactctagactccctctagagtctattccatggggtcaccccaaggtcatcaaactctttcaacaccacagacactttgttcttagccatggagtacggccagcagagcagagctggtcgactacatcctagagttgggctacatgaaggcggaagaggcctgaagcaaattccagcagatagtatcagccctctagtaccaccaacagaagggggatatccatagggacctgaagcccaagaatttccttgtggtccatcacaacataaaaataacagactttggatttgataccaggttcactgtaggccagaagctgggcaccttcggtgggagtccctcttatgcggtcctgaactcttccatggccaaacatatgatgggccccagtggacatgtggagctggaaagtcattctttacaccacagtaaccaggtcctgccatttattgggcagattttgtggcgctgaggaagctgatactgtgtgaacaattgtacaagatcccactctttgcttttcatttccagagagcttcataaacctatttctgactgcagggagaggcctatactagtccacgtcatggaacacctatggatcaacactggtcaggaggagacacgaaggccataccgggagctgctctctgattaccaggactcctgaaacacagagctcatggtgtccgtgggatatgaggcagaccacatccagtccttgttagaacaaaaatttgatgataccatggcctggtactgaatcctgggctacaggaaacctgatgcagggctccatcatcacagcaaagtctttgccttcagtggatcccacccaacagctactagccttccccatcacctgaaagaaactcttatgctttaacatacaaaacttgttaaaaacattgggaaaaggtgaaaattcgta

SEQ ID NO: 253729 - DNA, 516 bp, Homo sapiens
  misc_feature (4)..(4): n is a, c, g, or t
  misc_feature (6)..(8): n is a, c, g, or t
accntnnngggaaagcccacccaagaatgacaccaacacagagggaagtaaacatagccaagaggtcagcagaggtggttcctggtgccattatccagcacccagctacagaccagagagcttcataaacctatttctgactgcagggagaggcctatactagtccacgtcatggaacacctatggatcaacactggtcaggaggagacacgaaggccataccgggagctgctctctgattaccaggactcctgaaacacagagctcatggtgtccgtgggatatgaggcagaccacatccagtccttgttagaacaaaaatttgatgataccatggcctggtactgaatcctgggctacaggaaacctgatgcagggctccatcatcacagcaaagtctttgccttcagtggatcccacccaacagctactagccttccccatcacctgaaagaaactcttatgctttaacatacaaaacttgttaaaaacattgggaaaaggtgaaaattcgta

SEQ ID NO: 253730 - DNA, 265 bp, Homo sapiens
gaactcctgggctcaagcaatcatcttacctcagcttccaaagatctttttattattagaaaagcaacatagccttttataagagccacacataaaacaaactgacatagaaatattgagcaataaaggaatatatacaatatactaggcaaatactgagcaaaagagagcacaggcagctctctttgagtaattgacctattaaactaaagcaaaagcatccaaagaggcaagcacatgtaacagtaaacaaacagatagaaca

SEQ ID NO: 253731 - DNA, 1008 bp, Homo sapiens
tgaataaaaatgtagatctaaaggttaaatagctatttgacctattggtatcagggtaccaagggtctagactcaagcacatcacctttggagctacttaataaatattaatgacattaaataaatcctttagtttatccattcattcaacaaacatatagtacaagtattttgtgctaagtattctgttagccacagaggacttaaagatgaacacagcgccttcatccttagcaacagtgggattgtgtggcagaaaaggggggagcgccaggagggcaagtacatcagcttgacagcagtagcagacaaagcttcctggagaaggaattacagtgtctttgaaaacttacttcattatttctaattataaaagtaacacaggctcattgtggtacataaaagaaaaacaaatttataattaagtaaacgcgctctcttcagtgttcaccatccccaaccttactacacagagcttgctgtgttcagtgtggaaactttcagtcttttttgtatgtatgtttatacacacgcaaactcctcctttaaaaaaataacaaaactaggatatcatatatatttgtctataatttcctactttaaaaagcgtattatggtaattagccttctagatagtctccagtgatacccgcttcctggtattcacacccttatgttaactcctcccacgctgtaccagggttggtctgtgtagctaacagaacctggcagaagtgatgacggtcactcctgactttaggttatactgagacttccatcttgtatgtccttttttctcttgtatcattgagtctggggaagccgaatgccacattgtagggacattctgcctatggagaatcccatgtggttgagtaattgaggcctgataaccatgtgaatagctgtgatgtcatgagaaaacctgagctcaaacaactcagttgtttctggattcctgaccatagaaactgtgagatgataaatgtgtgttgtttaaaactaaaa

SEQ ID NO: 253732 - DNA, 494 bp, Homo sapiens
tgtactaaatctggaatgcttataaatggttgcaagggcagatcatttcagagtaagagatatttaaaaacaaagggctaagggaaacctcaattgaaactagagcaatacaaaataaaatctcctactgaaccctaaaagactcctactgactgacccctcaaaagcaccccatatgtctttctcttctcctctgaaaaggtaactcagggcccggcgcggtggctcacacctgtaatcccagcactttgggaggccaaggcgggcggatcacgaggtcaggagatcaagaccttcctggctaacacggtgaaaccccgtctctactaaaaatacaaaaaattagccgggtgtggtatcaggcgcctgtagtcccagctactcgggaggctgaggcaggggaatggcgtgaacccgggaggcggagcttgcaatgagccgagatcgcaccactgcactccagactgggcaaaggagcgaaactcagtctcaac

SEQ ID NO: 253733 - DNA, 590 bp, Homo sapiens
aacagtctgagacatgcaaatgtgtttaaatacacaagttcataataacactaaaaatttttttaaacttaattggtcgccattgggggacactaatagactacttcatcatttttaaaactattaaacaaaagcaaagaatcaaactattattttataaattgcatcacaggtagccagtgaatgagagaaagcctctttgatagaatttttcacaaataaatgagttggaaaggatagaattagaatactgccccttagttccatatgaattattaaatataggcaataatcactcgttactactatcatctctcaaagaaagacatcctgatgatatgtcccttctgatggaaatgtgtaatatcatctagaaaatattttttgtcccaaaattgaatctgagtctgatgaagcttctacatctaaataccaagttacagggaatacaggggcagagaaatacatgaaataacaccaaaaaacttaataagcaagatctagactgtaaaaaactttataggatagacaaacaggttttacttatttgaattctcattcaaagtataaagatattatgacacaattgc

SEQ ID NO: 253734 - DNA, 1114 bp, Homo sapiens
ctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacacgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagagaaaggaaacctcttcccgcagcctggctcctgtgttccctctatccagccaatgcctgtttacacagacacctggcctcactgccagcccacctcccctacagccctgtttgttcctgcttctcatgattttcctgtaaataaacacactcttaatttgcaaaaaaaaaa

SEQ ID NO: 253735 - DNA, 1111 bp, Homo sapiens
ctcactctgagcagtgcagagtcaaacccccggcccattgtgaaaatcacagagcggttcttccgcaacccagcgaagcccgcggaggaggacgtggcagagcgcgtgtttctggtcgcggaggagcgcatccagctgcgctaccactgccgtgaggaccacatcacggcctccaagcgcgagttcctgcggcgcaccgaggtggacagcaaaggcaacaagatcatcatgacgcccgacatgtgcatcagcttcgaggtggagcccatggagcacaccaagaagctgctctaccagtacgaggccatgatgcacctgaagagggaggagaagctgtccagacatcaggtctgggagtcagagctggaggtgctggagattctgaagcttcgagaggaagaggaggcggcgcacacactgaccatctccatctatgacaccaagcggaatgagaagagcaaggaatatcgggaggccatggagcgcatgatgcacgaagagcacctgcggcaggtggagacccagctggactacctggccccattcctggcccagctcccgccaggagagaaactaacacgctggcaggcggtgcgcctcaaggatgagtgcctcagcgacttcaagcagcggctcatcaacaaggccaacctcatccaggcccgctttgagaaggagacccaggagctgcaaaagaagcagcagtggtaccaggagaaccaggtgacgctgacacccgaggatgaagacctgtacctgagttactgctctcaggccatgttccgcatccgcatcctggagcagcgcctcaatcgacacaaggaactggccccactgaagtacctggctctggaggaaaagctctacaaggacccacgcctgggggagctccagaaaatattcgcttgatgtccctcctggggcctcagccagagctgccagaggcggccgagtgggctgaatgggcgaggatggagaaaatgatgaggccaatgcctgtttacacagacacctggcctcactgccagcccacctcccctacagccctgtttgttcctgcttctcatgattttcctgtaaataaacacactcttaatttgcaaaaaaaaaa

SEQ ID NO: 253736 - DNA, 480 bp, Homo sapiens
agcccaggagtttgaggctgcagcaagctaggatcacgccactgcactccagcctgggtgacagagagagactctgtttcttaaaaacaataacaacaaaacacacttatggccaggcacggtggctcttgcctgtaattccaggatttgggaggccaaggtgggcagatctcgcttgaacccaggagttccagactaacccgaacaacacagtgaaaccctatctctgcaaaaaatacaaaaattagctgggcgtggtggcgcatgcctgtaatcccagcaaggttgggggctgaggtgggaggattgcttgagcccaggaggtcgaggctgatgtgtcaccacagccagctagttttttgtgggtgtgtatgtaaatgaggtctcactatgttgctcactgtgttgctcagtgagccacgattgcgccactgcactccagcctgggtgacaaaagaaaaggaccctatctcaaaaaga

SEQ ID NO: 253737 - DNA, 590 bp, Homo sapiens
agaaaagccatacctcctccactgactgctctgttcagctgctgcacttcaccctcacctgcagtgtgtagaggacgttatggtacaatgctattttctactggctctgctactggagattacagcatgcgactgtgacaatactggctctgctactggagatcacagcatgcgactgtgacaaatggatattcccattaaattctttagtagactggggcattccattaaccattggcactatcccaacccaagtgaaacactgggtcatttttttcttgtgagcaagaagtgaagggagaaaacaaaggatatactctaattacctttcctatttcttttttgttgcatgcattatgataactgtatattacacttatttataattaatatatgacaagctgtcagctaaaatttaacaggtgatttgtcaagaaggcccattaatgcatacattaagcagtggatttcagtgtttcctaacaaaattgtgtattggttttgttttttcattctatttagtataaacatttagaggccacctatctttacattttgcagcatttttaaaaaataaaactattgctaac

SEQ ID NO: 253738 - DNA, 282 bp, Homo sapiens
caatataatttattaaaagtaccatgttgactccactttgaacagtggcctcatttctcatgttctgtttcaaaggagccctctgctggacagctctgtgtgatatcacatgcacgcatatatttatatatgatttataggctatagttaatataacccaaaagccatttatgattgaaactctatcgttgcaaattgaatgcatcactgaaacctgttttgtcatcactttttcatatttaatgaacaagcagttgtctaaaaataaaatgttcatcctta

SEQ ID NO: 253739 - DNA, 248 bp, Homo sapiens
agcagaattgccctgctttgcaccaatggtacagcagtctgacctctatcattagagccgcatttttaaaaccacagttcaaaaagtcacgtcttcttgcttggtgctatgtcagtagactaagctctcaccacgtggtggtactgatgggcatcctatacttcagtaacagctcatcaatcccatcaataattgcaacctgatttccaccgaaggcagccaagaccaaggaggcaatgatgagaaaa

SEQ ID NO: 253740 - DNA, 144 bp, Homo sapiens
aatcaaagtgatagatactcaataatgggattcgttccctgaacaggaatctaactcaggctgtagccataaaagcacagaagcttagttactagaccacaggctggagtgttgttttgtctcttttcccttctgtctcttctt

SEQ ID NO: 253741 - DNA, 1159 bp, Homo sapiens
aggtatgccggcatacctggaccttctctccacctccactgttcctattctagtgtccaagcctccgcatctatcaccctggctacctggcagacttcttcgtttttttgttttgtttcattttgtttgagacacgatctcaatctgtcacccaggctggagaacagtggtgtgatctcagcctcctaagtagttaggatcacaggtacatgccaccacacctgactaattttttgtagaaacggggtctcactttgttgtccaggctggtctcaaactcctgggctcaggcaatcctcccgtcttggcctcccaaagtgctggatttacaggtgtgagccatggcgcctcacctggggatccttttagtactgagggaaggaaacctttcccagaagcttcccagtcaccttccctttcttcccattggccacgactagggtgcaggcaccttgggaagggtggaccactgtgactaacccaatgcaggacatggctggccaaggggaggaaggtacatgagccaggacaattcaagctccatcagaaaacggggtcaatagtatcccctgggagaagccgtgcaatgcctgccacaaccctgcagagtcccagcagctgagggggtctattccaggggcgagatcacggcctgcaatgtgtgagctgggtctcaagagggagagagggaacaggctggagagatggaagtctgggagagcagctcctcgggagagcaccatgcatgaggagtgaggcttggggcagctgggagaggacctagagatggggagagagagaaggagtgtggccaggagcacagggggccactcaggccagagaagtgggaactgaaaatgctctggtgaaggggagagcagcagctgggcctgagaccagaaaagcccccatgggctgctggaggctcggggaggtggcagtgagctctgggctcagggcacaagaggcttttggaggctgggtgctggctggactctgtttgccagccttctctgtaagtcccaggcattagagcacagcaagcaggaataacaggagccctgggcccttagaaggaaactgaggagaagcctggatgtccatgctgtgttcctgagttttaaggtgacattttcttggccactttttatctgcatgg

SEQ ID NO: 253742 - DNA, 1831 bp, Homo sapiens
ggccagaatcgaaactgagagctcctgggcaggctcggcagggcaggcagctccaggagggcttcgaaccgtggccaacagttccagtggactgcgtggacccgtgagctcaggagcctcagacgcctccctggagagccaagctggtgttcgaggtggcgcctccagggtccaccctgctgcccaacagccccgcggccaccagagggccgtccctggcccggctgtgtgccctggtggacctgtgtctgggctgctcccgctgcacccagcggctcaatgaaagcacctacgtcctccgtagggtggagcatgactgctcccgcgagatcctgctggcccgctttaagcaggccaccaagagcaaggtctggcgcgtggtgggctgccggcccaccttcccaaggcccctgtgctaccaagtctgccactactacagccctgggctcggctgccggcgccaccgaaaccggtgcacctttgcccgcagtcgcgaggaggccctggtctggaccttcgagcgtcagcacaacctccagcgcctatggctgaaggcggaggtgcagggcagcggggcccagggaggggcaggccgggcggccgacgccatccttacggagtttggcggccgcttcgagctgctttgctccctctgcttcaggcgctgtcccccatgcatctgtcgcgtggacccccaggggcagtgccctgagcacggagcctgcccctccctcctggcccacgtgagcgccgagggccgccgcaagcaacagtttgtggtggtgaggccgcggccccgggccggccagcctcctgcctactgcaggtttgtggggcgtgggcagccgtgctggcgtggggagtcccgctgccagtttgcacacagcgccgtggagatggctgtgtgggaggccgagcagctgggtggcctccagcggggggacctgctcacaccccctgcccctgatggcgacgggcgcacggccccccttggccagccccctggggcccagctgtactgcccggcctgcttggtcacctgccactctcaggaggccttcgagaaccactgcgcatcctcggagcacgcacagatggtggccttcgaccaggccctgccctgggagcaccgttccccacccccgggactctccaagttcgagctctgcccaaagcctgacctctgtgagtatggggacgcctgcaccaaggcacactcagcacaggagctgcaggagtgggtccggcgcacgcaggctgtggagctgcgggggcaggcggcctggcaggacgggctggtgccctaccaggagcggctgctggccgagtaccagcgcagcagcagtgaggtccttgtgctggcagagacccttgatggagtgcgtgtcacctgcaaccagcccctgatgtaccaggcccaggagaggaagacccagtacagctggacgtttgccgtccactctgaggtgagcggagaacagctccgactgggcggagggagccctggggaagtggtgacttcagcccgggcagacgtcaacagcctgggtcatggagctaataccgaggcactgccgctcagcacctgcgtgacctgcagcaggtcccttagcctctctgcctcagtctcctcacctagagacagggggccaggacagtcccaccttggcagggttattctatggagtatatgggttaaaacaaggatttggccaggtgcggtggttcacgcctgtaatcccagcactttgggagaccgaggcaggtggatcacctgaggtcgggagttcgagatcagcctggccaatagggtgaaactccgtctctactg

SEQ ID NO: 253743 - DNA, 173 bp, Homo sapiens
ctcgagctcccgacctcaagtgatccgcccaccttggcctcccaaagtgctaggattacaggcatgagccactgcgcccggcccactttgtggtgtactttggtgaaacagaattcttcatttagccaagttagtccacctgaccctttttttaatgggtcatgcttttgggg

SEQ ID NO: 253744 - DNA, 428 bp, Homo sapiens
ttgtatacatatgtcatttagcacatatattaatatatctgtagtatatatttctatccatttaactggaattctgggtcaaagggcatgtgcatttttaattttggtaggtattactacattgaccttcattaaagattttattggctgggcacagtggctcatgcctgtaatcacagtactttgggaggctgaggtgagtggatcactcgagcccagaaattcaagaccagcctgggcaacatggcaaatccctctctctacaaaaaatacaaaaattagccaggtgtggtggcgtgtggccatagtccgagctacttgcgaggctgaggtgggaggattacatgatcccagggaggttgaggctgcagtgagttgtgattgctctactgcactgtagcctgggtgacagagtaaaatcctgtctc

SEQ ID NO: 253745 - DNA, 350 bp, Homo sapiens
ggagagacaaggtcttgaaatgttgcccaggctggtttcaaactcctggccttaagcaatcctcttaccttggccttgagccatgccacccagccagggaactttgaagtaattttttattatccattccttcatctttcacaggcaatcaatcaccattttctgtccatttttctctgaaatgcatctccctgtttctttttctgttccctctgccaccccaggtatttgtcacctcatactaaattatttaaaattcctcctaacagagctttcctgattccttgttctcttaaaaaaaaaaattatttcttttttcagagacaaggtctcactatgttgctcaggct

SEQ ID NO: 253746 - DNA, 743 bp, Homo sapiens
ctttacatgcattatttcatttggtcctgacacaaatccaactcagtagggacttttatgatcatttccattttccagatgcagaaactgagtgtcagagaggaaattacttgctaaaggttacagagctagccagtggcaggctgcatgcttgaacccagccctgcctgaccacacagcctctgccctcgtgtatttactatgctgcctccctgatttctgaccggttcctggagcacttaaagtggagcaactacttcacactcagcatgtgctgttttattgctacgaacacatctttttaggttcaggccctgtttattcaaataaattatcagggccttgagggcaagaaatgattttatatcagcttgcctcactaggacttagcacaatgctctcaaataataggagcctagttaactgctcctttatttcaacagttctttaatcaaacttcaaaggcagcatttattacatttacaagtcttattgtttgcatctgtccccacttccagcctggaaacatcacatatccctcatccgtgactcagcactgagcacctgggagctgctcagtaaatattgctgaggaattgagttgatggttctcgtcaatactgatgattaaccaggattaacgttttctcttttaaatttcattttccatctctgcgtgccgtctttttattgttctgcatttactcaaattattagacagtgaacttaaaacattcaacttg

SEQ ID NO: 253747 - DNA, 282 bp, Homo sapiens
gaagtctagcttgcaaaactggttgaattttgtagtaaacattttcctcatgtatctaactgggcagctgtgagttgtaagaagtatctgtttattatttatgtgctggttttattctaggactttggctgttagtcctcccttttttttttttttttttttttttttttttgaaaccgagtctcactctgtcactcaggctggagtgctgtggcacgatctcgcctcattgcaatctccacctcctgggttcaagtgattctcctgcctcagcttcctaag

SEQ ID NO: 253748 - DNA, 426 bp, Homo sapiens
agtttggatgctgggtcctgacccagaaacaacacggagtagatctcggatttgctttttcttaggtccaatgctaggacgattactttatctgtggtgaggaatgttataaaaaaccattgttggaatgccaccaaaatacttctttcccttttagcatcatcaccaagattctagaacgaagtaataacagttgccaaccttgagccattctccagctgttgtcatgtttcagtcagacaggaagtgttggcgagtaatatgggatttattgggagtgttcctttacgtgagtccaggaaataagaactagagatgagcttgggtgcctctgcttcttttatttctatggaacattctttggggtcagttttgaataatcactgggcattatcggatttctatcactattttttgcatgttctt

SEQ ID NO: 253749 - DNA, 429 bp, Homo sapiens
  misc_feature (206)..(206): n is a, c, g, or t
aagtgcttcttatggaagatcaaagaatgtggtttgttgagatggaatctactcctggttaacatgctgtgaacattgttgaaatggcaacaaaggatttagaatattacataaccttagttgatagcagcgtcagggtttgagaggattgactcaattttgaaagaagttctgtggataaaatgctgtcaaacagcatcacatgntacagagaaatctgtgaaaggatgcctactttgacccctcctattcagcatagcagtgaagacctaaccctgagcaatgaggcaagagaaagaaataaacggaccaggtgtggtggctcacacctgtaatcccagcacttcggaaggtcaaggcgggcagatcgcctgaggtcaggagttcacaacagcctgggcaacatggcgacaccccatctctacaaaa

SEQ ID NO: 253750 - DNA, 358 bp, Homo sapiens
ttcatgatttaaaaaaaaaaaaaaacctgtccacaggaactacgcatgaaggggacataactcaacatgataaatgttgcatgaacacacaactaacgccatcctaaacagggaaaagctgaaagcctttcctctaagaactggaataagacaaggatgcctactttgacccctcctattcagcatagcagtgaagacctaaccctgagcaatgaggcaagagaaagaaataaacggaccaggtgtggtggctcacacctgtaatcccagcacttcggaaggtcaaggcgggcagatcgcctgaggtcaggagttcacaacagcctgggcaacatggcgacaccccatctctacaaaa

SEQ ID NO: 253751 - DNA, 255 bp, Homo sapiens
tgagatggggtctcaccatgttgcccgggctggcttcgaatgcctaggctcaagcaatcctcccttctcagcctcccaaatagctgggattacaggtgtgagccaccgcgcccggccgaccatgcaagcttttctgacggttcctgaaaccaccgagttggttctaccccaggaccgacgcacactctgtccctgctgcatggaattcttccctctggtcttgacatgactgggaaggcttgcgtgcgcatgtcg

SEQ ID NO: 253752 - DNA, 801 bp, Homo sapiens
tccaaacctaaaaacaaagcttctgagccaactgctccttgcacaattctggcaaatgtctagctgtccacagcgttagacatggaatatttctactttgaccacagaagtactaacaatagtcaagttatatagagcagagtttctcagacgtggcatgtagggctggttcttttctttgtcatgagagtgctaggtatgtgcgttgtaggctgtttagcagcatccctggcctctactcactagaagccagcagtacccccgtctccattgcagcaaccataaatgtgtctaggcaacgcttgatcctcccttccccttcccagcagaggggcaaaaatggccctcatcgaggagcactgttgagcctctggggttctccaaaatagtgttttttctgtttttttgagatggagtcttattctgttgcccagggtggagtgcagtggcgtgatttcagctcacggcagtctctgtctcccgggttcgggcgattctcctgcctcagcctccctagtcgctggggttataggcacataccaccacacccggctaatttttatatttttggtggagacaggtttttgccgtgttggccaggctggtctcagactcctgacctcaggtgatccgcccaccttggtctctcaaagtgctgggattacaggcatgagcccaccacacccggccaagtgttttatgtgtggattagagcctggatgtgtgtttataccctggagtactggtacccatgcttcagaggaactgaacataattacaggggtgtaggaagtaaaagaa

SEQ ID NO: 253753 - DNA, 283 bp, Homo sapiens
ggtgattcgcctgcctcggcctcccaaagggctgagatcatacgcgtgagccgctgctcccggccatggcagatccttcttgaacacccactatgcatgaggcctccgctgggagttcccatcattcaccctcatagcagctctacaggaaggagctgtctgcccccaagtcacacagtggacaacagcagtttgggggtcagccttggcccccccactccgaactcctcgccgcctatgccctccactcctttccactgttaacccaagatggaaaagctta

SEQ ID NO: 253754 - DNA, 188 bp, Homo sapiens
agggggaagcggaagttatagcccagctcccccagcaggaggcctgagcggtgggtctctgtgactacctccttcataaagtcccacttgcccaagaacttgtatgataagttggaccagggctgagcgtgccggggccgggaagcatgttgcagagaccgggagtggggcaggacctctctcccttc

SEQ ID NO: 253755 - DNA, 307 bp, Homo sapiens
ttctttttttttggaaccatttctctgttccaggaagttgtcaaaacatgtgatttttaactttaaagaaaaacaggactgaaatgtgtcaagtccctggaaatagcctgaaactcaattgagtttatgcagaaaaacacacactaaaaaatcacaagaccatctggccacagagatctcagtttctctgacaacaccactggaactgtgggagggtaagtcttgtaatcaccaaattgaaaatcagtcaggagaacaaacaagaacagacaggtttcaaaacaatgtatcctacttcctgttctac

SEQ ID NO: 253756 - DNA, 690 bp, Homo sapiens
cccaggctggtcttacatactcccaggctcaagtgatcctcctgcctcagcctccgaagtgctgagattacaggtgtgagccactgcactcggcctcttttccctttttaaagtggttgttttccatctttctcctatttcccttgctcttgaaatacagctaaaaaaccccaaaaaaacaaaactgaaaaagaattctgggctttgtaatgttagtatgaattcctaatattgtgctgtggtgaagagattgaggggtaggtgcctggaaaataaagggaatcaccaccactgatggggaagacttctatatatgttctcagaggtttgtcaattggtgttgtcttattcagaatttgattactttgtttgtaaagtgaataactttgctaaatttgtttgttttatgccgtagagataaagggccagaagtttcattttcatagcttgttagtttactttgatatttgacagtgtaagtggtataataaatcactgatgcaagaaatacatctaaatagaccatatgctaggaggtatgttgtttttagtcttcattactggatttaaaatacttagaattctacaattctaatacttgctgatagttattaattggtacaagaataatagtttggcaaatagtaacttgtttaaacttaagaaaacctatattttctttctttcttt

SEQ ID NO: 253757 - DNA, 240 bp, Homo sapiens
actcaggttctgttgtgttttgttttgctttcctaacataaaggccactagcttcaggttatgctattcattcagcctgaaaatagaatacatactttcagaagatcctgttctctgcattcacagctgttggagagtctttgaaaatacccttgccagtatacagagatgtcagcctaaagaacagaaagagaagatgggggaggaaaaaaaggcaggggtaaaaaataaaaagttgcc

SEQ ID NO: 253758 - DNA, 188 bp, Homo sapiens
gacataagcctagcccacacaggagaactgagttgtcactgaaattagtctccccaaaggtgtgaaggtcaggacttttatggacaatttggtgggcagggtaatagataatgggtgttgctgattgcttgtaaaagaaatcgtaggggtgtggaaaattgcccttgtgagtgagtactcctttgggt

SEQ ID NO: 253759 - DNA, 411 bp, Homo sapiens
acagagtcttgtatattcatgtagctcatgatgatggaatcaagtttgaaggcttaacctgtgcttaacctatattgggcattgtcaagacttaaatttagaacactggaaagcaagtataattaattttacaaatagggcatcaaattttacaaagactcctaaggctatatggtattccttttataagacatggaaaaggcaaagataagggaaacgaacaaatcgctggttagaagtaggggatttgagtacatatgggcttaagagtgttctgtcatgattgtagtggtgaaaacaagcatttgcaaaaactcataaggctactcttaaaatagcaaattttgttgtatgtatattttaaagttaaacaataaaaatgctttcagtttattaaagaactcaaaaaaa

SEQ ID NO: 253760 - DNA, 409 bp, Homo sapiens
tacctagtaaaagggactctgcagatgtaattaaagtcagtaatcagttgaatgtatcttcccagttataataagtggaataacttcagctaaatgagttgaacttatcttctcactgaataagattattcaagctcacttaagaagattcctactcaattggagattatcctgaattacctgatggattcagtgtaataacatgagctcttagaagtaaaaaaagaaagaggataacatcagagagatttgaagtgtgggaagtatttgacctgccattgctgttttagagatcgaagaccctggtctgttgtggtggctactttgaggggctgaggattttttgatcccaggagtctaagatcagcctgggcaagatggaaaaaaaaaacatttctacaaaaaatgc

SEQ ID NO: 253761 - DNA, 527 bp, Homo sapiens
tttcagggagaaacaattaacaattcaaaacattatataattgggcgtcttttattacaattctttatctactaagaaacctgcttggagttaggaacggaatctctcttgcttgtttatttatctagagcccttgatgttgtgttttagaggtttcgcaaatatttgctgagtttgatggtgagagaaagtctgaatgcagagatctggatgagcatctaatgaatgtgaagaattagggttgagataaccaagaatgttccttgggttagaccaatggttttcaaccaggtacgattttgtatccccagggcatggcaatgtttggaaacatttttgctcgtcacaactggtggcagctattgctgacatctagtgaggataggctagggatgtttgctaaacatcctgcaaggcacagggcaatccccataacaaggaggtatctggctccagatgtcagtggtgctgcttttgggaacgctgtgttagagttaagctgggcttccaaagccctgtggaaatac

SEQ ID NO: 253762 - DNA, 423 bp, Homo sapiens
tttcagggagaaacaattaacaattcaaaacattatataattgggcgtcttttattacaattctttatctactaagaaacctgcttggagttaggaacggaatctctcttgcttgtttatttatctagagcccttgatgttgtgttttagaggtttcgcaaatatttgctgagtttgatggtgagagaaagtctgaatgcagagatctggatgagcatctaatgaatgtgaagaattagggttgagataaccaagaatgttccttggctcacagctattgtccctctcccagctacgatatacgacgccccagggccataggctagtcatgcgcggcacgttcgagtttagagcatctcgctggcagactactcggattacattctgactgaagtatagcctagggatgctctaggacacatg

SEQ ID NO: 253763 - DNA, 489 bp, Homo sapiens
ggccctacctgaggtgatggagtctggcctttcaatcccaacactcagcacactgggtgtggcctcacaggagccaagcaagcttctgctctgcacactgctttggctgggcattgttagggattgacttgtgtccccccaaaagacacgctgaaacctaacccccaacacctgtgaatgtggccttatttggaaataaagtttttgcaaatgtaatcaagttaacatgaggtcatatttgattagggtcggccctgatccactatgactggtgtccttttaggaagagaagaagccaggcgcagtggctcatgcctgtaatcccagcaacctggccaatttctctttcgtttttttgtgggtttgtttttaataacagtatgagaattaggatacttgagaagcaatatgagccagaatccttgcagatgtttacaaattcccgatctcttaactttttactgttataattcccacacctcgtttgag

SEQ ID NO: 253764 - DNA, 452 bp, Homo sapiens
atattgttgagattttattgattaagaagaattagtccccacaatttggtatgatttttaaagattttatattatttttaaagatttaaattatatgaaaatgttttttcaaaggtctattaatgtgatttttttaatctttaaaattactttgtgaaaatgataggttttctagtatggaattatccttttattattgcaataaactccactttaccatgctctgtcattatttaaccataccagtgatggccaggtggccaaaataaatagccaaatggctaaaattgtattgatgatttttgcaaatgtaagtaaggaaaattgttggttaaatttgtagttattgttacattcatgttcattttgattagcataataaactaatgaggacaggcttatttttctctctcacaaatcacttttacagttaaactctgatatataactta

SEQ ID NO: 253765 - DNA, 772 bp, Homo sapiens
caattactccctttggcaataaattcaggtatgatgcaaagaagacacctgagagggaggcctggagagaacactaaatgaatccagcctggaggctgcagtgggcctggaatcgccacctccatctctatgttgaaaagacgaggacaccattgtttcctgatcaacttcccatttcatcccagcagagggcaccagtgtaattctgttcccagctgtggaggctgagtggaaggcaggcgtgtcaggcgtcactctccaggaagaaatgaccccaggcaaactgcatagcagtgcaataggaacaactattgtgattgggtcctattttgaagttaatcctaaatcaattttgattttttggtccttcgaatatgaccaaaaactcagtctacaagtagattgttaagtcactttaacaggtatgctgaaataatattaatatctttgaactgaaacaaaaacaacccaaaacaaaaaaaacaccccacaccccaaaaccaaacatcgccaaattatacccccttacccagtcacccccaaaaaaacaaaacgccccttttggcccccagggggggacctttgcgcccttttctttttggggggggaaataaattaccccgcccaaatgccttcctcggtttgggtttttgggcgtgccgacgggtcccccctctttcaaaggggggtttccggttttcccccaaaccgggcggatacctggaaaaaaaacttggaagcaaagcgcttcaaagggcggaaacctataagg

SEQ ID NO: 253766 - DNA, 420 bp, Homo sapiens
gaaataaatcagttattaaaaacaaactcatagataatccagatattggagttaacagatagggcatcataacatctatgatgaatataaaggaaagaaagaaaaaatgaaagacaaaacaggttgtgtcagatttctttctggaagctttaaaatgctcactttattttcatagattctaatttcctaaattatgtttgatgtttcaagcaaaaatcatagcattgtctagtgttattctaaatggatgtaagacaattatactacaaatttgatagagtaaagagacataatatgacagaaggttgctatacttcactcagactggaataaagatgataccaattgactgtgataatgtttatataaatgaatatacactaagctgtaaaatgcaaccactaagctataaaatgcaac

SEQ ID NO: 253767 - DNA, 531 bp, Homo sapiens
  misc_feature (34)..(34): n is a, c, g, or t
  misc_feature (37)..(37): n is a, c, g, or t
  misc_feature (474)..(474): n is a, c, g, or t
  misc_feature (480)..(481): n is a, c, g, or t
  misc_feature (486)..(487): n is a, c, g, or t
  misc_feature (493)..(493): n is a, c, g, or t
  misc_feature (496)..(497): n is a, c, g, or t
  misc_feature (500)..(500): n is a, c, g, or t
  misc_feature (509)..(509): n is a, c, g, or t
  misc_feature (514)..(514): n is a, c, g, or t
  misc_feature (519)..(519): n is a, c, g, or t
  misc_feature (523)..(523): n is a, c, g, or t
  misc_feature (531)..(531): n is a, c, g, or t
cgggtccctgcttgatgaggtcagtaccgtacgnatnattgactcagtgcagccaaaacgccgtgccgctcccccatttgtgtcggtgagagttaggggagaggtgccttgagacagagcaggagtctggctgggctagcttttatcttgtgctccctggaaccctgactggatgatttctgaagtcgagctggagcccatctagagggaaggtgaaacttctcctcagcatgcagggcctcctgcacccacactgccacagccaccgcattaccagctcctgccagtctgaggagcaagaggctggcatgaagaatcagttccattctttcctccctaaatttagaaaaagcctgttttgcaaagctttcttcagtgtttcaagacaaaaaaaaaaaaattaagcagttgcacaacatgcatatcttctcctggcctgcagctccaggatatgcagctgggagcggcacatgngttggnngatcnnaagagncgnngtntaacggaantaaantcatnaaancagaaccn

SEQ ID NO: 253768 - DNA, 537 bp, Homo sapiens
  misc_feature (4)..(4): n is a, c, g, or t
  misc_feature (6)..(6): n is a, c, g, or t
  misc_feature (12)..(12): n is a, c, g, or t
  misc_feature (20)..(20): n is a, c, g, or t
  misc_feature (480)..(480): n is a, c, g, or t
  misc_feature (486)..(487): n is a, c, g, or t
  misc_feature (492)..(493): n is a, c, g, or t
  misc_feature (499)..(499): n is a, c, g, or t
  misc_feature (502)..(503): n is a, c, g, or t
  misc_feature (506)..(506): n is a, c, g, or t
  misc_feature (515)..(515): n is a, c, g, or t
  misc_feature (520)..(520): n is a, c, g, or t
  misc_feature (525)..(525): n is a, c, g, or t
  misc_feature (529)..(529): n is a, c, g, or t
  misc_feature (537)..(537): n is a, c, g, or t
aggntntcctgntttcatgngatgaggggctaaaagagagaaacttcactctgttgagccacacgcacgtgccgctcccccatttgtgtcggtgagagttaggggagaggtgccttgagacagagcaggagtctggctgggctagcttttatcttgtgctccctggaaccctgactggatgatttctgaagtcgagctggagcccatctagagggaaggtgaaacttctcctcagcatgcagggcctcctgcacccacactgccacagccaccgcattaccagctcctgccagtctgaggagcaagaggctggcatgaagaatcagttccattctttcctccctaaatttagaaaaagcctgttttgcaaagctttcttcagtgtttcaagacaaaaaaaaaaaaattaagcagttgcacaacatgcatatcttctcctggcctgcagctccaggatatgcagctgggagcggcacatgngttggnngatcnnaagagncgnngtntaacggaantaaantcatnaaancagaaccn

SEQ ID NO: 253769 - DNA, 535 bp, Homo sapiens
  misc_feature (20)..(20): n is a, c, g, or t
  misc_feature (25)..(25): n is a, c, g, or t
  misc_feature (478)..(478): n is a, c, g, or t
  misc_feature (484)..(485): n is a, c, g, or t
  misc_feature (490)..(491): n is a, c, g, or t
  misc_feature (497)..(497): n is a, c, g, or t
  misc_feature (500)..(501): n is a, c, g, or t
  misc_feature (504)..(504): n is a, c, g, or t
  misc_feature (513)..(513): n is a, c, g, or t
  misc_feature (518)..(518): n is a, c, g, or t
  misc_feature (523)..(523): n is a, c, g, or t
  misc_feature (527)..(527): n is a, c, g, or t
  misc_feature (535)..(535): n is a, c, g, or t
agggatcagctctcttgacngctcngaccctacgtatgagccgactcatagggtcacccaatccatgtgccgctcccccatttgtgtcggtgagagttaggggagaggtgccttgagacagagcaggagtctggctgggctagcttttatcttgtgctccctggaaccctgactggatgatttctgaagtcgagctggagcccatctagagggaaggtgaaacttctcctcagcatgcagggcctcctgcacccacactgccacagccaccgcattaccagctcctgccagtctgaggagcaagaggctggcatgaagaatcagttccattctttcctccctaaatttagaaaaagcctgttttgcaaagctttcttcagtgtttcaagacaaaaaaaaaaaaattaagcagttgcacaacatgcatatcttctcctggcctgcagctccaggatatgcagctgggagcggcacatgngttggnngatcnnaagagncgnngtntaacggaantaaantcatnaaancagaaccn

SEQ ID NO: 253770 - DNA, 361 bp, Homo sapiens
cttgcttctcttagtcattttcacagcacgacttcattgggatatatggaagattagcatgcccgggtctcacctctccctttaattctgcaggagtctggctgggctagcttttatcttgtgctccctggaaccctgactggatgatttctgaagtcgagctggagcccatctagagggaaggtgaaacttctcctcagcatgcagggcctcctgcacccacactgccacagccaccgcattaccagctcctgccagtctgaggagcaagaggctggcatgaagaatcagttccattctttcctccctaaatttagaaaaagcctgttttgcaaagctttcttcagtgtttcaagacaaa

SEQ ID NO: 253771 - DNA, 300 bp, Homo sapiens
agctcgggctgccataacaaagtaacagactacgtggcttcaataacaggcttctatttcttacagttctgggggctgaaaattccaagatcaaggttctggcaaggtaggtttattccaagtcctcttctcagggcttgcaggcagttctatttgtgttcacatgacttctgtgtgcagcaagaaacacagcaatagagtgctcaagagcctgctccctggtgtctcttcgtataaggacagcagtcccatcacgggagctccagctcaggacctcatctaaccctgatcacctcccaa

SEQ ID NO: 253772 - DNA, 483 bp, Homo sapiens
tctatcctggagcagaaaaatcctgtcttcattgctatagctacagattcagaaatgagcatgtaacaaattcaggccaaagagaggcaatggaaatcagagaaacactgttcctgaaagcttctgtcactcaagaatccatgaaacattcatgaacttcacatcagaagccaagcccagaaaatatgggtttaaggtttgcctatatgtccaatacaagagaaaaaagaacattccacttctttagaaggttctactttgatctcctggaagatttctgtatttgtcttcttaactcttgagttttgttgttgctaatattggatgaagaggagacaaaatgattggatctagaggagcaccgacaagcaaatggcagattcctaggccctcaccagaggctgagcagatgttggtgccatgcttgtacaagtctacggaaccatgagctaaaataaaccttttttctttagaaattaatca

SEQ ID NO: 253773 - DNA, 570 bp, Homo sapiens
tctatcctggagcagaaaaatcctgtcttcattgctatagctacagattcagaaatgagcatgtaacaaattcaggccaaagagaggcaatggaaatcagagaaacactgttcctgaaagcttctgtcactcaagaatccatgaaacattcatgaacttcacatcagaagccaagcccagaaaatatgggtttaaggtttgcctatatgtccaatacaagagaaaaaagaacattccacttctttagaaggttctactttgatctcctgattccagttgtgaaaaaaaattgtgcctaaagaatatagtccctttatagaattgttttgaaacctaccacaggtatttctacacaggaagatttctgtatttgtcttcttaactcttgagttttgttgttgctaatattggatgaagaggagacaaaatgattggatctagaggagcaccgacaagcaaatggcagattcctaggccctcaccagaggctgagcagatgttggtgccatgcttgtacaagtctacggaaccatgagctaaaataaaccttttttctttagaaattaatca

SEQ ID NO: 253774 - DNA, 347 bp, Homo sapiens
ttttttttgcacaacatggagtgaggacaaagggaagaaactcaaagtccccactcccatgaagccttgagtctagtaaagtatacaaaaaggtgaacatatggtgaaagttcatgtgttcaggattaatgtgcagacaagaataggagcattgggtgggtggggacgagctccccagagactcatctgaataacatgtgtcctgtgctttccaaaagtagccctgacccacagcttcaggtatattgactcattcagcctgcaaagcgccctgtattagacagagttctccagagagacagaaccgatagaatgaatggatgattagatagatgatagatagacag

SEQ ID NO: 253775 - DNA, 518 bp, Homo sapiens
tgtttgccaccatccatcctggcttctatgggttccatcgggacacctttgcctatgaatgccagcctcagtcccaagcccattttcctgagggtgaaggggacttttattatataggggccttatttggtgggtcagtgctggaggtttacaggctgatcatggcctgtcaccaggtgatgatgattgaccaagccaaccacatcgaggccctgtggcatgacgaaagcctcttaaacaagtacctgcttaaccacaaacccactctcccttgagtacatgtgggattaaaaagtcgatggagtatacgttggatgaatacctggtgggtttgtgcaccatgataaactgcaagagatctgtggtcttggtaaataacaatgaggaaatgtgaactgatgagggaagcttccagaaagagaccagagagggggtgattgccagtcagcccgtatcttcctcctgaaatgctaccctgatttaaaatcagctttacaataaagagtatgactccaaaa

SEQ ID NO: 253776 - DNA, 191 bp, Homo sapiens
tcaaggccagactatagcaagttatgtccatggtaatagttgctaacttggctcattctgctacctgaggatatttttctatctaacctctttaaggaaggagaatatactaacttaaatggattaaaatgtagcatatacttggtttgtatgcttgattgtaaattaacttaccagtcaaagctgctgct

SEQ ID NO: 253777 - DNA, 466 bp, Homo sapiens
tgccatttgggaatatttctatttcatcttatcattttattgtaaatgaatagtagttaccttttaataaatttacatgtcacattacttgtgagataataataatcactaattaattaatccttgtgttttttggggcatgaaaaattttgcagaacattttgaaaatataggaaaatgtaagagaaaattaaaatcatgtgtattcccattattctaagaactgatgttaacattttgatctatctcttcaatatttttccaatgaatactttaacgtaaatgacaccagactgtatattttgttttgctatctattctttgaaaagcggtaatatattatgaacatttttcaatgttaaaaagtttctacaatgatttttgcatggcttcatatagtactgtcctgttgtaattcacttatttaactctgtgctgttaatgattatattatttccaactttat

SEQ ID NO: 253778 - DNA, 349 bp, Homo sapiens
gaattgtaagggacctgaaaggtcatttagccaaatggcatactatatagtttagcccactccaacctccagatgaccatttcaagacagggcactctctaattctcaaagtagttcatgccactattgggatgtcctaattgctagaaatccatgcctttattaagtcaaattttgcctcctcctactcacagtccaggcagtgcttcttgggacctgctcactcctccacgatggcttttaagaaggctgaaggcatttactacgggcaagtaaatggcactgactttggagtctgaagaaccacattgagtttttctacatttgagggcataatttgctagagagg

SEQ ID NO: 253779 - DNA, 459 bp, Homo sapiens
ggagaaggctttgccttggcccccagaagagcagatgctccagtcaattctggagtaggaagaaaagatttggaatactttttgactccctgtgatatggtttagatgttttgtctcctccaaatctcatgttgaaatgtgacctccagtgctggaagtgggcctagagggagttgtttgggtcatgggggcagattccttatgaatatcttggtgctgtcctagtggtaatgattgagttctcattctacgagttcacataagatcttgttgtttaaaagagcctggcacctcctttctttctctcttgctcactctcacaatgtgacacactggatccccttgactttccaccatcattgtaaggcttctgaggccctcctagaagcagatacctgcaccatgcttcatgtacagcctgcagaactgtgagacaaataaacttgttttcttctaaaa

SEQ ID NO: 253780 - DNA, 514 bp, Homo sapiens
actctaaatggatccgccgttttgagctgtcgtgactgtcataaccttgggcttgggaaagtgaattggcctgaatagcaaggaggagaacttgggtgtggaaataccggaatctcactctattgctcaggctggagtgcagtggccacaaagcgggagattggcacgagggataccaacaccggaatatgtgatgagatgtgtgaagagcatggcaatggatgcaaactccctttgtgtttctggctttaagcagctctatactctcatgctgtcctacactcagcagcaatttgtcacaagtttgggaaattcttcctactcttttgaactccagcccaatttcctttctatcactgccctaggtcttactcttccagaagaaaaagggaaaacccaacctgaatgtcccctaaaagtgaagaaatgtccacacttctatgtgcagattggtatctacatacagacctcttggaggagtcagacaaacaagatcttgaatctttactgatct

SEQ ID NO: 253781 - DNA, 598 bp, Homo sapiens
actctaaatggatccgccgttttgagctgtcgtgactgtcataaccttgggcttgggaaagtgaattggcctgaatagcaaggaggagaacttgggtgtggaaataccggaatctcactctattgctcaggctggagtgcagtggccacaaagcgggagattggcacgagggataccaacaccggaatatgtgatgagatgtgtgaagagcatggcaatggatgcaaactccctttgtgtttctggctttaagcagctctatactctcatgctgtcctacactcagcagcaatttgtcacaagtttgggaaattcttcctactcttttgaactccagcccaatttcctttctatcactgccctaggtcttactcttccagaagaaaaagggaaaacccaacctgaatgtcccctaaaagtgaagaaatgtccacacttctatgtgcagattgtagacctttggaatctacattcaacatttgatactgcgtgtgactcctgatgaacacgctgaagatacatgatgtccagtaatttttactggggataatacctgcaatatacataagatggtgtcattaaagtacatttaaaatta

SEQ ID NO: 253782 - DNA, 431 bp, Homo sapiens
gctgttgctgtcacacaggcccaaggctgtggaggctcacaccagggtggtagaggaggatggtgaggagtggtcggaatctggttgtgtgttaaagatggggccagcaggactcaccagcagcctggatgaggggagcgatagggacagaagagttaaggctggtttcgagactttgggctcaagcacctcaaaggatagcattgccaccaactctaatgtatggagaaggcttgggaggagggtccagaattcagacatctcagtagaggtgtctagtaagtaggcagctgagtatctgagtgtgacatttagcctggaagtgatatatttgggcattgtcagtgtttacaatcaggagactggccaggatcactgatttagtttttgctgctgctgtaacaaagtaccataaactttgtaacttaaaa

SEQ ID NO: 253783 - DNA, 495 bp, Homo sapiens
aactcctcgaggctgacaaggaaaatcctaacttaaactttcaatgatatttccccatcttattcaagaagtgtgtcaatttcattcaacctgaacacatctggtgaagacagatagctatgagcaattcaacagctaaaatgaaagtgacgctctttggaatggtatatttaaggatattgggagggttgtggtggtgaagaagtaaagttcttgaggtcaagttcctttcctaggtaagagcctgcagagtgcacagacatgcctggagctggggcagcacctgggcatgtgagggggattgtggccagggagactcccgtgggagcttggtgggaggggcaatggagtcccagctgtcttcatttctgttgcaactaccttggacactgtagtactagagtaggggttcttctagagtcttctgagtctcagggacatatgtatggagtggagctcacacagctccactcaaagaatctaagagcatgagaa

SEQ ID NO: 253784 - DNA, 735 bp, Homo sapiens
cagcatcacttctgtgaaatccctgcccaaggtatgtaatcagaatcccatcatgaggcacacccaaatgagggacattctacaaaataactaccttgcaatcttcatagagtgaagattatgaaagtcaaggaataatgaggaactgttccagactgagggaaagaaaatatttgacaagcagatggtattcgtgcttctgaactgaattcttttgctctaataaaagacattttgggcacagttttctgattctgatgattgtattgtgattatgtaagagaatgtaggaaaagtattcaggggtagtgtgggacaggtcagcaactcactctgaaatggttcaggaaaatcagttctttatgctgtattttcaatccttgtataaattcgtgtttgtttcaaagattaaaaaagagagaaaatggaggggaaaatacctggtaggcaaatgaacaaaagacatgaataggcaattcatttaaaaattaaaataggtcttaaaatatttaaaaaaattcagcatcactgataattagagaaatgcaaattaaaactgcaatgaaatattctcatctgtcatgagaaggttgtggctgagttaagagattggcaaatccccacccaccctgcccaaaagcaactgtaaatgccattctgtaaacaaaaggaatcaggaacccttggtgatgtgactgatttcagagctggggcagataaagtacaagctgagct

SEQ ID NO: 253785 - DNA, 235 bp, Homo sapiens
  misc_feature (141)..(141): n is a, c, g, or t
tgccaaactttccgtgattggtaatgcacctttattgtaagctcagcaaagcagtccctcatctacgggatctggcaacacagagcattcctgcagcttccaaaaacagatctccatccagcacagacagacccagttagnttggtgatcgataatcaattgagggcatacctgctgtgtaggaataagggctaacctgtgtagtctgtcattcttcttttcctctttcagtttt

SEQ ID NO: 253786 - DNA, 259 bp, Homo sapiens
tgccaaactttccgtgattggtaatgcacctttattgtaagctcagcaaagcagtccctcatctacgggatctggcaacacagagcattcctgcagcttccaaaaacagatctccatccagcacagacagacccagtccgacctcacaatagaaaaaatatctgcactagaaaacagtaagaattctgacttagagaagaaggagggaagaatagatgatttattaagagccatctgtgatttgagacggcagattgat

SEQ ID NO: 253787 - DNA, 405 bp, Homo sapiens
tcttctttttctttttttagagacggggtcacccaggctggagtacagtggcataatcatagctcactgcagcctcgctcatgaactcaagtgatcctcccacctcagctgaccaaatagctgggactagaggcatgcccaccacacccggctaagcacctttgattctaatattgaaaatatcattataaaatatctagtaggtatggattaatgaatgagttaaatggcagatgtttgaccctaataagtaaaggtttcgggacgccagggagatggtaatatctgggatcttcttaggcctcattaccaggacataaagaaacaaaatgaagtttctcaaaatgcccatttaatacattattttttatcgtaataaacatacggccttttcagatcttattt

SEQ ID NO: 253788 - DNA, 484 bp, Homo sapiens
gcagagaggggtgacttggactaggatacgtaaagtgaatccggaaaagagacaacctggatgatcaagcaggaactgatttaaaggaattgatgtctgctgctaagagtatgaagccctgagggctgagaccacatctgcctggttttctgtggcagctgcagcatcaacactggctcttcgaagagtagcagctgatgaacattactccggcaaacaattttctctgctaggaactggataaatgcaaaggaaggaggggagagtgtgtcagacggggaccctgccctactggagcacacgcatcaccacctgggttaggacggcctcacccgtcccctggaccttcaccttatgtcccagagaggagacatctgctagagcaaagaaaattcattgtcatataaaacaaacaagaaaacacacacacacatgtgcacacacacatacagaaagcaaataaaacattgttagatgatgtaaa

SEQ ID NO: 253789 - DNA, 491 bp, Homo sapiens
ttcccaactttaaaaaaaaatccactttctgctccaaaggtgaagtgtcacattagaaggcaggatgctttgtgctccttcccgcaagctaacttccaaatacattctctatttttatatcagactcttttattactttttattattttttatattagactttacatgaagtgagccgttaaccttttttgttacaagacttcatgcccacaggtatattcaagtcccagatggaaagatgatctggatcaggcaagatgctgaccaggggaacaggagacacagtcaagggaatctgaggaagtacatgtttttgcccaatacagtccccaccttgtgccactcagatgtcctcatgccctccaactgtggctggttttataagcacatgactagtgtagttgcacgcggtcttgtgcttgtggggctttttgcttggattaatgttctgcacttgcatttttatttttcagacagcggaggagtatccg

SEQ ID NO: 253790 - DNA, 726 bp, Homo sapiens
cgtacacacacacacacacacacacacatacacacacacacacacacggggagagaagccaaaacttggtgagttttgaaagatgtagaattactgacttttaggtgcactgggacatgtatttctttagctatatatatgtgaatattttttcaaaatttgtttctgattttatatgtagtctaaattcattttaaaaacatggtatattgttaatattcctagattaaaagttatttgttgatcatttttctgcctcatacaggtattccagatatacaaaaattattaagatagagagttgaacttatggcaagtagtatctcaaatccaataccatataattttcatattgattatggaatttaaagaatgagaaactgacttcttattaagtctttggaaaaggtagcatttgatgcctcaaaggtgaaatgtgactttcttaattcttttaaatataaagtagatgatattgattctgtttcattggattcatctaaagggaaaaggatataaacctctaaagttcagtggatttaatcactgcagtgttagatgttaaaatacctaaaatgatgttttaaaagttcatatatacttttacatttgttccagctataaaataaaattaaattaggtataatgtatgtgaaaagatgtttactattatagtctcatgtaatttatcaaaattgttaaaaatagttgttagcttagtttttc

SEQ ID NO: 253791 - DNA, 229 bp, Homo sapiens
tgacttctaaagaatcttggtacgtgaggaagaaacccagaagaggaagaggaaagcaaaggagtcagggatggctcttcctcaggagagacggtgtttcaccattttggccatgctggtcttgaactcctgacctcaggtgatccgcctgcttcagcctcacagaatgctgggattacagacacgagccatcatgcccagccccaccaattgttattaaatatatatg

SEQ ID NO: 253792 - DNA, 293 bp, Homo sapiens
aatgttgagtaagtccttcttgaaaatgttttcaagtgggagaatattagtggtaaatttctaactgtcttttaacattttaattgggcttggatcattcacattttccccaaatcctttctaaattaaaaaaaaggtaaaggccaggtgcagtggttcatgcctgtaacgggtgcagtggttcatgcagtggttcatgcagtcccagtacattggaaggccgaggcaggaggatcgcttaagaccaggagttcaagaccagcctgggcaacagaacaagacccccatctctt

SEQ ID NO: 253793 - DNA, 316 bp, Homo sapiens
gaagaagatgttaatatcgactttacagcagagaaaactcagattctagcaggtgagtcctcaggtcacaggcgtaaagtcacagcatggaagacccatattcagtgggcgtcgtcttgccacatgctttgacctgtagctgtggtccctaatcccagccaaaggcttcactgttgagcctcaggaaaccagtgaacgctccaggattccctgcaaaatgtgccaaagcgtgcatacatttgcagaagcaaaatcacagctttcatccgattttcaaagctatctggaaccaaaaaacattaaggataactggcct

SEQ ID NO: 253794 - DNA, 372 bp, Homo sapiens
agtaggcagggacataagttgtttgtgaatataatattacagacattgtagagaagtcagaaaatcacccagaatatttcccatcataaaatcattgattttttttctgtttattttcatccatcatttttcctttgatctttttaaagatgtatgtataattttatatccttagtttttcactttacaattgtaagtagcttccttgtggcataacctttgcacaattactttattttttgaaatgattttctcccccagaattaaagcagtataaccaaactgcagaattaggaaagtggagaaaaagccactcacttctgccactcttgtacaatgactcttttgttgtgacattgtccctgtattcgc

SEQ ID NO: 253795 - DNA, 210 bp, Homo sapiens
gacacagcacttttagctgccaatgcttaatagctagaagagttcacgtaaaaatttcatttcctacttatctttaaaaactggaaacactagccacactggcgcatatttccacttggcaacaatggactgcagcaagcagggacggccccttcaggcatgggctcacgttcccagctgccacaacacctcctgtcccacctccagttc

SEQ ID NO: 253796 - DNA, 418 bp, Homo sapiens
aagaggaaatgaaaaaaaaggaaggaaggtaggcaatgagggcagtgttaccttcttgaaaagcccagatctgtgctcagtgaacattcatttcacatgcgaaaaggaaggcaaagggtagggggtgggcagttaatgatgcttttgtctgatgcccggtaaatctacattttacataagcaagcatgtgaaatgacagctatctgggaacaaaaggatggcagtttttgcatgactgggttctcaagctttaccttccctttggcatggtggcacgcgcctgtaatcccggctactcaggagcctgaggcagagaaccacttgaacttgggaagtggaggttgcagtgaactgagatcatgccgttgcacttcagcctgggcgacagggcaagactctgtctcaaaaaaaaaaccca

SEQ ID NO: 253797 - DNA, 371 bp, Homo sapiens
gattactttagtttagtttagttttagagatgtgggggtcttgctttgttgcttgggctagtctcaaactcctggcctcaagcagtcctcccacctcagtctgctgagtagctgggattacaggtgtgggcaacatgcccagtgcaaactggattatgttttgttttttttgtttttgagacggagtctcactctgtcacccaggctggagtgcagtggcacgatcttggctcactgcaagctccgcctcccgggttcacgccattctcctgcctcagctacattggaggctgaacccgggaggcggggagcagagttcctgacactgcactctggcctggacgacagagctagagtccatattatgaaaa

SEQ ID NO: 253798 - DNA, 661 bp, Homo sapiens
ggcttcactggctcctgaagtcaaaacaaagcaagatgtccacccaggcaagagtggacaccccactcacccattcccagaggccacctggacactctccaaagaagcagaaacagtcaggctttgtttttagctctccttgtgggcccctgaggcctgccccactttctagaaacagggagcttggggcccatgccatctggagggactgggcagcctttgccttctcttgccactcatggggaaaagccaagggaatgcagccctctccatgtgcacagcttccaggaaatccacgtggtagggcctctggtgggactggagtctatcagaaccacagtggtcagtctgtgcacagggctgtgtcccttgcaggagctccaagagccttgctatggaaaccccaaactccggagactgttctgattctctcatccactccacagaacccagctagcatttttctgagctcaacttgagctcaggtctaggaaaaaatctataactcagagggagaaagacaatgaaagcaatgcagaagctcccagttgagctcaatccagacaatgtaataacaagcatcatttattcattcattcagcaaagggtggaactcatgcctgtaaagatgctaaccatgccaaaaataaacatagcataa

SEQ ID NO: 253799 - DNA, 384 bp, Homo sapiens
  misc_feature (320)..(320): n is a, c, g, or t
caccttcctctaggcagatatccccaaggtcacccactgcacttggacttgcaaaccctggccactgtgcctcctgccccacgcagctgtgagggagcccaggggaatggagccttagacccgggcagctgtgttggaatgaggttattctgttccgaaggaagagagggcgaatgaatgtcatgggaaacacacagagttagcaagagttccattgaacccggcaggcaagtgtgttctgttgtgacctcatctcttccttagatggtgcccacaaacatctgtgtgtactcaggcctgcccatcagcctggggtcacnccagggctgtgcaaaggctgagggcccctgggctcactgagaattcagtggactagtagtagta

SEQ ID NO: 253800 - DNA, 365 bp, Homo sapiens
caccttcctctaggcagatatccccaaggtcacccactgcacttggacttgcaaaccctggccactgtgcctcctgccccacgcagctgtgagggagcccaggggaatggagccttagacccgggcagctgtgttggaatgaggttattctgttccgaaggaagagagggcgaatgaatgtcatgggaaacacacagagttagcaagagttccattgaacccggcaggcaagtgtgttctgttgtgacctcatctcttccttagatggtgcccacaaacatctcctgtaggacttcccatcccagggctgtgcaaaggctgagggcccctgggctcactgagaattcagtggactagtagtagta

SEQ ID NO: 253801 - DNA, 446 bp, Homo sapiens
gaatgtgatgtcctcctggggaatgttgggaaggcacttgcaaagctattttaagaggcgtttggaactgtgagaggacagggaagtataggagaacatgccagaagccttgtttgtaaatactgtattctctttaggggctactcagtggcaaaatcaaacagatattttgccagacaataaagcagctcatctttacttcctaagagaattccacactcagtgaagatcaaaacttacaatgaaaacattttaatgaatcacagaaaatcagtttttctgtttgtttggttgttggttttgtgtctttcctggtgtgagctccccaagcttacagatgagctgatgctactagttggtaccagtaatccatcagaagacagatgaaactttgtaagagaaactgtatttgataaagctgaaagctaacttgcttcaatcttttt

SEQ ID NO: 253802 - DNA, 258 bp, Homo sapiens
gattttctccctctctgtgggttgtctgttaacttacagacattctttcttttgctgtgcagaagctttttagtttaattaagtcccatctatttatctttgtttttgttgcatttgcttttgggttattggtcatgaagtctttgcctaagccaatgtctagaaggctttttccgatgttatctctctttggaaggtttttaaaaaaaacctttgggacacagtgtcaattagttttgatgggcatccaaaaaaaaa

SEQ ID NO: 253803 - DNA, 448 bp, Homo sapiens
aaggtagcaaaattttttaaaaaatggaaaagagaaagattattgatgccttgtgaatacaggtgtccccaaaaggcctgagaccaaccttaattatcaagaatatggttgcagtggaaattggtaaacagctgaaattgattcattgattattcaacacttattgagcacatactactattattaatagctgtactgcgagcgctaatacttaaaagaggaagtcaggtgaaggcgcaacagctttatgctctttttcactataatctgtgaaatagtgtatattaaacaataatagtatatggaaaagcacatctacatgtgtcatcagttataatactgtggggctgtttggcagacaatagagtagataaatttattgaacattgggcctttgaaaggtatgtggaaattgtaaataaaaatggattccatgaaaaaaaaaaaa

SEQ ID NO: 253804 - DNA, 7233 bp, Homo sapiens
gcgggtagatcttgggccgggcagcagcagtcgcagagcggcgcggcggcggtggcggcagcaggcagcaggcatgaccatggcagcggcggcggtggtggcacgcggggccggggcgagggcagcgacagcggcggctttgcggggtggctgcgggaccgcggctcgggggcggccgtgtgcgggccccgcccggcccttgtgcactgcacccgggaccgccccggacatgaagcgctacctgtgggagcgctacccgggaggcgaagagaagcacagaagaattggttccttccattatgagcaacttgttgaatccagatgccattttctcaaacaatgaaatgagcctgtcagacattgaaatctatggcttcgattatgattacaccttggtgttttattcaaagcacctccacacgctgatatttaatgctgcacgggaccttctcatcaatgaacaccggtatccagcagaaatcaggaagtatgagtatgacccaaattttgcaattcgtggacttcattatgatgtacagcgggcagtattaatgaagatcgatgcttttcattatatccagctgggaactgtctacagaggcctcagtgttgtccctgatgaagaagtcattgaaatgtacgaggggtcccacgtgcccttggagcagatgagtgacttttacggaaagagctctcatggaaacacgatgaagcagttcatggacatcttctccctgcccgagatgaccctcctgtcctgcgtgaatgaatacttcctcaagaacaacatcgactatgagcctgtgcatctgtacaaagatgtcaaggattcaattcgagacgtccacatcaaaggaataatgtacagagcaattgaagcagacattgaaaagtacatctgctatgctgagcagacccgcgcagtgttggccaaactggctgatcatggcaagaagatgtttctcatcaccaatagccccagtagctttgtggacaaagggatgagttatatcgttgggaaagactggagggacctgttcgatgtggtcattgttcaggctgagaagccaaacttctttaatgataagcggaggcctttccgaaagatgaatgagaaaggtgtcttactctgggataaaatccataagttgcagaaaggccagatatacaagcagggtaatttatatgaatttttgaagcttactggatggagaggatccagagtgttgtattttggtgaccatatatacagtgacctggcggatttgaccctaaagcatggctggaggactggtgcaatcatcccagagttgagatctgagctcaaaatcatgaacacggagcaatacattcaaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaagggcaaaaactagaaactgtaactgcccctgattgggcaggcatgatggggttgacttcatgtgggtctgagtgttgcttttggaaaagatacagataagccttttgatatttattttgtaccttacggagaataattctcccaatgattaagacaggagctagcagcccacccctccagcctttccccccatgcagggctgaaaggcaagcttcacattggaactctgattttgcctttttgtttactgaggtcctggaacatcaggtttcctgggataggtagaccacttgatgccatgtctgtattctagcaggtcaagcttgaaaccgttcttgactcctccatggaacatttcctgaacatttacgggctatgcattgggaactgcaggggcacagtgatgggcaaagattagctgcttccagaaggctgatttcgtgggctccacaatggtaaaacgctgctgtgagtggcagagaggttccccaggtgatggccagttcccaaatcatttggtactaaggctttgacattctggcacatcacatcaaatagaacacagcctccctggaaggacttaagtgagaaagaacaagagaagctgcaactcctggacccttttgtcctcagtgtgtggttcctgcgtccttccccagggcaggagagaggagatgagagctctggtcaaaacctgccagctagtggaacagccttctatagagccttctgcaagaaacgagtgggtttgaagaaccaaaacatttgtggtaggtctcccaggagcttgttaaacctggaaacaccacctgagttggtttcatctgctcattggaagaaagaaaatgaaccaggaaaaagcatctttgtcatgaaatgctatgccatgccacccacccagttgaattggaatcctgttaaaacatgagatttaccagaaacagtcctttgtctagatggaaacaaacaagatcctggcttctctctaatgagttaccaactgagaggtgcttggattggccaggggaggaggaagatggccaccacaacttagccatgtccagccttctcttagatttcactcctgtgatgtttgtgcgactatttgggagtttgtatagtttgtttttttttttttgttttgttttgtttttttttagatgtctaagatgggaaagggcgaaggacattgaagctaaggaatagatatgacctagctaaccaagcttttctcatttctttctgttttgttttgttgagatggagttttgctcttattgcccaggctggagtgcagtggcacaatctcagctcactgcaacctctgcctcccgggttcaagcgattctcctgcctcagcctcccaagtagctgggattacaggcatgcactaccacacccagctaattttgtatttctagtagagatggggtttctccatggtggtcaggctggtctcgaactcctgacctcagataatctgcccgccttggcctcccaaattgctgggattacaggtgtgagccaccgcacctggcctgcttttttcatttctttctaggggcaatgcaagtggcatgtattccttttgttggagggaagaatccttaattgcacctggatttgtagtatccttcaatgtaaagtgcatatttactgcactctctgagtgctatgggaatgtctgctgttattagttatggggctgctaatactgttttaattgcatatgctatatcaatacttctgttcagattagcctgatctagtattgctaaaactcattttaagcttttgcggtaacttgtatatattcttaaatctaaaggatggcaggaacatgaggggagcttgtggagagtgcttgcttattcaacatttttattgtgataaatgtatgtaaccatctattgatgaaatccaagtctggcattccatgggctccttgccagatggcagaaacttaatgagttatatagcatcctttgtaatgctgcttgttatagttggaatgtacttgtgatatttggctgtatttaactataatggtgaaggtgaccctttagatccaataaggcttctccccatcttttcttctacattttgttatgaacacagtaaggcacagtagtatgttctttttttggaacagggtaggcattttgtttattgtttgcttgcttctaggtgttttcgccatcagggtgtattggaggctgacacttaatgggtgtgtgttacgcccagaactgctcggtgtcggggttctaaaagaatgcgctggtgttcttggcttcaagtttctgctttggagaagcagattcaggaagtaggtgttgcttaaaaataattcttggtttttatctaatcagatattcattgattacctaccaggtgccagttatagggtgttttgtttactcaagaatgaagtagaactatttttaaaacctgtttccatgagtgttcacgttaggtgacctaagctttgaaggagaaaaacattttctgggtatgaataatgagttttgtaatcaattcccagttagaagaatttcagtctctgggccattgagcttggcagtgttgagatctcccatgtgacagaagcctggcatctgggccaccaaggctcactgactgtgtaccttgcagactgtagacccatgtcgtggcggtaacggggccaaacacagtcattcccatgtgaacgatggaggcacatcccactttattattaatccttgtatatactcagtcaggacagattttaacttgtcgctgtcatgactttttttttttttttttgaggcaaggtctcgctctgttgcccattctggagtgcagtggtgtgatctcggctcactgcaacctcttgcctcccaggttcaagcaattttcgtgcctcagcctcccgagtagctgggactactggtacatgccaccaggcctggccaagttttgtagttttaatagagatggggtttcaccatgttggccaggctggtctcaaactcctagcctcaagtgttctgcccacctcagccttccaaagtgctgggattctgggtgtgagccactgtcatgcctggcctcgtcatgactcttttctctttttttttttttttttttttgagatttagttttgctctttttgcccaggccggagtgcaatggcacgatcttggctcactccaacctccgcctcctgggttcaagtgattctcctgcctcagcctcccgagtagctgggattacaggtgcccaccaccacatccagctaatttttttgtatttttagtagagacggggtttcaccatgttggccaggctggtctcgaactcctgaccttgggtaatccacctgccttggcctcccaaggtgctgggattacaggcatgagccaccgtgcccagcctatcatgactcaactgggatctggcacactgcactgggtgttttgttctctgatgtgcacattgatgaatgcatattggtacaagggaaacgaatctgttttcagccatttaaaaaattgtgttgtaaagcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaagggacttgcacagctgattttctttttccagtgttgtttttacgggtgaaacgtggcttttgaaatactttagttgtttggcttagagctcccactttccccctaacatagtgcctgtctgttttttaaaacattttacccttcggcactattttctgctattcccattaatattatgtaacataaaccacttgctactgatttgggcatattacagactacaattactagttgctttgaatgcattggcactcttaattattgcaaaggagaattgaaaagtagtcttgtggtcctagttaatttagctttgggcaaactaagtggcttttcttctgtcctcttctcaaaaggccttttaagcagcagagactgggctaaatactggaactgaattccacttttctgcctgctcatttgctgccaaagaccacttggggctccttgtctagaatgctctaagacgaaatttggccagacacagggttccttgattgttctgttcaactaatagagaacctacattttgccttcttaatatcgactttcttttgtaccaggtttttctttctttcttttttgccttaggagcttagctcaaagttcagctaacctttgacactactagtgtcatttagtaacagtaatctttgacactactagtgtcatttaggagcttagctcaaagttcagctaacctttgacactgctagtgcgttcaagaaagggtagggaatgaagtacccttaatgcagggtcagcaaacttttcctgtaaaaggccagataggaagtatttttggctttttgggctgtttgcttttgctactactactgtgggaatgaccatggtcatggctgtgttccagcacaacttgatttaccaagacaagctgtgggctgtatttggtcctcaggctgtggcttgctagcccctgctctaatggattgtgttggcggcaatggcaagattcccttgctgagaacatgcagatgaataaccttatagctgggatgcagagaggagaaagttctgtaggtaataagtgcactgtattccctctgagctacttcctgggcatagttacatgtatggccagtgtgtgtacttgagccatcaggctcagacacttgttgaatatacctctcattgcattagtttgtaattgtgctagtgctgggtgctgagctcagctgcccggatgacctttccagactgaaggacatactcccctaacagctgggagtgctgctggctggccatttacttccagcccttatgaggagtttcccctgctgaagagccctgcctgccccagatcatacccccttcctgcctgtaacccttaccggctccatatggggtacaaaggtctggcctcctcaccccaacttgggaaaccctctggggccatcccagctccagagccccttgtggggtcagtgagacctcattgtggccacattacagcccagtgcctctccctgacaagcctgtacccagccggctcagcccacagcactgtcctatgaaccttcctgcacgccattctccacctcagtatctgctttcggggaacccaacctgcgacagtgcttctgtgtgttttcagtcctgcaggtttgaactctgactttggagacttttccagttatctcgtggaatgacagattgtgcctgtatgatatcaggcacaattaatgcaaattaggcagacctatttattctagatgtgaatttgctatttattttaaatgttgattttatgtgttatgtgactctgaacttattgccaaataaaagtttgaattgt

SEQ ID NO: 253805 - DNA, 381 bp, Homo sapiens
ctgcaattctgtccctccactaacgccctttatccaagcgttcatctaatggagcatcccttcatgagttcactcacccatccatttacccagaaaatatttgtgaaacatcagcttccatttgaggacacagtgagaagacagccatcagtctataaaccaggaagtgggccctcaccgcttcctagtttaccaaatctactggtgcctttgatcttggacttttagcctccagaactgtgagaaataaatttctgttgtttataagccacccagttcatgatggcactttgttatggcagcccagacaggggtcggctggcaaataggtcagcttggaccatggccagcttggtgtccacacaccctcctctccaagca

SEQ ID NO: 253806 - DNA, 239 bp, Homo sapiens
agttcctaggtttaagattttgcacatgtttgttctttactttcttgcaaagagattacttatttatatttcatcggaaaagttgtcctggaggcatttggaggtttatgcagttattctgtattaccaactaattgtttagaccagtactgtccaatagaaatataatgcaaactattaaatatgtaatttaaaattctctagttgccacattaataaaaatcaaacagatgaaactc

SEQ ID NO: 253807 - DNA, 586 bp, Homo sapiens
ttctcaaaaacaaaacaaaacaatttattttctatattcaaataggtagaagagcagattttgaatgttcccaacacaaagaaatgataactgaggaaatgaatccgctaatcaccctgatgtgatcattacacattgtatacatatattgaaatatcacctgtatcccgtaaattattacaattattatataaacatacaattattatacataaattaaaaataataaaagcaagaaagagttctttttggcattttaaacagaattccccctcttttgctcgtgaatttgagaggcagtgttcgaatcacagcttggttagcgtgtgacctcaaggaatgtttgttatctggggctgctcaaacaaaccatcccacaacttagtagcattaaatggattgccccaaacttagcgcctgtcgtgatttctttggaccagcgattctggaagtagttggctgtgcaattctggctggaggcaggtggagggatgctcctacagttttttttgtttttgtttttgtttttttttgtgagacacagtcttgctctgttgcccaggctggagggcagtgtctcgatctt

SEQ ID NO: 253808 - DNA, 588 bp, Homo sapiens
ttcccattcaaattcaagagtcagttatattactggtgagtatgggaccaatattccgcttctgctgccctcaccttcctttttcatttctcatgaataaagtaccatatcaccctataaaaggtatctggtttagtcaaggaaaaggaggtgaatcgttcattatttgccattttgagtagttcaaattctctaagagaagttaagtttcagaagacaacttactttggaagctgagtgaaagccaggaaaccagctttggatgccacaagcctcctcacagcctggaactgactctcaagttccgcatttgaagcaacgacatccccttcttgggacagtaatgctgttatggcattattgatcagtttttctttgttttctgagaagagaccctagattgtttttggtattacatctgggaaatcttttcttaaccccaagtcacaaagaagttgctttactttctgcattaggcttctttgcaagatgatgctgaagaatgtttaaatgtttacaagtcattggcctaccgatgttacaaaccaactttctgggctctatttacaaaggtaagggaacaggcta

SEQ ID NO: 253809 - DNA, 311 bp, Homo sapiens
ttttttgagatggagtctcgctctgttgcccaggctggagtgcagtgggtgatctcagctcactgcaacctccacctcctgggttcaagcgattctcctgcctcagcctcccgggtagctgggattacaagcacacgccaccacacccggctaatttttgtatttttagtagagatggggtttcaccatgttgccaggctggtctcgaactcctgacctcaagtgatccgcccgcctcagcctcccaaagtggtgtgagccaccgcacccagcctcctgactttattttctatcccttctgtcgtcttctc

SEQ ID NO: 253810 - DNA, 540 bp, Homo sapiens
ggacagtgtaacgtcttgaattgtatagattagagttctgttaagatgactaatgttaaaagagtgcaagcagaggaggaatcgaagtcaggagggctcacagagctgaggggcctggggtgtgatgtagacatgcatgcagggtttgggagtcaggctgcctgggtttggatccagcctagataaagtactcagctttattgagctacagattcctcttctgtaaaagaacgtccacctcataggtagcttaaaattaaatgtgataatgagtgccaagtgctctgcactgtgcttgatacgttttatgaagtcagtaaagattaaccactaattaattctgaactttgcttgagattgtaggctcctgtgggaaggactccatcgcattgatcactgggttttcccgtgccatccatagaactttgtgcttaataatgactcaataaatatgattagatggatggatgtaaaatatggacttgggagaaagaaaaattagaagaataaaaaataaatggaatgaataatgaaataata

SEQ ID NO: 253811 - DNA, 692 bp, Homo sapiens
ttttgaggcatacaaaattctgttttagaaaaccaggtttgcagaaactcaatcctttctctattgtcattcctgttcttcctgttaaccttttattttaatgaactggaaagagttagacttaggggatctggacttgggcttggctttatctctaataaatagatgaacttgtttttacctctattttacctctattgacctgagttttttttttttttaaatttcacaaaataaggctatgagaccagattcctttaaaatctgttccttgacctgtcttgatcattttatatttttctcttttcttttttttttttgagacggattctcacttactctgtcgcccaggctggagtgcagtggtgctgtcttggctcactgcaaccttcacctcctgggttcaagcagttctcctgcctctgcctcttgagtagctgggattacaggctgcaccaccatgttgggctaatttttctatttttagcagagaccaggtttcaccatgttggccaggctggtctgaaactcctgacctcaagctattggcctccctaagtcctgggattacaggcgtgttactgtgcctggcctcattttatatttttcatctgtggttgtcttgcctttcttccttaaactgcttctctttctccatggcaagtagggaatctctttaaaaactttggtac

SEQ ID NO: 253812 - DNA, 301 bp, Homo sapiens
taggtggtaatatggaaaccaaaacaaggcaagggcatggctaaggttgtaccgtgatccagtctccccagctgaattcagagaaccactcatcaacaccagggcaaccctgactgccccaggacccctccaatctgtggtccccacccttctgcctctcttatggaccatctctttccataggtcagtggcctccccacaggtgaggaagaggtaaggaagggcaggggatgatggttagttaagggtagggcgagagatcctccgtcaggaacctctactcagctggctttgtttttct

SEQ ID NO: 253813 - DNA, 699 bp, Homo sapiens
gtttcagagaggatattttttcttctcatatttttgaattttcaaattttctataatcgagcatgcattacttttgtactagaaacattgtataaaaattaaaaataagaaaatagtatcaccaatgacttatatttgggcacatatgtgtgcacaatgagatgaggtaccactcattaaaaatagtgaggggggtactttgtagattgaaggtagatgaactttggtgccaatgtcagcagtttttttacagacttctcacaaatctatgaggcatgcagtgataattcttagtacaagcaattaaggttatttcagcaaacagctgtctcacaaacacttccaagattcctttgaaggttgaggaatgttgatcaaagcaaactctcttgtgaagcttcagagacatttcagcaggacgttaaaacaaaatgtggaaaccgatatcaacttagctctccatcctgatgtggtttatcctattggcacaaagcttctgatattatctgtgcacaagggtctagatgtaatacattgctattgtcatagcaaattcagcaaaatacctatcagtgtatggtccacaaatgcttagaaaggaaagcatcgcatttactatgattaacttctctttgctggggaaaaatagaactcacaatcttcaagatggctgcatttgaaatagcctttcctcaggag

SEQ ID NO: 253814 - DNA, 478 bp, Homo sapiens
cgggctcccctctaatcgtccaggacaaactccatgtagttccactggtcaacggccagctggcctgccggtgcctgtcggtgtgctcttggcgtcctctcgacgtccagccgcttgtgtgttcttttgccagtgtgttcgtctcaacgtccagatcttccaaaataactgaagaatgtgctggaatgcaacatcctgagatatggaggaactcactggagcagcctcattctgttcctttccttcctagaaacagaatgttcttcttcatggcctactatgccatgagatccccaaggtataaaacccaattctgtccgctttctggggtccctcaggtgtgctgcaagtggggcacagcagtaagactctatctgcctttagcagatggagtggtggggaaccagctcatcatgaatcctaggcttctgttgtcccttgcttcctatctggaagtaataaaccaacttcatgtaac

SEQ ID NO: 253815 - DNA, 756 bp, Homo sapiens
agaagaaagaaagaaagaaaagaaaagaaggaaagaaaaaagaaaggatgaaaatacataactcagactagagtcagacagaagggagttccattcccagcccaccacctgtcagatttggggcaagttatttaaccttttttgctcctcagttttttttaatccctgaaatggggattggaattggaacattataggattgtcatggaaattcaaagaaagaatgagtggagaatgtttgaaagagtacctaccatatgatgagtgcccaatcaattgtagctattgcaattatgtaaaagagaaatgtgtaatagctttttgtttggtgtattcaatatggttttcaaaataaagaccaatatcataaagttttgttgctgtttctcataactacatttaaattcccggttactttaagccccctttttttttgtcttctgcatacctgcaagtacctcatccattcttccgtaatgtttttctcccttagccaataccattccaatgaataaatgctcaagaccaaatgtgaacagaggtttaggctgactttaggactgagtcactgtgatctgtttcagcctcctggagctcttttttcctccatgctcatttaccgaggagtataatgtttgcatcatacctgctgttgaattaccatgtaacgattaatgagatatgtttattaacaagatatgtttatgaaatgccttatgtttgtgatcacttgtaataaaacattaataaagaata

SEQ ID NO: 253816 - DNA, 490 bp, Homo sapiens
cactgaagcaaaattaggtgtgattaaacagaaacaacagatggtatctttctattgggaaactaatcgtttgtgtaactggcaggatgaaacatcagaaaatacttgacacattttgctagagtcctaaagggcacctaggaagactgactccaaaatgtcaaaataaggaaaatacataactcagactagagtcagacagaagggagttccattcccagcccaccacctgtcagatttggggcaagttatttaaccttttttgctcctcagttttttttaatccctgaaatggggattggaattggaacattataggattgtcatggaaattcaaagaaagaatgagtggagaatgtttgaaagagtacctaccatatgatgagtgcccaatcaattgtagctattgcaattatgtaaaagagaaatgtgtaatagctttttgtttggtgtattcaatatggttttcaaaataaagaccaatatcata

SEQ ID NO: 253817 - DNA, 365 bp, Homo sapiens
aatccactgaggattatatgtgtgcttttgttttttcctattttaattaacaaacaaaccaaataaagtatggttctaggcccagtgtaggtagaaaatagaacagtcaaggaggggactaatatagatagttatgtctttgattgatggcagaaatgactggataaaaagttaactccatagcacaatcttacttttaattggcgccaacacatatttagaatgtgtctggaaggaccatctgctttggataggtcttgtgtaatcttgtaatggtaaaatattcataacttttttgatgacatactgtaatataaagcacaactagaccaaatataattttaggaggttgtagtaaaaaagaa

SEQ ID NO: 253818 - DNA, 458 bp, Homo sapiens
cccaccgtgggtagagtatatttccccaccacactgatactggggttggtcatgtgacttcctctggcatatgggatgtcagcagatgtgaacaacagatgtaaatgtgcccgcagggcttagctgagctctttcactcaagtattctgccaggagaagagcatgccccagggaattgcttacccttatcctgagaattatcaaatgtggagcagagtaaacccaaccttggatttggcaccgacagaacccaaccaatccaacagcctgaagcagagtcatttatccaagtcttgaatggaggatcagctaagccaaactggacctttagaaccctgagcataagaataaaggcttattgtgaggaagcaagtctgagttttgggtggtttgttacatggcattattatagtaacagctgtaatcccagcattttgggaggccaaggcaggaagatt

SEQ ID NO: 253819 - DNA, 312 bp, Homo sapiens
  misc_feature (31)..(31): n is a, c, g, or t
  misc_feature (62)..(62): n is a, c, g, or t
  misc_feature (66)..(66): n is a, c, g, or t
cacaggcatgaatgcaggagacttaaagccntaaatgatcatggagaacagtcagtaaagtnatcngtgcgtgggctggtgtaggcataaaggaatggtgggaaatacggccagctgcagagtgaatgtccactaagggggaaggctgtttttccaccagcgtgaaagaatgttgtccctttgcatttcatttcaagaaaagctggaagtgtgaattttaaaaatgtaaaatctatttgttttaaatattggtcactagctcaaaagtttttaaaacactattcaatacccaaatgcaatagcaaaaaaaaa

SEQ ID NO: 253820 - DNA, 474 bp, Homo sapiens
aagcaagttcagagatatttttactttcagttcctaggcaagaaggacatgagttgggagggtagtcctctgtccctgtgtcatgtgaagcaggaatgaagagttgggcagagagagagtgaaaagcgtgtagcaactagcaatatatataagggaagttcaagagcaaatacctgaatggtcctgataaaggaagctgcaagaaaatgtggagcctagtctgttaggcaggagggatgcctctaagttcttatttctgaccactggcctgagccatttgggtatagtatagaactggaaactctgtcaagagtagcggagccctgcttctggcatgagaaaattaaatgttcaaaatgaatgtggaagcaacataaaattaaagaattcactacaataagaaagatagaaaataattgaattgtgtgtttaacttaagaaaatagaataataaccgcagagtaagtgcactga

SEQ ID NO: 253821 - DNA, 414 bp, Homo sapiens
tacctcaagtaatgagaagttgattgtaaagatgcttcatcaccaatgatttgattgattgcaagttacaaaaatcagactcacctgctttctttatttatatataatcaaaactttatgctgtaatcccagcagtttgggaggtctaggctggtctcgaactcctgtcctcaggtgatccacccaccctggtctcccaaagtggtaggattacagacatgagccaccacacacggcccagtttaaatgaattttaaaggtggtctagatcaattttattattttgcatgttaagatgcaaggactgttcaacacacaaatcaataaatgtgctacctcacatcaatagaatcaaggtcaaaaactatatgatcttttcaatagatgctaaaaagcatttaataaattcagcat

SEQ ID NO: 253822 - DNA, 4852 bp, Homo sapiens
  misc_feature (165)..(165): n is a, c, g, or t
  misc_feature (1005)..(1005): n is a, c, g, or t
  misc_feature (1053)..(1053): n is a, c, g, or t
  misc_feature (1142)..(1142): n is a, c, g, or t
  misc_feature (1234)..(1234): n is a, c, g, or t
  misc_feature (1584)..(1584): n is a, c, g, or t
  misc_feature (1731)..(1731): n is a, c, g, or t
  misc_feature (1907)..(1907): n is a, c, g, or t
  misc_feature (2144)..(2144): n is a, c, g, or t
  misc_feature (2334)..(2334): n is a, c, g, or t
  misc_feature (2544)..(2544): n is a, c, g, or t
  misc_feature (2682)..(2682): n is a, c, g, or t
  misc_feature (2957)..(2957): n is a, c, g, or t
  misc_feature (3238)..(3238): n is a, c, g, or t
  misc_feature (3423)..(3423): n is a, c, g, or t
  misc_feature (3430)..(3430): n is a, c, g, or t
  misc_feature (3460)..(3460): n is a, c, g, or t
  misc_feature (3472)..(3472): n is a, c, g, or t
  misc_feature (3495)..(3495): n is a, c, g, or t
  misc_feature (3516)..(3516): n is a, c, g, or t
  misc_feature (3531)..(3531): n is a, c, g, or t
  misc_feature (4119)..(4119): n is a, c, g, or t
  misc_feature (4293)..(4293): n is a, c, g, or t
  misc_feature (4357)..(4357): n is a, c, g, or t
aaaagaaatgatgaaatgatattgaaatgaaattgaaagatgagatgatgagatgaaatggtgaaatgttgaaatgaaatgatgaaatgaatagatgtgacatgaaatgagctgaaatgatgagatcaaatgaaatgaaatgagattaaatgatgagatgaaaantgatgagatgaaatgctgagatgaaatgagatcagatgaactgagatgagatgagatgaaataatgaaattaggtgaaataatgaaatgagatgaaataatgaaattgaaatgagatgagaagaaatgagatgaaatgttgtaatgaaaggaggaaatgatgagatgaggagatgaaatgatgagatgaattgagatgaaatgagatgaaaaatgatatgaaaaatgatatcaaaaatatgagatgagatgaaatgagattatatgaaatgacataatgaaataaatgaaattagatgaaatgaaatgaaatagtgaaatgaaatgatgaaatgaaataatgaaaatgaaatggaaatgagatgagatgagatttggtgaaatgatgagatgaaatgatgagatgatatgaaatgatgagatgagatgggatgagatgaaatgagataaaatgatgagatgaaatgatgagatgaaatgatggggtgaagtgatgcactgtcacgtgtgtgtctattctttttcccaagcaacaaaaattataattcattaattttaattttattatttaagaatattcttaagagttgaaggaaaaataatatctgtacattatgggttacaatctaagtataaataatacataaatatattaaaacttacaaagaatatgttttggaatcgaatataccatgcttctgtgatgacagttatttcatgctggttgtcacaattttacatgaaaaactaatgaaaaaatgtttttaactgtttctaaaaataacagtttccaaaacagttttacattcgaaatatgaaaaagatgtctttgtgttccttnatctgatgagattttcacactctgcacatgataattgttagatttttnttgtgttgataaattgtatatcaaataaaaaatgttattacctcttaaattaggatttttaggtgatataggcagaaaggacggcaagnttttataactttgtctaaatgaactttctaaatgcctgagtattaaaagatagcatgtctataaatcacaatgtatatattactgtatgacntaggaccaatcaaaaccgttacctctgataacattatattgtgcccagtataaaatagatataataatacctcaaacttaaatccgggcattgtcattgaatatcttaagaatatgcaacaaaggtgcttttaaaaatacaagctagtgattgtaccaaatttgtaaatcacataggatagtgggtcattttaagaatattagttatttcaatctataaacgtggatgtctttccttttttgtgttttctttaatttctttcattaatatttgtcatttttgttgtcgaaatcttttacttccttggttaaatttatttctaagtacatttttgtagctattgtaaaagnaattgctttcttaatttcttgtttcagctagtttactatcaatatatagaaatgctactgatttttgtatgttgatttatatcctgcaactttattaatttcatgtatcaccctaagaagcttttggtagagtcttatttttttccntgtataagatcacattgtctttaaacagggacaatttgactgtctcctttccaattcagatgtcctttatttctttctctcacctaattgtcctggctaagactttcactatgtgaaatatgattggtgagaataggcatccttttcttgttccagtaaaatctttttcttgttcncagtaaaatctttcaccttttccacactcagtatgatcttagttgtagatttgtcctttatgtccttctgttttaaggcatatattttctatactaaattgttgagaggttttttgtcatgtaagaatatttaattttgccaaacgcttttattgtgtttattaatttaatcatatggttttcagtatatatccaaaggaaagaaaaccagtatatcaaagacttacctgcaccccnatgtttattacagcactattcacaatagccaagatatggaatcaacaaaagtgtccatcaacagatgaatggataaagaaatgtgacatacatatataatggaatactatttagtcataataaagaacaaaatcctgttatttgtggcaacaagaatgcaagtggagggcattatgttaggtgaaataancctggcatagaaacataaacaccacataactacgtgttctcacttatgtatggaagctaaaatttttaatctcgtagaagtagatagtagagttttggttaccatatcctggaaagagtaggagaaagaagagtataagaaaaatgtggttaatacatacaaaattacagctggagagaaggaagaagttctagttctctacagcactgntgggtgactgtagttaacgggaatttattgtgtgttttcaaataactaaaataaaagattttgaatattctcactgcaaagaaataatacatgatttaggtaatggatatgataatgactctgacttgatctttacgnattgcataaatatatcaaaatatcactctgtaccccataacatgtacatttattatatgtcaattaaagtaaatttaaaagagaaaaaatgaggtaaaggtaaatatacataatttaattactttttcttctataaaacccgagtcagtaccaagaagagtcaatttattagttttctaaaataaaaaaaatcaaaatcaccaaaaaagagcaatatccaagaaaacattgaaaatgaaacacaacatttagtaagaatagaaaacttgggcacngtatcaccctgttcctagataccgatttactgatggccatttaaatagaattttattctatctaattcatttatactcccagagttcgaaattacattttacctacaataaatgagataacacttgtaaattatatggtactctgcctaacacacgttaataactcaatacatgttagcaataaacttttagtatagtagtcaaagtattaatttctcacattgcaatttccttcaaagacatgaatacaacctttctaatgactccttgttcatcaaganacctcttcaaattattctatttgtttcattcagtatattatctgtgtataccgatattacactcttttctttttttgagatggaatctcattctgttactgatgctggagtgaggtggcatgatctcggttcactgcaacctccacctcccaggttcaagcgattctcctgtctcagcctcccangtagctnggactacaggtgcataccacgatgcctggntaatttttgtanttttagtacagtcagagtttcancttgttgtccaggctggtctngaactcctgacctcnggtgatccacccaccatggcctcccaaagtgctgggattacaggcataagccaccgcacccagcctgatattgcactcttggattttgaacactgaatatctttttgaaagattacacctctttacttctttgtgcttcagaaattattttccttcaagtgttctaagagtctaatgaagaatgaagtcatgttttatcacttttgtccttaaagatttcagacatgctgaaactgattgaagtatcatttgctactagatagattaattatctccagttgtaggagtggatacatctttaatggtatattttgggttattgtcttatttttgatgcagtattctataaataatttattaaacctggcatccttgggtgagcatagatttttcaactttggtgttatattgtgtttgcttttaaaaactgcttctgaggccaggtatggtggctcttgcccatacccagcactttgggaggccaagatgggtggattacctcaggtcaggagttcaagaccagcctggtcaacatggcaaaaccatgtctctactaaaaacacaaaattagccaggcatggtggtgcntgcttgtagtcctaaccactcgagaggctgaggcaagagaatcacctgaacctgggaggcaaaagttgctaggttgctgtgagccaaattcgcaccattgccctccagcctgggtgaaaagagcaaaactctgtctcaaaaaaaaaaaaaaacccaccaaaaactgcttttgantggagttgtacatataatttttatgaaaaaaattaacaagtgcataagttcataatagaaaaancaataatactccaggcacaagttagtactaaaaaaattatgttgaatattctctaatacaacatgctttttcccttcatgaacaatttgtgttttactgagaagagtcattgtttatggtagacattagactacagatgaatatgtactttaaacactcttagttgctttcttaattttatatctgctgctttatgcttctgtttattttcattctttccaatgtccacattctagtaaatttgaatattttaatccaagtttatatactatttaatattgcttgtatagtttagtatttttaagactcaaaaaggtttacagaaagaagaaaaagatcaacatgttattaatcatttaaagatcattttgaaatctttgacctttatattttaatgaataaaatattagtagttattagtataaaataatttatgtcttttggacttagcatccagtatttcttttttaataaagaaaataattattctcttgc

SEQ ID NO: 253823 - DNA, 460 bp, Homo sapiens
gtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtactttaaaattaatcctcggtcgggtctgattgttacagcacggccactgaatactg

SEQ ID NO: 253824 - DNA, 456 bp, Homo sapiens
gtgacagttgatgacttagatgatggagcgaatggagagatcgaatctgtttccattgtggctggggatcctttagatcagttcttcctggctaaggaaggaaagtggttgaatgagtacaagattaaggagaggaagcagattgactgggagagctttccctatggctacaatctcactcttcaagcaaaagacaagggatctcctcaaaaatgttcagcattaaaggcagtctacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatctcctggtgaggatgcagtgtagagtgctgtagctgtgtgttccaataaattattttgtagggaaaaaaaaaaa

SEQ ID NO: 253825 - DNA, 319 bp, Homo sapiens
caaggagccagattctctcactttaaacaagaaattgagaaatgaagctggtgattgagggactccaaaatctggccaagtagtataatgaaagtgagatattgttctggtttcaccactattgatattttctaattgtggtagatgtactgtataatacgacttcacatcttctgacaagagcttcacactgaatcctgtttctttaaacagcatctcttggtcatctgttggccagtactgtgcacatttaaccaattctttctccataatgcggttcagcatgacaactgctttggtcttctgctgccaaaccata

SEQ ID NO: 253826 - DNA, 635 bp, Homo sapiens
attgcctaatggtataaattatcttgttttgtcagcacaataaagtttattttattggcattttaaggcaccatctttatgttggatatttgtatcaactaaatagtggtaggtaggtcggtcgatcgatcaatcggtaggtaggtaggtagatagatagatagatagatagatagatagatccagcattttggtgtgtagaatcttatacttcatagctactgctacttgatggaaatttatttagcacatatacgtattagaagattgtttaccaaatacactactatgggagattttgagcaggtaatattttgtaaatgccagttagcagataaacaatagtatgtgtatatatctatatgaaaatacctttggccaggtgcggtggctcacacctgtaatcccagcactttgggaggccgaggtgggcggatcacctgaggtcaggaggtcaagaccagcctggccagcatgatgaaaccccgtctctactaaaaattcaaaaattagctggccatgctggcaggcgcctgtaatcctagctactcgggaggctgaggcaggcgaattgtttgaacctgggaggcggaagttgcagtgagccgatcacaccattgcactccagcctaggc

SEQ ID NO: 253827 - DNA, 722 bp, Homo sapiens
ctagaatctagatataaaaaatttatatttgtctctatattctagaatctagatattaaaaaaaggtagaagtttattataatgaacagtcattccctcatttattaattcaaattaactagttatacctattatgtactaggtatgcctttagatgctacagattaagcagtgaaaatgacaggtatatttttggtatttgttcttcaaatatgtatctgacttgctcttctctacatagctatttattttagattaactcatttgtctcaatggcacaatcgtaagtctacttgaaaagactgaacaaatgtgtgcatttttggtaagaagccaaaggtacctcggacagttctttgttcctctgatgacaggaagtcctccagagatgtaactactcttaaaactgacaaatctgaagttgcaaaccatagatattatatatgcatgcagagtcaacacattttctaggcgactgctttatgtcacaatactaggtgctaggaatacaaagaagatccagacatctcacagccaacgctccaataaagttcagtgggaagacaataatgtaaacccaaagggtaatagatattgtgagagaagtatgttgggtagcaggagtaccaaaggggaaccatgtttttatttgatggagaaataggtacggggacaagaaatttccacagagaaagccctttagttgagccctgaagtatgaa

SEQ ID NO: 253828 - DNA, 554 bp, Homo sapiens
ccatattaaattgtagccttttgcatgcgggtattatataataatgaatgggtggctcctagtagcatgcaacccatgactgtttacttccctaaaagggttaggtctgtgtcctgcacagtgttcaaaaccattaaatgtgttctttgtagcaggatggtacacagccatcagcagaatgagttaaaaccaacaatgaattcaatataccaggaaatagattgttagtagggaatggcattaaaggaaaaaaaaattagataagatgcattcaaggaataattactttcactctgctggcttaatcagtgaaggaacataaaaggaaagctggcagtgggtcttggtaatatatgaactatattagagtgccagaaaaggagacctcagaagttaagcataggttgccaatctgctacaattatttttcccaccaatctgctcaaaatgattgtatatagtattcttaaaaccatgtgtcttggtgcagaaatattgacaaatgctggccagctttatcttcctatatccttcattaaaagtatatgcatata

SEQ ID NO: 253829 - DNA, 2555 bp, Homo sapiens
acagagctaccctagtgtccccaggctgaggaggtagtgactggcatacatggctcagtttgtccaggtcctggctgaaataggtgactttggtcgcttccagatacagctattgatcctgctgtgtgttctcaacttcctgtctcccttctacttttttgcccatgtcttcatggtcctagatgagccccaccactgtgcagtggcttgggtgaagaaccacactttcaacctgagtgctgctgaacagctggtactgagcgtgcccctggacactgcaggtcacccagagccctgcctcatgttccggccaccccccgccaatgccagcctgcaggacatcctcagccaccgcttcaatgagacgcagccttgtgatatgggctgggaatatcctgagaacaggctcccatccctgaagaatgagttcaacctggtttgtgatcggaagcacctgaaggacaccacacagtcagtgttcatgggtgggctccttgttggcaccctcatgtttgggcccctctgcgaccggattggccgcaaggccacaatcctggcgcagctgctcctcttcaccctcatcggcctggccacagcttttgtgcccagctttgagctctacatggccctgcgctttgctgtggctactgccgtcgctggacttagcttcagcaatgtcaccctactgacagaatgggtggggccctcatggaggacgcaggccgtggtcctggcccagtgcaacttctccctcgggcagatggtgcttgcgggactcgcctacggtttccgcaactggaggctccttcagatcaccggcactgcgcctggcttactgctcttcttctacttctgggctctgccagaatctgcacgttggctcctgacccgtgggaggatggacgaggcgatacaactgatccagaaggcggcctcggtcaataggcggaaactctccccggagctcatgaaccagctggtcccagagaagacaggcccctcagggaatgccctggatctgttcagacacccccagctccggaaggtgaccctgattatcttctgtgtctggtttgtggacagtctggggtactacggcctgagcctccaagtgggggacttcggcctggacgtctatctgacgcagctcatctttggagctgttgaggtgcctgcccgctgttccagcatcttcatgatgcagaggtttggccgcaagtggagccagttggggaccttggtcttgggtggcctgatgtgtatcatcatcatcttcatcccagcagatctgcccgtggtggtcaccatgctggctgtggtggggaagatggccacagctgctgcctttaccatctcctatgtgtactctgccgagcttttccccaccatcctccggcagacaggcatggggctggtgggcatcttctcacggatcgggggcatcctcacaccacttgtgatcctgctgggagagtaccacgctgccctccccatgctcatctacggcagcctccccatcgtggccggcctgctgtgcaccctgctgccagagacgcatggccagggcctgaaagacaccctccaggacctggagctggggcctcacccacggtcccccaaatcagtgccctcagagaaggaaacagaggccaagggaagaacttccagcccgggagtggcctttgtgagcagcacatacttctgattgaggtctctaagagctggaccatcagcagcagggagctgcctaaacacctccttggatatggccaggacccacagggacacagggcaagaccagccttgcttatggaggcaggacaccacaatctggcccatggctgtcacctcctgccgagtccaatcccagactgggaaccaccatctgagacaggacctcccggcctccttcacctttctcatctccagagccctgcccccaatactctgtctgggttaggatcttgggtatgtcttggaattaacttgtcctctaacaatcttcatggggtatggctctcttgatctcctcaatctggagtcccctgccctcaaaacacagtgatgttcagaacagaacacaaggtaagccctttccaatttgtgggaacaggaggggagaggaaacaaatgtgaagttgtggactctacccaggcaggtggatgaaaatgctgtggataaaaggaaggttatgattccttctagcggatggaccagattcctctggctaacgtatggccccataggtcactgggtcatacagagagaagattcagttcagcctaaatcaaaacttccaccttgtgttcacttcaaagatggcccaacccccgccctacactcagctcatgcctaacctatgtgtggctcagggaccagcttggggaaggaaaggaggtttgttctgctccccgcctcaccccgcctcctcctgctcatgctcagctgcttctggaccttccagggcccatgcagggtgagggaaagggtagaggtcttttcaccgagctgctgctggttgcagttctttctggtgcacattggctaatgccag

SEQ ID NO: 253830 - DNA, 281 bp, Homo sapiens
aatcaggtaaaaatcataaaattaaatcaaagctatatgttttcattcagtttttaatgcaaatagcttatagatgcttacactgaaacatctcaagcactttaacaggtctgcctaaaattaggatgatttcagttgtaagaaacaaaaatatttgttttggcttaaaccaatggtgtctaatcttttggcttccctgggccacagtggaagaattgtcttgtgccacatataaaatacactaatgctaaagaaagctgataagttaaaaaaaaaaaaaa

SEQ ID NO: 253831 - DNA, 190 bp, Homo sapiens
aacagacaccagggcctggttgagggtggagggcgaggattgaaaaaaatacctataagccaggcgtggtggctcgctcccgtaatcccagcactttgggaggttgaggccagaggatcgcttgagcccaggagtttgggaccagcctgggcaacatagcaagactccatctctattttaaaaaaaaaaa

SEQ ID NO: 253832 - DNA, 120 bp, Homo sapiens
aaagaggtggggtctcactatattgcccatgctggccttggtctcctgggttcaagtgatccttttgcctcagctgcctaaccacaattttaaagtgcacatttccttctaattcaagat

SEQ ID NO: 253833 - DNA, 349 bp, Homo sapiens
gggtgtatttttctgtcattgtgccaatgtcacacgtcttgatttctctaactttagagtaggtcttgatatctgctagccttttggctttaagaggggcatggctattctatcaccaatagatgacaattgttaactttgttttatgcttctaaaagtataattttactgaatcttaaatatgtatattcaacaaaatttagattacactgtacatttgtttagtaatctacatattttacctagcttgaatatttcccctgtgctcaaatattcttgagactttttactttgaaataatttcaagtttacagtacagttgcaaaaatattacaaaataatgccctca

SEQ ID NO: 253834 - DNA, 702 bp, Homo sapiens
aatatatccctccagcattaacatcaacacagactttaagtgtgataagaaacatttacagtctattctctctaaagcctgctactgggaggcattctgcatgataaaacctaggtctccacaatccccgtcttaatccagacactcttttctattgatagtagctttttcaactaattgcccatcacaacagaatatatttatttatttatttttattatacttaaagttctagggcacatgtgcacaacgtgcaggtttgttacataggtatacatgtgccatgttggtgtgctgcacccattaactcatcatttacattaggtatttctcctaatgctatccctctcccagccccccacaccacaacaggccccagtgtgtgatgttcccctccctgtgtccaagtgttctcattgttcaattcccacctatgagtgagaacatggggtgtttggttttctgtccttgtgatagtttgctgagaatgatggtttccagcttcatccatgtccctccaaaggacatgaactcatccttgtttatggctgcacagtattccatggtgtatatgtgccacatttccttaatccagtctatcattgatggacatttgggttggttccaagtctttgctatcgtgaatagtgccgcaataaacatgtgcgtgcatgtgtctttatagtagcatgatttataatc

SEQ ID NO: 253835 - DNA, 372 bp, Homo sapiens
  misc_feature (2)..(2): n is a, c, g, or t
  misc_feature (11)..(12): n is a, c, g, or t
  misc_feature (88)..(88): n is a, c, g, or t
cnggggcatgnnagtctccttgaggaataaccccctttttttccttagtaggggggcattcaactaactacactgttctgaagtctgnaagaggagcaggctaggacatctcactgttcaggatacagactcttcctcaacctcctggtggttggtatggtgcacccatgctctcacctctgcctggcttgtggactctgtccttatattccatttagggtccctctattctctccttcagttgactcacctctgccctccagcccttactttggccccccatggcctgctttcctccctggctagccctcagctcagatatgataaccctaatatcttttcatgaactcatgatttttatctttcacataa

SEQ ID NO: 253836 - DNA, 446 bp, Homo sapiens
ggcatagttggagaggccaagatccaggaacttgccctcctggtgcagctggtggcaggcactcagtgtctcttccaccggggtgctgtggtctggcctgagcaggtagaagaggtccactcggggacactgcagccacttcagtgacgtctccagctggaaccggagactgtcaggtttcagggagttcccaaacaatggattggccttggtatcaattttcaggccacccaggatggtcttggactggctgtcgctgtacacgaaggccgtgtctatcttggtgtggccgtgctccaggaaggcgcgggtgactacggcgccccatctccatggcacccaacaccgtggagggccgggacatgatggcggcaacaggagactgcgacagcccgggagcaacgtgcagtggttggaagcatcagctccctggagttggcggccgc

SEQ ID NO: 253837 - DNA, 346 bp, Homo sapiens
ttttaaaacaataaataaattagaaaaaaaacagtattctcagtactataggacctgattaagtttgtgggactgaaaatgatttatgcttttcaaatatggaatctagctgtaaatgttgctgttatcttttggttggggtaggggaggcagctgcagttactatggtggtagtggaatgagtttggagtccaacatgtctaactggtatgtttggatagaaatttccgaaagacattgagaaatacagttaaagctgtatttctagcattacctataataatttttaatttacttttgatgtgatgtttttggatttgccgtattcttaagtgatttttacaca

SEQ ID NO: 253838 - DNA, 431 bp, Homo sapiens
caacttgagaagtactggagcagaatgtgtggctgcctgcagaatcttgtgctgggtgttggagtcccagggagctagaggtagcagggactcagggctctgagactggcaacagtgtgcctgaggcattgtctacgctctgcagaagaaaggtgggaataattctaggagcaaagcaaggaaagtgggtgcagagagaaccgatggaatttctttaggcttgaaaacttgagggggttgtgaagagaaaataagttgttggagaaaaaaatccagagtagaggttgtctaacatgtatgaaacatgctgtttttgttagatcatcaaagtgactttagagaccgacagtggcagtacatgccctgttacacaaagaggtgtttccttccataaccactgcttggtttaaaaaaatttaaaaagaagcaaa

SEQ ID NO: 253839 - DNA, 269 bp, Homo sapiens
ttttttttggatttaaaaattatttcctattttcaaatgatttaaaccttttaagaaaataaaagttgggcaaatttgcctccaccaattatcacaaaaattaactttgtagtttatataatccataactattacctataaaaatctataaatgtactggataaataatagagaaatcaaaaatatcactttaggtaatacacccatttaaaattgaatccatttccatggagaaaggaaaaaatacactgtagcatttggtataaaag

SEQ ID NO: 253840 - DNA, 673 bp, Homo sapiens
agcaatgattccaaagtatgtgaagctagcctcacagattgaagtccttgaaatcacactttccaaacagcttcaaatgaagaacaagctcatacaaactcaagagtgcttgatcgatgagcaactccagcaagtgaagacatcacagtctggggcagtgcatggctgacccctttacctgttgaactagctgctttggcccttgtttcaagggaaaagggctctagaggaattgggggtttggtcctcttaaggtctgaggtctttgggtctctgggtttggtcaggcccttagggactgtgggcttaggctgagcaagggtagccttgggacatgtctcaaactctggtgaagtcaagaaaggccacagagtggaaaatccagaatctacatcccattcgtgccagagccctgttccatccactctctgagcagatgtctccctacgaaggcccaagggactcctgaaaagcaggcacgaatagaccgcagagttaaacagtgcaagggcatgctgtggacccacccactttgggtaaatcttttgacttctctgtgaatcagaaaatcaatgggatagactatgcctcacagggccaccctagggatcgaataagatgatggataccaaagtgcttcattaacaataaagtgccaaaaagagttactact

SEQ ID NO: 253841 - DNA, 460 bp, Homo sapiens
ttcaacacccagctcaaatcccacttctgtaaacactttattctccactctagtctaccccttattatctgtatgattattttggtataccattagtaccttgtaagatttttcgtatttttttcataaactacttttgtaattttgtattcagtttttgagtgggtaatgtgcacatggtacagattttaaatttacaaaaataccctcccatccaattctatccccagcatccagttttcctccttggaagcaaccacttttacaactttctgtgttcttcccagtatattctatgcctctcttagagagagagagagagaatacacaaacacaaggagaatacacggatatacacccgcaaatgttggcatacaacatggaaatcctttggcccctttggacttctctttacttaacattatggacttttttttagttgtggctaaaacaaaaaata

SEQ ID NO: 253842 - DNA, 474 bp, Homo sapiens
atgaaatgactgttttcacatatgtggcaccaggcagcccagggatgccggtgaaatctctgggagaacggcatgttccagagagccacagcttgctcagcctggaccccagaacgaaggaggcatcagaagctgagccacccgtggccgacaagaaacctgagtgggaggggaaacttggttgctgtgatcgacccaggcttgcgagttgttttggcaacacagcctagcaagagccgaccaatatgtcattgatgaaagaaagtcaacaggcgtgtagaaggagctgtctactgagcatgtctgcacttttctgaattatgttgcacttgagtaaaaagtaagcaagcctgtctatttactttaaatgatgtgtgccagatatgtacagtatgcagagttaagaaggtgccaccccaaaataggctgctctggcatagtcactattaggaattaaaggcagttaaaacaata

SEQ ID NO: 253843 - DNA, 304 bp, Homo sapiens
ctcttgatttattaacatctacaggtcagaataagttgattccaacactttttttccagttttctcattgcatttgtggaggagagagaatttttggagatccttagtctgctattcttactgacattagccttatgttgttgatagtagtatagaatagtattcgaaatgatgtggacaattttgtcaaatgcttttaagatattgtacatctgggccgggcgcggtggctcacacctgtaatccagcactttgggaggccgaagcaggtggatcatgaggtcaggagatcaagaccatcctg

SEQ ID NO: 253844 - DNA, 885 bp, Homo sapiens
gattcggaacgaggagagagactcatatattatgtaaataatggaacaaacaaacagattttttaaaaatcataattaagatgttgaaatgtagaaaagatgaacaaagtgtaagaaaaaatagtacccacagaaatatctatataaaaaattaaatggacatcttatacctaaagaatacagtattgggaataactcattgcatgggtttgagggcagacaagagccaacagaaaggagtaataaacttgatgaaaaaatggaaaatatccagaataaagtacagtgagaaaatacaaaaaaaatttagagcattagagataagagatagagcctgtaatccaggctgaagtgcagtggtgtgatatagctcactgcaacctcgacctgggctcaagcgatcctcttgagtagctagggctacaggcacacaccatgctcaactaatttgtttttgtagagatggggtctcacagtgttgcccaggctggtcttgagtgacattttatctcaattttcatatttaattggcataaagttattcatactgtcctgttctctacccaatgtctgatggatctatgatgaaattgtctctgcgtattctatatttattaggtatatgtatcagttaggttggttggttaattggttattcatgttattagttttctttcggttagtgtttatagagtacattattttcatctgtttgcttttctcttcctgtgtttttatattttgagtgtctttgtatctcagggccctcttataaacaaatataattgagttctgggggtttttttggtctggtttgttcatttattcctactgactgttttacttaatccacccttctttaataaaattatttatttgggttta

SEQ ID NO: 253845 - DNA, 372 bp, Homo sapiens
ggcaagggcagaggccttcagagcgttttctttttccctttcctcccttcctgcaaacaatgtggctacagtttaactggaagtgacaaactgaggaaactgaggcactggaagatgaaggctacagaggtagaaagtgatggaggagatacatccagaagactgcattacaatttcaaatcaaagctggacaagtttttttttttttttacacagatatcaccatgttagaaaagttggacaagttttgaaaccattctgaacctatcattcctgtctttcaaatccttccaaggcatcttattattgatttgtttctatattttcctcattattaaagaggttgagtatcttttctctagagctagtttg

SEQ ID NO: 253846 - DNA, 320 bp, Homo sapiens
atgcctggagacgggaatgtctggaatcttagaggaaggaatcacacaccgacaagcatggcaggcttagtctttgaaacttaatcagagcctgagatacatccagaagactgcattacaatttcaaatcaaagctggacaagtttttttttttttttacacagatatcaccatgttagaaaagttggacaagttttgaaaccattctgaacctatcattcctgtctttcaaatccttccaaggcatcttattattgatttgtttctatattttcctcattattaaagaggttgagtatcttttctctagagctagtttg

SEQ ID NO: 253847 - DNA, 757 bp, Homo sapiens
catttccctagctccctcctgccaagccactgtgtctggagctgatccaccttcctattgatattctttgtgatcattgtgtttttttgctacagcgataataacaatagttaacatatgtcgagttttccatgtgctaccacccttctccctaatggtttatcctcaccccattttaccctcacagcaactccaggaagtcaataacgtttctcattccccctgcctcatagggctgctataaggatgaggtaagagaatgctcataaagcactcaggctagtgtctggaacataaacttaatgtatgttagctgttactattgtttttaaaatggttgcctggatactaaacctctctctgtgaccattatacacgctttatctggcccctggcctctgagggctttgggcaccagttcgtgttttccaaaaaatcttttccagaattgcaaagggctgggagaggccaggagtgaaatagagaatcccatacagtcaggcttccaactttgcattaaagaaagcgtattgaataaatttttctcttctccctccgaagatctcactaaaatgataatagaagaattataaaaaggtataaacttgagacattttcagataaatgaaagctgagagaatttatcacccatacaccagcactataagaaacgctaaacgcagttccctgtagctggaggtaaaggtaatgacaccagatgaaaacttgaatgcacaggaagaaatgaagagttcca

SEQ ID NO: 253848 - DNA, 322 bp, Homo sapiens
  misc_feature (249)..(249): n is a, c, g, or t
attccctcatcactcatgaggtccctggcggctttgtcttgtctttaattccagagcctgaagcccaaagataacaggttcttaaaacgtgattttgcaccttctactgaaatacagctgagtcttacatcagtcctgtggaccgcaggcacaacactcacaagcaggagacaggacagaactggtggctaagaacaggcgatccaggacaagacggcctgactgtgactctcagctctcccacttccntacccatatgatcttggcttagtcactcaacctcttcatgcctctgtgtcctcatctgtaagaatttcttcat

SEQ ID NO: 253849 - DNA, 616 bp, Homo sapiens
agaactcctcctggcactccttacactctgatccaccattttgtgaaacatcaactatacccttatacaattataatgggaaggcccatgtgtcaggaacccaaataaccgacccaacttttctccagggagatatattgcaatatattgtaagggactaattcatcaccttatgaaaagccaagttttggtaaaggattctttttacagtgccctccctgaagatgaggtttctggtcataatctgtagcctagagactttgtctcttacaaaagagaaagtctttggtaaaggactcccttaatccccaatggaagggtccataccaggtagtattgactaattcatgtgctgcacaattagggggtatagacttatgtatttacatgtctcatcttaaaaaggcacatcctcctgagtgaacagtgattccagccaaggatcttagcctccagttcactaaacaatatcaacctttgacttgggactagaagcagataacagctgttgttgacagctttaacccaagacactggcccacccatgcctatggatactggcaattgctatcttatggagaacccagcacctggtttatctgatttagtgtctttg

SEQ ID NO: 253850 - DNA, 730 bp, Homo sapiens
ctccctgctcattgcctgtcactttcctgagtctgagaccctctcctcatgtaatctttgccacacaggcatgcttcagaaggctgactttacctgtctgtcgagctgatctgaatcaactccatggcattcagattcagcactgatagacttaacatgcggtagagccaacatccttgctgaagtccaagcagattccatctgtaatcatagttcttcaaaccccacaagtttgtggattcatgtggggtttcattaatagtaatgatcccagttttactaggcaaaatctgagttcctcttatgatctgcccccaccaacctcatctcatacaggtctctccctttctcactcttctgcatccgtatcagcctctctccttgtttcacatcgattgctagaaccacatcttagagcttagcaatgccaaaggtataaatatcaaacatcctacatttgagaatatttctcatgttgtagcttcttgatagaaattgaatgtagtcaatcagtaaaataaataagcactaggtttaaagtaaaccattaataaaaatgaatacctgtaagtcactccaaaataatgtggatagaagttagactttaaaaaatagaccctgctttgttgatttgatttttggactatgtaaatattttaggtaattacaaaacaaattttaaaaacccaattcccataaataaaagtaaaccacacagagaggaaatttt

SEQ ID NO: 253851 - DNA, 577 bp, Homo sapiens
agcaagaatcatcaatggaagtcagtggatgaaagttttgaagaaaaacagaacattggcgtagcctctaaatatctccccaaagatatttcttaattacaaagggaaaacttgtaactttacagtggagaaacttggcagtcaccacctttgccaggtaatcatagttaacatcaccaggcaggggattaaagaacagcacgtacctcctgacatggtgcactgggaaggtcacatcactacagtgcctataacccaagtccaatcatgaagaaatgccagagaaaccgacgctgagggaccttctacaaaaataactggtcactctttaaaaaaaggccaatgtcatgaaatacagagacttaagaactgccccctgaccaaagcttcagcttgggtcagcaagatactcatcagtcaaggttctacttgagcaagaaaaagtgggtaatggtgcccatgatgagtaagcatcacctgactataacttacttccgggaagaggagctgtcctgcaccgtggtgaagctgaaagtacacaggcaatgcagcgcaaacttcatccctccctggatca

SEQ ID NO: 253852 - DNA, 425 bp, Homo sapiens
tcttgagagaagaaaccatatacagagtcatatctcagttgatcctccaagcaaaaggctttatatccagaacctggcttagatctgtggctgaaaagctaaaggctctaatttgcagactcctttacagccaggattccagaagactcaggtctgatgaatgagatgcacgctcctgggtggcagagcagataggagagcagaagagtcagagtaaggggaaggtgatgtgaatgaagatggagcagaaaaatgtgagcacacaccttgcagggaagccagcaaccgccagaagcagaagcagcaaaggcagaatcttccagttgaacctccagagaaagtatggccctgacgacaaactaattttggacttctggcttcctgatacgtgagagaataaatttgtattgttttgagccaccaaa

SEQ ID NO: 253853 - DNA, 453 bp, Homo sapiens
ctgtgttggccaggctagagtgcagtgactatttacaggcatgatcatagcttactgtggccttgaactcctgggctcaagcagtcctactgcctcagccttccaagtagccgggactacaggtccatgttactgtgcccagcttgtttttgttaaggaatctgttaagaaattcttttaggtcgtgtgcggtggctcacgcctgtagtcccagcactttgggatgccgaggtgggcggatcaccaggtcaggagatcgagaccacggtgaaaccctgtctctactaaaaaatacaaaaaattagccgggcctggtggtgggcgcctgtagtcccagctactcaggaggctgaggcaggagaatggtgtgaacccaggaggcggaacttgcagtgagccaagatcgcgcctctatgctccagcctgggtgacagagcgagactccgtcttaaa

SEQ ID NO: 253854 - DNA, 559 bp, Homo sapiens
agaccgagtagtgccgagttccttgaagaaaattattttatggacaatgtatgagtctgttttcgtgctgctgataaagacatacccagactcacagttctacgtggctggggaggcctcacaatcgtgatggaaggtgaaagacacgtcttacatggccacagggagaatgagagtccctgtacagaaccatcagatcacatgagacttactcactgccatgagaacagcatgggggaaaccgcccccatgattcagttatctcccaccgggtccctcccacaacacgtggaaattatgggagctataattcaagatgagatttgagtggggacacagccagaccatatcagacaagaatcatcttctcaaatttggggtgcgtggctgagtgcacacacctgtgaaaactgcgggatgaatgcattacaacttcctggaacaagtcattttacctaagtaattggaaggggaaagccaactgatctgcttatctggtaaatcatttaaaacatgatttttacattaacacaaacccagatttattatgaagtaatat

SEQ ID NO: 253855 - DNA, 512 bp, Homo sapiens
agcgtctctgggaggtagcacaagactccacaaggatagcacagtgactgattcccaggcatgagccaccgggcctggccccaaatatataggtcttattatgtcacagtgcttttatttgttgagttatttttttctgttttccccatgaaaatgtaagctccaccttggcttacactgtgccaggctactatttgtaggcaactaattgagcacctactacacagcaggagctcaattagtatttcttgaatgaattaaatcatgagggaatgaatgagccaaataagcaatggaggaggagacagatgttccaaacagagaggactgcctgtgtagcggagctgtggccaccaggggtttgagagctgaaggaaggcctatagggccagtgtacatagtacataccaggagaggtagtgatagatgaggaagagaattaagcatggctagatcctaacggaccttgaaggctgtgtttgttttaagggcaatgagaaggcatgaaaggg

SEQ ID NO: 253856 - DNA, 147 bp, Homo sapiens
gtaaatatatgtattacatccctagaaaaagaatcccaggattttccctcctgtgtgttttcatcttgcttcttcatggtccatgatgccagctgaggttgtcagtacaatgaaaccaaactggcgggatggaagcagattattttg

SEQ ID NO: 253857 - DNA, 447 bp, Homo sapiens
gtagagacaagtgttttctagtatactaaacctatagtggtaaaagtgaaaaagataaatgtttttgttgtttgagcagagaaatgttttggacttaagatgttaaacacacagaaaatctttcaaaccattcttcttcaaagctttctctgtggctgggggcgagaggaattctggaaagaatagtcgtacccattttggtggaacttcctgaacgtttacacgaggcatgatttttgagagatttattggcttgccagctttgagtgtagttgctagttccttgagcaaatgtatatcctgtgtcatagcataaaatattaattggaattccagcaaatatccagatagttgggaggggaatagacatggcagccttttttgcttaaggatggtgacaattctgtcaacaaaaagctagcctctagcatcctgcaagttggagtt

SEQ ID NO: 253858 - DNA, 384 bp, Homo sapiens
gagcataaggcattcattctgttgtaaattgtgagaaacagtgcaaactggttagtgatttcctaatgtgatggcttgctgaaagctcaggtggaagcttccctaccactggtagaaattcctggactctcagggtagagctttcttccacaacctttccagtgattttgtaagtcactcaacacatgataatatctctatttggaaataaactgttgtcttcagcctaactctgctctagcagacacatcaaagtttatgacctctttgatctccttttattatttaatcccaatttaaaatttttcttgtgtaatattatctggaacttttttattgtattggacttagaaaaataaacacttggatatttccattcactca

SEQ ID NO: 253859 - DNA, 954 bp, Homo sapiens
tttttcaaaaatgtctagggtcttaggagagttggacacattcaaaacacaatatgtgattaagaagattaaagattaatacttattgatggattactatgtgccaaacttccaaccgaatcctgacaacaattccttaagatgtggaaactgcagttcactgaggttgacatttccgggttcatacaacaaggatggggatgaatgactgtaactgcagacctttacaaggacaatgagagctcctaatggaggcgctaaggcagctggcccagaggcagtaaagttggcaacctcattggctccccttgagagtccggcccaccacaaccattcttttagatatgcatggtcacttagatctgctttcatggttcctatcctgtttggcaccatgacaagaaaacaaacaagttatggacttagaagatatagacttatggtggagacagagacatggaataataacccaaagtagctcatcttcctagaggcctattcttcctcttcctccagccattgcctgtttgacatgagatgtgtccttcgataagtcagtagtggattacctcaaggcaggggacaactaaggctccaatagaaaggatgaattgcaagaatgggacagagatcatattctcaaaaggactttttaataaaaactcactgaaagcaattaatttttcttgatgatttaattttctgcctggacaaagctgctgttttaactgtgtttacaaagcttctactgctggccatggcttctggaattggtctctgatggctggatctttcacactggagccctggttttgattatccaagagatgaaagaatcactccctaaaccttccgttgtccactacagagcttctcttccaccccaccatgctgcctttcctgtcaggatgacaacagcaaagacagcaataataaaagctaatgcttacatta

SEQ ID NO: 253860 - DNA, 1127 bp, Homo sapiens
tttttcaaaaatgtctagggtcttaggagagttggacacattcaaaacacaatatgtgattaagaagattaaagattaatacttattgatggattactatgtgccaaacttccaaccgaatcctgacaacaattccttaagatgtggaaactgcagttcactgaggttgacatttccgggttcatacaacaaggatggggatgaatgactgtaactgcagacctttacaaggacaatgagagctcctaatggaggcgctaaggcagctggcccagaggcagtaaagttggcaacctcattggctccccttgagagtccggcccaccacaaccattcttttagatatgcatggtcacttagatctgctttcatggttcctatcctgtttggcaccatgacaagaaaacaaacaagttatggacttagaagatatagacttatggtggagacagagacatggaataataacccaaagtagctcatcttcctagagctgatgccatcgaaacctgatcatctatcaatcttagttttagtggtgaagactcatggtggattttgcctagcagttcataatttgtctcaagggtgcctgagtgtctcagcgtctccagaaagcccttcgtggttgtttctggaatgagtcccagtgctcacctcacacaggcctattcttcctcttcctccagccattgcctgtttgacatgagatgtgtccttcgataagtcagtagtggattacctcaaggcaggggacaactaaggctccaatagaaaggatgaattgcaagaatgggacagagatcatattctcaaaaggactttttaataaaaactcactgaaagcaattaatttttcttgatgatttaattttctgcctggacaaagctgctgttttaactgtgtttacaaagcttctactgctggccatggcttctggaattggtctctgatggctggatctttcacactggagccctggttttgattatccaagagatgaaagaatcactccctaaaccttccgttgtccactacagagcttctcttccaccccaccatgctgcctttcctgtcaggatgacaacagcaaagacagcaataataaaagctaatgcttacatta

SEQ ID NO: 253861 - DNA, 926 bp, Homo sapiens
cttggaatgttttccctacaatcctcatgagaacacggtgagcccaggagggaagttcctattcacagctggggaaactgagacccagggaaggaagatgacttggctcaagtccttcagctcccctgatgcctgcagcagggctctcgcatcatgcctggccccgtgtggctcattgctggtgtgatctaaattctacacagggagtagcagtgggagggtctctgaagggatgttggaggacgctgcctcctgccttcccctgtttgcacaaggactccaatgtggaggtgagtgccccatctgggctctgtctcaggtgtgcttcctcaaaaagaaagcgcagagcccaggcccggaggcccggaggcccggagctcccctcgacaggctgagccctgccttgggctcccagatgaggtggtccaggaccgggaacgatttagttctgctgaggtttcagttacaaactctgccatcacgctggagcctagtgaggttcccagttggaaaaagaaaaacaattctttctggctggctgaagaaacggctccagcaaggagctggcaagtgtgtaagtaaacacagctccagccggcacagtcgggctctgtcaagaccggccctgaggctgcagaggcaccagagggtctaggagaaggcccaactgtggggagagaagtggggagacaggcctgccagccttgttcaggcatcaggagatgttggccaaggcccaccctggagatgtcagcctcttcccacctctagaggtctgggaagctcccacggccttctgcagcccctgctggagcctgggtggtgagctcatgattgcacagtaagtgtccgtctgctccctccagatagtgtgtgccttgggcaggccatgcccaggtccctctgccctccccatgcagggcact

SEQ ID NO: 253862 - DNA, 729 bp, Homo sapiens
tctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagctgagccctgccttgggctcccagatgaggtggtccaggaccgggaacgatttagttctgctgaggtttcagttacaaactctgccatcacgctggagcctagtgaggttcccagttggaaaaagaaaaacaattctttctggctggctgaagaaacggctccagcaaggagctggcaagtgtgtaagtaaacacagctccagccggcacagtcgggctctgtcaagaccggccctgaggctgcagaggcaccagagggtctaggagaaggcccaactgtggggagagaagtggggagacaggcctgccagccttgttcaggcatcaggagatgttggccaaggcccaccctggagatgtcagcctcttcccacctctagaggtctgggaagctcccacggccttctgcagcccctgctggagcctgggtggtgagctcatgattgcacagtaagtgtccgtctgctccctccagatagtgtgtgccttgggcaggccatgcccaggtccctctgccctccccatgcagggcact

SEQ ID NO: 253863 - DNA, 388 bp, Homo sapiens
tttatgaacataacatttccacttacaggatttatgattgtactcactgattttgctcagctgtgtgataaaccctaggacatttcagaagctaggctgtaagaataagccttttagctgtatattggtagttcaataaagaaaacagcttgtgttatagcacagttcttttaaagtagtttcttaagaattctaaagaatgttggaaaggatttcatgatgtatctctctcaaatatccaggccaactgtgttatattgaggtgaaaagatttgttttttggatagatactttattgattgaatgaataactaaaagtagaaatggtgacattgccaggagtgtcaataattgatagatattggccataatatttccactttctatc

SEQ ID NO: 253864 - DNA, 678 bp, Homo sapiens
ccgggcgtggtggcaggtgcctgtagtcccagctacttgggaggctggggcaggagaatggcatgaacccgggaggcagagcttgcagtgagccgagatcatgccattgcactccagcctgggggacagagcgagactctgtctcaaaagaaaaaaaaaaaaagatgaccagaggacagagactgcagggagcagtacagggtagtgcaagaagctctggccctggggccagttttgtgtggggagggggcatttgaatctcacctctggcacctgtttttggagcaacctcagataagtcacttaacatttctgaaccaacttttctcatttgtaaaaatagaatctaccaggataaattggttttaggacttaagactataatcaatccatgtatatataagtacaaatttccccaaggagcaatggttcagcgtttgccaattcattgtttgtggagattttatagaacataatatcactaataacaagaatcaactggctgggcgtggtggctcatgcctgtaatcccagcacttcggaagggcgaggagggtgaatcatttgaggtcaggagttcaagaccagcctagccaacatggtgaaaccccatctctactaaaaatacaaaattggccggatgcggtggcatgtgcctggtcgacgcccagctactca

SEQ ID NO: 253865 - DNA, 1178 bp, Homo sapiens
acttctcatcctggccaaatagctattgcaaatgctatttttgactctattgatatattgaaatgtgacgtttccatctacaggtaaagaatttgtaggaaaaaagaagaaaaagtgatgtaattttgaagtattcttttagtgaggtattctctcatctctgtaacaaacagaattgctgttctttgctgtaggggctgtcctgtgccgtaaaggatgtttaccagcatccttgaccttctcccaccagccaatagcacctctccagtggtgacaatcaaaaatgtctgtattcagcagatcctgaattcagaaggaaaaaaaaagtttaaaaaaaaaccaaaaatgtctgcacacatggtcccccaaaattgtcgcagttgagaaccactgttttaactgaagcaacaagattattataaaagaaaccatcttcttccctccatccaccaaaaaactaaagtaatttctgagatagaccccctctagaaatttcagaggatttagacaaagcaggtagattaaatactcagttatttagttataaaaggccaaaccagaattattgaggacaatgtctttggagactgttgctggtgagctgtgattcttaccacaggtgcctgcctgccttttacttcaagtcgagggagtgggccttcaatggatctgctcagagcacttgacttgtacctcctgcagtctgaggggcaccgtgggcctgtgtctgactcccacaggctggcggctgttttggcagcagagtagaggaatgttgaatctgcactgggattagcctgtactcccaagtttgttcgggcaagaggtgcctgagagcttcctgtggaccaggtgtgggccatacagagctgtcactaggctaacacagcagcaccatgagaaaaaagctctccttcgtccagacgctttgcttccatctattgggaagcagtcgttgtaatttagtttggacaaaacactttactgccacctgcgggctggccccgcgccacagccgtagctttaacctcccgtcagcgccgccccaggaagaggcttctcggccgcggagccacttggggcctcagttctcgccctcttgccgtcgccgcgggtcctggagaagcggccgcggccagggaacggggcatcgcggttccacggtaggtaaccccgct

SEQ ID NO: 253866 - DNA, 426 bp, Homo sapiens
ctaacgggaggtgttttgtccatggaggcaaattcctcatgaacgtcttggtacactccttgctgtagtgagtgggtcgttactctgtcagtaccctggagagctggttgtttaaaaaagcatggaatctcctgcctctctctcttgctagctctcttgcccataaggtttctgcatatgctggctcccttatgccttctgccatgagtggaagcagtgtgagaccctcatcaaaaccatatgtggacagcatgcatcttgtacagcctgcaaaaacatgagacactttttcctataaattacccagactcaggcattcctttatggcaacacaaattgtctaagacaggaattgtagaagagaaagtatggtggaaaaactagatactgagaatctttcctgtaggaaagcagctaacaaaatta

SEQ ID NO: 253867 - DNA, 654 bp, Homo sapiens
aaggacaaatacctattgcatgtgggcttaaaacctagatgacaggttgatgggtgcagcgaaacaccatggcccatgtatacctatgtaacaaacctgcacgttctgcacatgtatccgagaacttaaagtttaattaaaatgccatgatgcggcatggttgggtgagcaggtgatggggtcggtgcgtatgtaactccaccagcaggtctcctctttaggctccatctacctaattgggcatcaactcaccatctctccatgagtccaacacacataggttcctcttggaccagattgttgcttcatagggaagacaccaaaggcggtaattgtgcttgtgtgtagtgaaaatggggtataaagatacaaacatttagcttttagcttcatgtacaagtgaggggagctgcttatttcttattccccagagagatgggggcctgagacagtgagggcagattgagggactccatttcctgttcatgctggtgcacatgctcactgagtgtattggcaagctagcagcccatactatttcagaagattcttctctttctcatttggctaaattttacctgttgaactttagtatattaaatatgtctaagctgtaatttcaccatactcaatttatctgagttccattttctt

SEQ ID NO: 253868 - DNA, 396 bp, Homo sapiens
atagcatatgcctatatgcccactatctagattctaccattaacatttgactcttcttgttttgtcatatatctatctattctatgtagccatccttttttttcttccgccttttttacgtaagtattgtcttttctcttttcttctttgctccccagttgattaaaccagtgtttctctggggctgattgggactcaagtgtcttccagctttgtgtgagctctgggaattgtttagcttatagttccgagggtcattctctgcccagacttactgggtttcatcctacacaagtatatcttagtattcaaccacagactcaaggggacatcctcccttgcagatttctggaactctttcttgatttaccttcttcctttctggtactctgccct

SEQ ID NO: 253869 - DNA, 440 bp, Homo sapiens
agactatcagattctaataaattgtgctttttagctcaaggtttaaaagaagcttgtggttccaggcaatggtcaaatgtggtcagttgttagggctaaaattacattaatgacgttatataattttatataatgaggaaaacagagcaagaaacatgtaccttttattatctgcataagcaaagcaaacatataaaataatggcacaaattttacggggtgagagggagttgggaattgggaaggagacaagttctctttattctcacacatggacaataaatgaaattacaattttcccttgatttcttctctacatgaaagctgaaatcctggatatacctgtcacaaatgatccttgttctcagcttagtcttttattttctatttgactctgtggtgacattgatgagctacttcatcacttctctattgttacc

SEQ ID NO: 253870 - DNA, 422 bp, Homo sapiens
catgtgtgtgcccactcaggggtgtatataagtattttatctgtattgcatacctatgctttctgtatacaatatttggaaatacacactgaaagccttagaaatatgtgtactcttaattttttaaaaaaaagattgtactcctcaaacgatttcagttcttaaaatccattcaaagaaaactaaaagtctgaattgaagtgttttttgatcatagtgaaaaatttgaaataatctacctgtccaacagtgggcctttgtttaaaaaatcatggtgtatccctatgatggtatatatgtaatcaaaaacatttaagttttcaaagaaaattgtggaagcataattctaagtatgaagcatacttagaataaacgtgcataatgtgaagtatgggagagggatacaaaacttgtttgatatg

SEQ ID NO: 253871 - DNA, 435 bp, Homo sapiens
gcatgtgggctaaggacggtcaatgcgaccttttcccaaactcacatcccacagaactggccccacctggcacttgtaacctcaacagcagtgagggtaaatagagtttaccttaacggagcactgactgatatgatctcatctcatcctccagcagccctttgtcctccctttgcagatgtaaaggagggaggtaaagacccagcaaggttcagtaacttgcccaaggtcacacagctgcacacatgagaacattggtcaatgcattgtccggtggaggacaagagataaagccagaaggcaaatgtgctcacaatggaatgtgtttccgctgtgaagaagtggcacctgatacatgtgaagcatacccctaccccggtttagtgggtgagggaaggctccttgaaaaagtgttggtaaagaaagttaatattt

SEQ ID NO: 253872 - DNA, 287 bp, Homo sapiens
gccgggccgggcggagaagcttgcgggctccgcgcacctcacctccgccaatcagcaccgcgaatcgacggtgacgtcgctctccccgccccctggggggccgcctttctccaggaagccacgcccaactgctggccggccgcctccctctcggcggcttccgtgcggtcctaaaggctggtgctcggcaggaggaggacgcgggctggggccgtggggcggcgtgagggtagcccgggagcggtgaggagcgtgcgaggcccacgtgagcggagggacgcggccgc

SEQ ID NO: 253873 - DNA, 359 bp, Homo sapiens
ctaatttttgtatttttcatagagacagggtttcaccatgttgcccaggctggtctggaactcctgatctgaggtgatctacccaccttggccccccaaagtgctgagactataggcatgagccaccgcgtccagccaggattcttgaaagggaacatttatagacgcaaaggatggaatagtggttgccagggaggagggaggtgggtgtggctttaaaagggcagcaggagggatgatcctgcagtgatggaatgttctgtcttgattgtagcaacaccaatatgctgattgtgatattatactatagttttgcataacagttaccattaaaggaaattgggtaaaaggctacacaa

SEQ ID NO: 253874 - DNA, 394 bp, Homo sapiens
aaataaaattactgaaaaggcgaagtatactttccaaaaattagactctaatcaatgtagtccgtgcaacaattttctttaataccgaattgcattttatatagctatttgcacagatcttcacaataaaaccataagaaaaggagaataggatattatcttcacagttctacagaggagtaaaaaaactgaccttgatctaaataagtttagaggtggattttaatcctttaataagcaaaagacatataataaaattgataaatgacaatatcaatactttatctaaaagtaatttcataaagaaacaaagccaaaattgattcagttaacataaaaaagagttaacccagaagaaaacaatgaatattgatctcgatttcagcaagcagaa

SEQ ID NO: 253875 - DNA, 110 bp, Homo sapiens
ttatgtcccaagactaattttgcctctgaggatccacagtggctgtcactgtagttattatgtgttttagcattttgcacttgaataaaagcaaagtttaatagacagat

SEQ ID NO: 253876 - DNA, 423 bp, Homo sapiens
atatgttgggaatttgatttaattatgtgaggggagttcagaattggatacatggatctggagtgaaggtaaaaggtctgggatggatatagagacctgtagacacttttaggtggctttttttaaaccacaggattaagagagagtatctcttgagatagtgtgtataaataacagttggctagctatgtagccctggagtatagcaatatttaaatatcgggtaggaccataccttgtagatttactatgctgattaagttaatgtacgtaaaacactttaaaagctgaatctagcaaatacacaatacaggttgctagtgttattactggaggccacatctctgggagaaaaaaaagcatacaaatgataatctataggacctagatctctatgtcttcttaccttggcatggattaacc

SEQ ID NO: 253877 - DNA, 925 bp, Homo sapiens
ggtcgacagctcctgacttgtgatccacccgcctcggcctcccaaagtgctaggattacaggcgtaagccactgcgcccggccacgtcttccttttcttagctttgctttgagaaatcgtttcttatcttggattccattacaatggtcctcctgccatctggcttctccagttggttcgcttatttttccttctcctatcctcattcataagtatacctcaggactagttgtggactttttctctggtattttcttaggtaacttactctctgttgccttgtgtatccagttacctaaaggctctggaggtcccacttttatctcaaatccagcatgtctaaaactgaacatactgtatttccccctgccctcagatggctcatttcaaggtccccagttgggttaatggtctagttagttctttccctagttttcaaaccttggtgtcttcttgagcactctcctggtgtttagtgttcccaagtctgttaactcttctttctcagggtctgttgagactttccgttcctacccgctaaccattcccctcgtttagcttttagtatttcaggcctagacgctcctgtccccagagcttagatcatcttgagccctgaaattcagcagatcttgctcagtgtgcaaggttcaagtcagttcaccaacttccaatcttggctcctacccagaggaatttttgtcctctgagtgaatatctggtaatcttttaattcatgctgctgtgtattatatataatttaactttaatgtctgtatgtcttggcttctcagttacattgtaaatatgttgttaggaaaaaaattctttcttgatacatgggtcttttatatttcagcttcctgtgtgttgagaatatcacagtctgtatcatgtgagaataatttaagaagtagtataacta

SEQ ID NO: 253878 - DNA, 909 bp, Homo sapiens
gaaacagaagctatatagcagtgaaaaatgggttccccccatccttctaggttctttgcgcccggccacgtcttccttttcttagctttgctttgagaaatcgtttcttatcttggattccattacaatggtcctcctgccatctggcttctccagttggttcgcttatttttccttctcctatcctcattcataagtatacctcaggactagttgtggactttttctctggtattttcttaggtaacttactctctgttgccttgtgtatccagttacctaaaggctctggaggtcccacttttatctcaaatccagcatgtctaaaactgaacatactgtatttccccctgccctcagatggctcatttcaaggtccccagttgggttaatggtctagttagttctttccctagttttcaaaccttggtgtcttcttgagcactctcctggtgtttagtgttcccaagtctgttaactcttctttctcagggtctgttgagactttccgttcctacccgctaaccattcccctcgtttagcttttagtatttcaggcctagacgctcctgtccccagagcttagatcatcttgagccctgaaattcagcagatcttgctcagtgtgcaaggttcaagtcagttcaccaacttccaatcttggctcctacccagaggaatttttgtcctctgagtgaatatctggtaatcttttaattcatgctgctgtgtattatatataatttaactttaatgtctgtatgtcttggcttctcagttacattgtaaatatgttgttaggaaaaaaattctttcttgatacatgggtcttttatatttcagcttcctgtgtgttgagaatatcacagtctgtatcatgtgagaataatttaagaagtagtataacta

SEQ ID NO: 253879 - DNA, 120 bp, Homo sapiens
ttggaggggtctagggaaggatgacacagttcctgccctcgaggagagtacagttatcttcaagaaataacaactgcaaaaacaaacattaaagaaggcatataattatgtgctaagtcc

SEQ ID NO: 253880 - DNA, 478 bp, Homo sapiens
cagttctgtgctagatcaaaaatttttaaaggggcttcttaatctctttaaaatcataaaaggaacagatttctaaaggcaagttttctgcatgacctacttcaacccctgtcctttgtggctcttcattgcaccacaggaaacaattagggctctatacatatctataacctctgtatatgtgaaatactgatttctgaataaaccgagttacttccataagaaacaatccatggtttttataaattgttggctttaggctttaaaacttcgtcatttcgtgagattaatctgaacaaactgagtctatacctcaattaaaccctcaggtgtattggaaattatgtttccattattttactatgaatgctgaggttaagaatccctttaacaatgtaaaaccttactgttttgccaaatttttacagaaaaatagctctgtgtgttctaccagtgtcaaaataaaacacttgaaggt

SEQ ID NO: 253881 - DNA, 338 bp, Homo sapiens
agtccactggctgtttcccctgcctcctgctctcccagtgccctctccacaccagtgccagagctgcttctaagagatgcctcaaagcccgcttccagcttaggaaccccagggaacatggatggtttctccattgccacttcctagccttcctggcataggaaggtctggtttgcctgcaggtccctctctgggggggtccctgctccatagatgctgaggctccagaagtctgttcttttatatcacatttgaaaacctttgaaatgcattatagttgagtcatatgaattatgtaagtatatcctactcattgtataaaacaacacagaattgtc

SEQ ID NO: 253882 - DNA, 418 bp, Homo sapiens
gaaccttgattttagactttcagtctccagaaccatgagaaaacaaatcacacttgttgaagcaacccagtctgtggtattttgttatggcagcctgagttgctaagacacttggcaattgtcatgaggtttaaatatgattccataagctgtactctgtgggatgaccctggcaatccataacccacacaccaatggaactggcacatactgggggtctcaaattattactgctgttattctcattattattttaggcaattgcatgaatctattttctctcctatcttgctagctctttgaagataggacctagtcttatccatttttctataacccagaactagtctagagtttggcacataatagttgcctaatgaatatctgctacatgaataaataagcttatattttaata

SEQ ID NO: 253883 - DNA, 2386 bp, Homo sapiens
gaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaaggaaaaaaaat

SEQ ID NO: 253884 - DNA, 2228 bp, Homo sapiens
agcgggggcacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaaggaaaaaaaat

SEQ ID NO: 253885 - DNA, 1812 bp, Homo sapiens
gatctgggatgcagtggattaacaagggatgacgtatgactcttctgtgtttgtcagcatctaggctaggccctgatcccagggaacctgtgctgcaaatgtccactcattcattcattcgttcatttgttcatccatcaacctcctttcttcacaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaaggaaaaaaaat

SEQ ID NO: 253886 - DNA, 2316 bp, Homo sapiens
gaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaaggaaaaaaaat

SEQ ID NO: 253887 - DNA, 1102 bp, Homo sapiens
atatattaatttacagattatgttatactaaaataaataatattctatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaaggaaaaaaaat

SEQ ID NO: 253888 - DNA, 1112 bp, Homo sapiens
tgattcacaccctcactcccacgccacatctcgagccaccatctactcaattatcgatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaaggaaaaaaaat

SEQ ID NO: 253889 - DNA, 2046 bp, Homo sapiens
gaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgacccccagtctttcccaaggggcgaaggcctt

SEQ ID NO: 253890 - DNA, 869 bp, Homo sapiens
  misc_feature (22)..(22): n is a, c, g, or t
  misc_feature (67)..(67): n is a, c, g, or t
agataagtggcctgtgcagatncagagatctgccagaaggaacaagcaccaccagcagctcccttgnctcttaccctctctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccacagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaaggaaaaaaaat

SEQ ID NO: 253891 - DNA, 1632 bp, Homo sapiens
gaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaaggaaaaaaaat

SEQ ID NO: 253892 - DNA, 1601 bp, Homo sapiens
gaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcactggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaaggaaaaaaaat

SEQ ID NO: 253893 - DNA, 1559 bp, Homo sapiens
gaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtttcgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcactcattttctgcgtgagctgcgccatctttatctggggctattttgcttagtgtggggtgaacccaggggtccaaactctgtttctcttcagtgctccatttttttaatgaaagaaaaaataataaagcttttgtttaccacaaggaaaaaaaat

SEQ ID NO: 253894 - DNA, 502 bp, Homo sapiens
gctcccaaactgatgggggagagagacatcatcccccagctctgggagtttccagtctgatggaggagacagagcctgcttcggtaactctcactctgcgggggaagactcagccctatccagggagctcccacactttcaatggggaggcccacccagatctgaaaatgtctaatttcaggctgggcacagtggctcacacctgtaatcccagcattttgggaggctgagacaggaagatggcttgagaagaatttgaccagcctcggcaactgttaagacctcgtctctacaatgaaaaaacatttttttttcattagtctggtgtgtggtagcacgtctgtagtcctatgtacgtgggaggctgagtcgggaggatcccttgtgcccaggagtttgaaattacagtgagctgtgatggcgtcactacattccagcctgggtgacagagcaagaccctgtctttaataataataataataaaattacaaataacaaaaat

SEQ ID NO: 253895 - DNA, 323 bp, Homo sapiens
tgggtgtgtgtgggtgagtgcaggtgtatctgggtgtaggtgggtgagtatgggtgtgtgtctgcgtgtaggtgggtgagtatgggtgtgcaggtgcgtgtgagtatgtgtttacattgtggtatgtgtctgttgggtgccgccattagggatttggaagagtgaggaccataaacttgtaaacatttctacatgcctggtccataagaagtgtaccaagcatgatcaaaagtaactaaaccaagtaaacaaattagacattaattaaacttaatgctgggcaggaaagaagtattcaaggccaggtaaaatgaagaaatata

SEQ ID NO: 253896 - DNA, 212 bp, Homo sapiens
acagagagaagtggggagagacagagagagaaatgggggagagacagagatagaagtgggggagaaacagagacagagagaagtgggggagagagagacagagaagtgggggagagtcagagatagaagtgggggagagacagagaagtgggggagaggcagagaaagaagtggaggagaggcagagacagaagatggggagagacagagat

SEQ ID NO: 253897 - DNA, 351 bp, Homo sapiens
ggtgggtggcagtggcctcagcagctttccccagcagctccaccagctggaaaatgttaagacaacaactccatccttgcccctagggagaacctgtttgtttagattccacagcctcctgttaagaggcaagtgtccgtgcaggggttggttgaatcgggtaaaaattgacctgtgggtaaactcttcattgtcctccactaggcgggtgctagaatctgtggacaccgacaaaggacattagctcatttgttcatcctttcaaaggatactttgcatacctactgtgtgccaggctccgctgggtcctgagaatacagagaaaacaaaaaacaaaggtccctgctttcc

SEQ ID NO: 253898 - DNA, 293 bp, Homo sapiens
ccggggacgcctcacaatcatggcagaagatgaaggaagagcaaagggacatcttacatggtggcaggcaagagagcttgtgcaggggaaatcccattgataaaaacatcagatctcgtgagacttactaccatgagaaccatgtaagaaaaactgcccttatgatacagttatctccacctggtcccacccttgacacatggggattattacaattcaagatgggatgtgggtggggacagggccaaaccatatcagtctgtaactaatctataaaagactcccttggctgg

SEQ ID NO: 253899 - DNA, 290 bp, Homo sapiens
gaagcaccatgaaatcaggtgggtgatggtttcctttcctggtgcttttaaccagttctcccagagtggagataaacatgaagttaatatggggaatgttgatcttcctaaatgcagctccaaatgatagacccaggacaggtttccaaacagctgttattcagattagaggcaaggacttgatgtattgctcccattagaaagtgtcctaatggaaagggcctgcactttctcctggccccatctgaattaaacaattggagtattttaaatcaagggtcataagtgtc

SEQ ID NO: 253900 - DNA, 415 bp, Homo sapiens
caggggaggggcacagccagctccagatgtagaaagaccctttggggtcatggctggagggcaagctggtggaggggactggactggagggggacccaaaaggccagataagaggttgagatagaccaggcgcggtggctcatgcctgtaatcccagcactttgggaggccgaggtgggtggatcatgaagtcaagagattgaggccatcctggctaacacggtgaaaccctgtctctacttaaaaaaaaaaaatttccaaaaaattagccgggcacggtggtgggcgcctgtagtcccagctactcgggaggctgaggcgggagaatggtgtgaacctgggaggtggagcttgcagtgagccgacatcgtgccactgcactccagcctgggtgacagagtgagactccgtctca

SEQ ID NO: 253901 - DNA, 867 bp, Homo sapiens
gaacaaataagctcaaaggtctggaggagccaacagacctgtgcaaacctcagctttccccagttcagctccttttccatcttcttgatttctgtatttttaaaaaaacaaggctgcattatattgtaggagaacaataacccactggaccacatcctggtaaggaagagctgcaaagccatggcctcatcactgtagacataagcttccaacagtgccccattgtggcatttgatttaactcagcccttcaaaaacatgcatttctgacttaaattctgcacaccatcaccatatccccagcagatgtcgctaacgtctcacattttggtcatgccagcagcacgcatctcaggcaacaaatatttattaagcagcgaatgtgcattgtgcaccaggctgagcactttgtagataaaaattcctggggcatgacccaggacatgaagaaaagttacttaagtgaggaggagagaagagatccagatcattttttgatgacaaaagaaggtaacataaaaaaataatggactgtctgaaaagttctttcccattgaggtacaagtttgtttctggctatgcaatgtgaaattggaactgaatgtctgggaccacctcgaagcttgtttcaaaggcctattactacgtgtcttttagacagattttatttcagcttgcctaattgaagcctctggaatctctaatgacagaagtggtaattcatatttctacatttcttctggaaaggaaggcccgaatgagaaggcagcactaaacaaaccgtgaagtcaaagttgaagtatggttgctaggggaagagtgtcgagagccccatgaggtggttgccctctgagatggcttgttgccc

SEQ ID NO: 253902 - DNA, 427 bp, Homo sapiens
tctagatttattgttggagtaaaattagttcctagacatactatcttccatgtttgggtattaaataaacactgaatgaatgactcataggatttttgacatagctgagagatactctcacatatttgaaaacctagttttggggccatttgttgtggtgcacacctgtaattccagcactttgggaggccaaggcatgtggattgcttgagctcaggagtttgagaccaccctggccaacatggcaaaaccccatctctacaaaaaaatacaaaaattaggcaggagtgatggcatgtgcctgtagttccagctactcgacaggctgatgtggaaggatcacttgggcccaggaggcagaggctgcagtgacccaagatgatgccactgcactccagcctgggcaacagagtgagaccctgtcaaa

SEQ ID NO: 253903 - DNA, 298 bp, Homo sapiens
tgagattaacatttaaatctctagactttgagtaaagcacatcaggtaaaagcttgcatagaacgaaaagattaacccaatccaagcaagagggaattatcagcagatggccttcagacttgaactgcagtcttggttctttctggggtctccggcctgcctgtgcacacacacacacatgcagacacacacaccaggaatggtgactggtgaagacacacacacacacacacacacacacacccacctctttggtccacttctctagagaaccctgactaatacaactaggatggtg

SEQ ID NO: 253904 - DNA, 695 bp, Homo sapiens
ggcgcccagcctccctacagttttcaaacattcagagaggtgattatggtgtatcttttattctgttttgctttggatcttggcgttcttctagagaactcatctgctcaggagcttctcagtgcatcttccctcccaaacttgtcttacccagcagagaatgaatgtactcaagattaccagttttgcagatgaataaaccaatgattccagaggttatggtgcatatctagagtcacatgactaagaaatgataaaaccaggatttcagccaggttatctgtttcaagacattttcagacaaaaaaatctggagtttgccaccaacaagaaatgatcctagcctcagcatctcagcccacactgggagtgtcaggtcacagtgagccgagatcatgccactccactccagcctgggtgacagagcaagactccatttcaaaaaaaaaaaaaactgaaaataccaaatattgacaaggatttggagcaagtggaaccctcatacattgctgatggaaatgcaaaattatacagccaatttggaaaaataactgggtgtggtggtgtgcacctatttttccaacaacttgggagactaaggtaggaagatcccttgagcccaggagtttgaggttacagtgagctgatggcgccacggctctccagcctgggtgacaaaataaaactgtttcaaa

SEQ ID NO: 253905 - DNA, 432 bp, Homo sapiens
ggcgcccagcctccctacagttttcaaacattcagagaggtgattatggtgtatcttttattctgttttgctttggatcttggcgttcttctagagaactcatctgctcaggagcttctcagtgcatcttccctcccaaacttgtcttacccagcagagaatgaatgtactcaagattaccagttttgcagatgaataaaccaatgattccagaggttatggtgcatatctagagtcacatgactaagaaatgataaaaccaggatttcagccaggttatctgtttcaagacattttcagacaaaaaaatctggagtttgccaccaacaagaaatgatcctagcctcagcatctcagcccacactgggagtgtcaggtgctgaaaaaaaatttttttaattttacatagtaaataattttataaaaaagaaa

SEQ ID NO: 253906 - DNA, 327 bp, Homo sapiens
acatgacaaaaccccatctctacaaaaaaaaaaaaaaaaaaagtcataaataaatgctcagaattgtcacattgaaattggatcattctcatttataagcaatatcataaatgacaactaggggaggtcaaaggggttctactctagtcttaaagccacagcatggttgtaagtgaaatatctaaactgtgttcagggttttagttacttgcctcacattgtcgaagttcaggattcagtaccatttaaaccttctcaaacaaacaaataaaaaagttatctccgttgcattccagcctgggcaacatagtgagattgaatctcaaa

SEQ ID NO: 253907 - DNA, 1308 bp, Homo sapiens
tgtcatttccagtagtgaaccctcagctgtctctttgtgcctccgagatactgtcaagcgttgtagcctgagaaattgacccactgagcctgcttaattgtgtgcaaacccgtgttgaggcgttcttcctaggccctaatttacgtaggaataggttttcccttccggtctgtgtataatgagaggggagaacgttagtgctaaggcgctaagttctggataaatacttgatttgatgtgatagtgtgtattactctatcagaaatgcagagcgttgtatgatttttctgtgtacacgcgataagagcaatattagttgcaaaaggaagttttcatctttgaacattaaaggtatcctttattcttgatcactatagcatgcaaaaaagaaactatattttctgtcctgttctttgtattactgttaaagagttggtaaactgccgtcttgctgtgagactgggaagtcggcaatgaagttagatttgtattcatgaacatgatctgcctgtcatataggcttgctttgacttgttttttttttcagtagtggcaaagggttttctgccactcaatccacactttcctccgcattggtatctccgttgaccattttgcaaaatagtttattgagattaggggtctgatcttttgtataacctgttgtagtgaactgatcatatgcgacttgactttggccaatagtacctcgtgcagtgtacagtactactatttagacttactgatttgggtaatagaaaagctatgatgttagaaatgttgtcgttgtatattggagaaattttgaagttgcatattggagtaatttagtcctgtatgctttgtaaatgagtgcattctattgtcgagagtaaatacagtattttgtagtataaacttaagcttttagctgaagaaattggcagcatagttggagtgtggagactattcttaaaacgcaaatgttttaaattacaaggaactgtagtggtgtgtaggctgtaacaattcctggtgccaaatttgggagattatttggttgagctactttctataaagaaacatattaagtatctgcaataaaagtggatttgtagctatacacaagggattttacattataaataataactcaataaggcacctttctttgctctttgtgtatctgccagttaagaccaaaacatctcatattttcactggagcttcctgccaaaacaaatactggttttgcattggctttgctgctcagtttgaaagctaggggaatctcttagagcctactctggttctggaggctgcctgatt

SEQ ID NO: 253908 - DNA, 623 bp, Homo sapiens
cacttcctggtgttcctttaacacagctgactggctcctgctgggaaagaagatgggcaacctcagccagctatcctctggagaagacaagtgactgcttcgaaagaagacctagaagtattacttaattcacctctacaggaggaatataacttccccccagaccattatggcctccctgcagtttgtgatctctttgcctgtatgcagcttaaagttgataaaaagaagtggttatatcaaactcctctacagatgtgaaggagtggacaagagttgagcagcctttctgctgattatcacacatcatgagctgagtgactgtggcttgccaaatcattgtgtttctgggtctgaccagttagcttagttcttctcctgcctaattttgaactagtaaagtgaagtgagtcatcagattataagttactgtttaaaagaaaaatgttgtgtattgatgctgagctgattcagttccttccttcttacagaagtgttaattcacccccacaccagaaatgcagcatctttgtgggtatgtctttttcacaagcctccaaggctccttagatcaggtcgttactaaaagtacattaaaacactcaagttttaaaaatgaaaaa

SEQ ID NO: 253909 - DNA, 486 bp, Homo sapiens
agaaaaattgtctgcatgagaagcctagacatttctaagtttcaagcataattataaggagtagtgtgatgtacttgcctatgctttgttcttggcttgctggcaccagttttttttcttgaatctctaaatctactttatatttttgaaagtgttttaaaactatttttaaattaagatccttacacttttatttgtactctttgaaaataagaccataattatacaacaagtaagttttgatttttttctgtgtgaaatctgcatatatatatagtgtcttgctatgttgcccaggtcttgaactcctgggctcaagcagtgctcctgcctcagcctcccaaagtattgggattacaggtgtgagctgccatgcccagcctgattgtttcgtttcttatgatcaaaagagaaatgcaatcagaagacttgttaactgttttctagtatcaaatttgtaaaaataaagcagaaaacatcatccca

SEQ ID NO: 253910 - DNA, 373 bp, Homo sapiens
ttctctcccttcccgtatttaacagcttgcacctcagtttctttatgtaacagcttgcacctcatgggacaacacaacccgtgtggcagaatttttgtgaagagtcaatgaaatagtgtatgtgatcgctcgagcagtgaccggtacggaggtgctgaagagatgctgcttgttactttctttctaggtaccacagagtccgtgttcacacagtgtaaatgccatctgtgggaatttaggacactgtcactagagacacagtagtttaaatcacagacgtaattaagaaaacccaatatactataattcagaaaatccaaatctgcaaaccaaatgcaaattattctctttgcagaaggattcttctattaaa

SEQ ID NO: 253911 - DNA, 396 bp, Homo sapiens
atctttattgaatagatgggttgtggaaactgacagccacagattaaacgcagaagaaggcactagtgcacatgatcgggactgctcactttatttaacaagaatcaccatagtgatgagagatgtgtgagggaaacggcactgcggttgccaacagcagcaggctggggccaacgggctcccggaggcaaagcctggaccatttctgaatgaggggctcatcatcgcctagaactttatgctttgtgtgtgtgtgggggggttctttttgtaaaattgtattcattttaacagcaaatgttgaaaatgtttcaatatgcattctcccctaaaatgtgtagttataagataagagacttggttttcttgccatttttcctttgctgattaaaaaga

SEQ ID NO: 253912 - DNA, 419 bp, Homo sapiens
aaaacttgagatattcaaaaattgtgattccccaacacccacttacttacatatttttggtcaagtatttattccctgctttggttcacatttgtaatttcagatttattagaaagctaatttatatatttttcttccccttcatttacaaactgtctgttaacagattggcaaccaagactaagttttaaatccagaagagagaaatgtttcacgcaagcagtcccccaactcccaacacacactccctttcattccgagcactaaataggtagcttacttgacaagcttcctttaattacacacagacatgggggttggggtaagaagatggtggtaaatatgaaaagtaatctttaataacttctgcttttgtataaaattgtaagtgaagtcaaaagaaatattcttagagtaat

SEQ ID NO: 253913 - DNA, 242 bp, Homo sapiens
tctgcaccagcgagaaccccctcggcctacacggaagcccctcaccaggcaagccgggagccccagaccccgtggcccggagtgggtcgctctgtgacaccctggacaggtcactcaaccacttggcgcctcctcggccactcagaaaacacctgccctcccggagaccccggtgaaagccgagcactcctgcaccctccttccgagcccacgcacaccaggacaccttcagccgcgtctcc

SEQ ID NO: 253914 - DNA, 246 bp, Homo sapiens
cagggtcgatgagagggtatcctgtgtgcctgtgtgtggaaagcggggagtggtagtcatggaaaagaaggttaggaacaaaaccatgctcacttattttttcaacaaataattattgaggcccctgccaggtgctaattcctactccagaggaagggatgtgatagtgaacaaaatagatctctccctctcctgccaagaaaaactttcatgaaccttacattctggtggaggaaaggtttgaca

SEQ ID NO: 253915 - DNA, 621 bp, Homo sapiens
tatttttcctaaagagaaatggttataaactaaatcacttggcctgagagccagtaagtaggcatgaaccaaaaggtactcaggagagaagagaaagaaaagcgatgagtagcagtagaaaacacctacagcagatgcagcagatattctgtaagcaaagagaaccagtaatgaagaagacagaaacaactgtgaagtagaagaggactgagataaaaataattcagatctcaataacctttaaataaaacagcaggggctttttaacatactgcaagcagggcaaatgcagccaccctaaaacttttagcaaccaaaaccaggggaattgcatgtaataggtaacccttagggcctaacctgccagatacagaattttagaagtttgtctaaacatataaagggtgaatttacatgccagaggtgaatttacatgccagaggtgaatttctgaaataaaaggaaatttttttcaatagttcattcacataaggggcaaataagcatagtttccacagatggtttttttttgtctttccccagatagagctttgctcttgttgcccaggctagttttgaattcctgccctcaagcagtcatttcacctcgaccttccaagt

SEQ ID NO: 253916 - DNA, 602 bp, Homo sapiens
tatttttcctaaagagaaatggttataaactaaatcacttggcctgagagccagtaagtaggcatgaaccaaaaggtactcaggagagaagagaaagaaaagcgatgagtagcagtagaaaacacctacagcagatgcagcagatattctgtaagcaaagagaaccagtaatgaagaagacagaaacaactgtgaagtagaagaggactgagataaaaataattcagatctcaataacctttaaataaaacagcaggggctttttaacatactgcaagcagggcaaatgcagccaccctaaaacttttagcaaccaaaaccaggggaattgcatgtaataggtaacccttagggcctaacctgccagatacagaattttagaagtttgtctaaacatataaagggtgaatttacatgccagaggtgaatttctgaaataaaaggaaatttttttcaatagttcattcacataaggggcaaataagcatagtttccacagatggtttttttttgtctttccccagatagagctttgctcttgttgcccaggctagttttgaattcctgccctcaagcagtcatttcacctcgaccttccaagt

SEQ ID NO: 253917 - DNA, 355 bp, Homo sapiens
agacctggggctctgagaagccgatggcttgcctgagaccacccagctgagaggcagagctgggatccgagtctaggtctctgtgactccattctctgtgcttttcccaattccgctcagaagtgtcccaggtagtgccagggaagagagatgggggagggggagctcaggcagctgtggtgacattttcagagggaaatggtctgccctagaggggcccagagggccttttgtgctttctttatacttcctggatctgaactggaaaaaaacatgcaagggctgcttcacacatgattcctgattcacgcagacacaaaagaacgaacccagccaaacaaatcgcacagcccaa

SEQ ID NO: 253918 - DNA, 303 bp, Homo sapiens
tgagaaaccaaggcccagagactgtggatgacttccgtaaggtcacacagcaagccagccgcagaatcaaaagtcaacttctgactcctaaaggagaactgtttccattccacagtgctcaatgcagcttccccctgacctgcagcctgctgggcagaattgctgatatggcaaatcatttctatgtctgcagtcaggaaaccagagctgttggaaattatctacacacacacatacacacacacacacacacacatacacacacacacacacattatccttttccttcttctaagtaaaaaa

SEQ ID NO: 253919 - DNA, 6799 bp, Homo sapiens
  misc_feature (805)..(805): n is a, c, g, or t
  misc_feature (2200)..(2200): n is a, c, g, or t
  misc_feature (3643)..(3643): n is a, c, g, or t
  misc_feature (6522)..(6522): n is a, c, g, or t
ataagaataaaaattaccccaaatttccaaatcaagaagtaatcatggttcaggtttgggcagatgttctttctaggcatgaacacacgttatctcattgtttacttaacaccgggttataaacatttacccatagcatttgaaaggtagctatagatagaaaagaatcagagaagttctaaaacagctcttgcgctttgtttcaaattctctgcaggaaagatgaggtcttcagccttttttttagctggacggcaccgttgcagcagtggtgaacagggcactggattgagtcaggaaacccagctgtgaccttgggcaagccacttgccctctttgagcttcactcctgctaaggcaaggggcgctattcgtaccctgtctgcccacctcacaggctctggtgaagtccttgatttgaacgcctttagctcccaaggttgtggtttggagatagggcaggtcacatgaccatgaagactgaaggagaaacgtggaagcacgtgtgcctgttgcttcttttccaacttaaaatgcttggtgatctcctgaagactccagcctcctctctgggaagccaggatccacagaccctttacctgcgggtcatgggcagtcccagatggtccccctccccaacagagggggtgcagtgagacctccggaagttactgcctctgttaccctcaaagggattttcagatcagacagcccccctactccaagggacgtgtgtggagcttggtacctttatttatctcctgctccaacccctgtggactgcctgcacccagaatggggcctntcctgctggcaagtggctgagaacctccactccactcagcagggctgttccccatttaccgaaaagctccgagagaaaataactaaccccatggcgccgctgtagctactggcagagcctcctggtccccacctctagcgcctgtggtttttgtttcatgcagagtgagcagtgaatctgggatcccatcagcagtcagtttgggtgcctgcgaggcacaatgatagatgttggtgaagggtatgtgtgaggatattaattaatattaacatgctagttatattaatattctcattggaatttgtggggctttgcaagttatatttcaaatatatggttttatgtaatccttttaactgccctgaaaccttgaaattattgcacctattttatagatggagagactgaggctcagaggggtgaattgcctaagatcctgggggaggaagcacccaggttttctggttttgagtcctgggcccttcctgctgagtagctacccccaacacagacctgcccttggagagcttgcagccacactgggaaggccagtgtattggattgctgcttagacctggaaagcacgtgaataaagcttcaggttaaaaccatgggggttccaggaggcagcagtcggctctgcctgggggtgagctgaggagccggtgctctctggaacaagggtagttgggctgaggctcagtggacagtggaggttggcaggtgaagtgcaggaggtctttgcagggagtgggaccaccttgagcacacacagaggaatgagacaggcaggttactcaaggagcagaggtctcgtgaccacttcccagagcatgtggggtcctagcctcatctccaggaggagaaagtgcatctatacacagatttgtcaatggagtttaaataggatgtgggaaaatctagattttccaaaacagtacatatttgctttgagaagaaaggtagatgcaggatgcataggttagataattttaatagcagtaacctcagagcatgtaagtatgatttgatttactggagtgcctggccgtctcagtcagtgggagcacggcttgggctgggagatgaggttgacaagggttctttctctcaaatgcttcctttggtttgctaagaggtatctcctactcggccgggggcagaagacttttccttcttttcccagtttgcagtagttgggccagatttgtggaagtgggagaaaggcctgccctgcttctacatagagttggctgtcctgacttgatactcggtgtgccttccagagacccgcctccatctcctcaactccctggcttgatgcttaggtggtgatggctgttgggcacaggagttacataacagatctgtgatggacccaggagcagagccagntgagtgaatgtcatggagtgggagtggtcttgcatggctgtggtgtcccctgcagcttgtgcagggtatgtggcaagaggtgctcaccactcatctggaatggctagactggaagcacttggccctcttgggctctgcacccccaccccctcccacctggcctgcctgctcatcttcatgggcgcctggggagaccaattatggctgcttgtcatagtggctcaggtcaccgttcacacttcctgggaccaggacatcagagccctgagaagggtcaaggggccaagtgggcctagccttttactgacagctgggaaatgcaagcgtgtggaccagagcaccaagtgagttggggccggtgtgggttcagcaccgtgtccctacccagagctccatttgttgaaaacagcctttctctaccgtttcttcacttggacaactttaaactatgtattggctggtcgcggtggctcacgcctgtaatcccagcactttgggaggccgaggtgggcaggtaacttgaggtcaggaggtcgagaccagcctggccaacatggtgaaacctcatctctactaaaaatacaaaaattagcccagcgtggtgacacgcacctgtaatcccagctactcgggaggctgaggcagaagaatcgcttgaacttgggaggcaaagattgcagtgagctgagattgcatcaccgcacttcagcctgggagacagagcgagactgcatctcaaaaaacaaacagaaacctacatattttctatatttcccccaacattgaggctcatttcttggatgaacaatttaaatgtactgtgcctctctggcaatattttccaaaattacagatgtttctatactttcaccggcagctctgcctcccagaatttattctacggatgggttaacacgtgtgcaaaatgatttatttgcaaggttcgtcattgttgccttatttttaatagcaaaagattggaggcagcttaaatgttcattcgcaggggccaatgaacaaaccatggcccgtctaaacatgggataccgcgtggccataatacataagatggacgctcaacgcactgtgccggattgagcagcaaggtggattgccgagggaagaagcaggtctgggcggtgtgtctcggagctgccatcagtgtaaaagggaagagaatcaaaagtgtcttgcttgtctatgcccagggggtctctgggcagacaccgcaagtcggtgattgtgatgcctctggagggggtgctggtcatgggagattgcttgtttgctggagatcccatgtaccttttgattgctgaagcaggtgaatgtacgcctttccaagaaattaaaatgggccaggtgcggtggctcacgcctgtaatcccagcagtttgggaggctgatgttggaggatcacttgaggtgaggggttcgagaccngcctggccaacatgatgaaaccccatctccactaaaaatacacaaattagccagacatggtggtacatgcctgtaatcccagctgctctagaggctgaggcaggagaatcatgtgaaccctagaggctgagtttacagtgagccaagatcatgccattgtactccagcctgagctacagagcgagactctgtctcaaataataaaataaaataaattaaaaacataaggactgtaaccttgcctcctgcccagtgtaggaaggtcaaggttctggctacttctcaagtacaggagcctcactcaggccccagaccactaatcaaaaaatatgtgcttggttctcacaaaggggccgagtgtgagggcttgggtgttgcttggtaaatacgacccccggtcccggccttggagagatggagccctctctgggccccttggacacactgctgttggctgactttgtcattttcaacccttgctccgattggctcacgtcatgatttctgaaacctttgggggcttccccactgacagaaagatacactttaactcagcactgggcatcccaggccctctttactgggcctcttcttgagccgcacttggcctgtcaccccttcctctgtctgccctcttaactccccacctccgtgcctttgctcatatagttccctttgcctgcctttccgtccagagcagtctccacgtgcccaggtcctgtctgactttcaagggccagcttagtttccacttctgcactgccttctgacctccctggcttctgtgtaaactgcccagatcaagccacacaatggttcctgcacccaaggaagctccctggggccccctcctggccactcgctcttcgccggtagtcaccactcacaccttggcactttcgcgtggtgcctgccgctgcctgtttgggcctcccacacacagagtgtacagaacggactcctcggtgtctggctgccttcccgcagcactgtcagatcatccaggttgcctgtagtggccctttggtttttttctctgctgcgtaggagttcaccaaatataccactatttattcattctcctgtggacaggcattgggttatgtccagcctcttcggtgaattcattcttgtctttgggggcgcgtgtgcgctctttgctgggtatacacccagggtgggttgatggcttacctgactcagaatgtgtttgcatgaatgaaattcaggttggtatgagaaatctagggtgtcctggctggagccaggcttcttgattacagggacagagcaggtacagggatcctggtttagacagcctgctcccatggggtggtagcattgttggggtgcaggatgctgaatctgcaggggacctatccgctcagtgcccagtgggattttagctggctggaaaggtggtcacatgtagaggggctcaacaatccagctaaagaggctgagcgttggtccattgttctcaatttgagagaaaactgagatcatcaaaattaggactggtatgtactaaaggaaagaacctaattacaaggctgaattgagtaagccctcgctgagggactttggatttctttgttgttcccctttatttctgcacccccacccaagtgacagatatgtacatgattggatgattttgctttcctggttgagagattcctgggaacttggcccaggagaagggggagaaatgtggagccgctagagtggcctccgcttgtttgtgttgattgaaggggagacggaaggagagctgtggacccctgaccccttgtgagggcatgtgatccttttcaaaaggctcaccaggcagaagtgcctggccaggggccgctctttccctctaatcccctctggagaagggccaggctgtgggttgctgacctgctctgatgtggatcagcctcccccaataatgcagctgcccagaagctcagagagcccaggcaacccccaaaggcaggagggccggctgtcattcccgttgtcattcccaggcggctggagtgggagcagagcggtcagttcagatgaacagtgctcgagtctgaccccaaccagcgagttatggtaagatggaaggttctccatctatattaaataagagaacaaaagccctcccaggctgcatgaatattccagggatatatatgtgaacgggttgccagtttagcttggcctgtgggtggcagccgcctgagtgagcacttcgtggctgcagctctaaagggtttggatctgaaactaatgaatgaaaatatgacctcagaagatttaaagagagcaaatacccagcaacagaacctgggtcccagagactgttgggagcatgaaatcccaggctggccgaaggaggaagtgggagagcaatggcagctgacatcacatggtgccagaccttctcagtgctttctgtgttcactcattattccgtccctctctctcagaggcaggtatggctgcttccccattttatagatgaggaagctaaggcaaggagaggttgtgtaacttgctcacagacacaaagctagccagtggcaaagctggaggtcaggtctaggtggtcaggctccagagttctgcggatttcacagcacggcagtggcagtcggaagaaccatttgtcaggtgattgtgggcaaatgacgtcagcccttcaaacctctgttttgcatctgcaagctgcttgctgctgcaacaaattaccagaaacttagtgacttaaaacacaaattaggtcgggtgcggtggctcacatctgtaatcccagcactttgggaggctgaggtgagtggatcacttgaggtcaggagttcgagaccagcctggccaacatgatgaaaccctgtctctancaaaaatataaaaaattagccaggcatttggccgggtgtggtggatcacgcctgtaatcccagaactttgggaggacaaggtgggcggaacacaaggtcaggagttcaagaccagcctgaccaatatggtgaaagcctgtctctactaagaatacaaaattagcaggacgtggtggcacgcgcctgtagtcccagttactgggaggcggaggttgcagtgagccaagatcacgccactgcactccagcctgggtgacagagtgagactccgtctcac

SEQ ID NO: 253920 - DNA, 424 bp, Homo sapiens
ctcactctttaattggcactggcccctaagtttgccaggagctcgctgcccgctcggagcagggtcccggccgggagccgctggtgggggcggggagtccgggagccgcaatccagaagcgtcgtgggccatgtatatttcatcaaacggactttgggtgcgtcgcgtctcactgccatcagtgctatgtgcagtgacatttctgacttgagtggaggaatgcgcgaaggaaacccgggcgaaattggtattagaggatcttcttggcgccaatgctaattgtcctgatttatgccccttctgactaagctcaacgtcttcatctgaaataaaatgaaagcggtgccaagcggcatagaaccgcctggccgctggttctgatccccgggaaccagaaaatcgtcctgcggcttgaaaaaaaaaa

SEQ ID NO: 253921 - DNA, 6900 bp, Homo sapiens
  misc_feature (30)..(30): n is a, c, g, or t
ggggttcggagcgcgaagccgccgctgggncctcggcgcgccccgcgtctgcgcttgctgccgcgccccggtcggcgcgctgggagttccagccatgctcttctggcacacgcagcccgagcactacaaccagcacaactccggcagctacctgcgtgatgtgctcgctctgcccatcttcaagcaggaggaaccccagctgtcccccgagaacgaggcccgcctgccacccctgcaatatgtgttgtgtgctgccacgtccccagccgtgaagctgcatgaagagacgctgacctacctcaaccaaggtcagtcttatgaaatccgactactggagaatcggaagctgggagactttcaagatctgaacacaaaatatgtcaagagcatcatccgtgtggtcttccatgaccgccggctgcagtatacggagcaccagcagctggagggctggcggtggagtcggccaggggaccggatcctggacatcgatattccactgtctgttggtatcttggaccccagggccagcccgacccagctgaatgcagtcgagtttttgtgggaccctgcgaagagagcttctgcattcattcaggtacactgcatcagcacagaattcacccccaggaagcacgggggcgagaagggagtgccctttcgagtccagattgacacgtttaagcagaacgagaatggggagtacacggagcacctgcactcagccagctgccagatcaaggtgttcaagccgaagggagccgatcggaaacagaagactgaccgggagaagatggagaaaagaactgcccaagagaaggagaaataccagccgtcctatgaaaccaccatcctcacagagtgctctccatggcccgacgtggcctaccaggtgaacagcgccccgtccccaagctacaatggttctccaaacagctttggcctcggcgaaggcaacgcctctccgacccacccggtggaggccctgcccgtgggcagtgaccacctgctcccatcagcttcgatccaggatgcccagcagtggcttcaccgcaacaggttctcgcagttctgccggctctttgccagcttctcaggtgctgacttgctgaagatgtcccgagatgatttggtccagatctgtggtcccgcagatgggatccggctcttcaacgccatcaaaggccggaatgtgaggccaaagatgaccatttatgtctgtcaggagctggagcagaatcgagtgcccctgcagcagaagcgggacggcagtggagacagcaacctgtctgtgtaccacgccatcttcctggaagagctgaccaccttggagctgattgagaagattgccaacctgtacagcatctccccccagcacatccaccgagtctaccggcagggccccacgggcatccatgtggtggtgagcaacgagatggtgcagaacttccaagatgaatcctgttttgtcctcagcacaattaaagctgagagcaatgatggctaccacatcatcctgaaatgtggactctgagcagcagtggacctcatacctgtctccagctcccagccctgtggatccccgtggatgtagacattgccccactgtaagctgtggcctcaccaggcaagctgaggccaggagggaccctgcccagtctgtgaaagctacagagcaccaaccagcagaagcctgtggacaccaagtacggtgtacagaaagccagtggctcctttctcccttcctcttggcctccagattttgaatggttccttgttcttttctattggtccaaccctgacgttctaaaagggcaaacagtggagacgtctgctctgaaatccctcatcccttagttggaagctgattgggtatcttggtgctgcctgtattggtcccttctgaccactctcctgcctccagagaaagctctgcttcaccctggaagctggtacctttacctcctcctctgggagttggctgcatggccagcactgccgacttgatgggagcagtttgccctcattctcctgtttcaggtttgcttcccttctcagtgaccctggtgagcatccgcctttcctgttcttggatgaattgatgggagtggggctattctgtgccttctacctctttcttctctacgttgtttctaaggatctgctgctgcggaacccaaagatgtgctcctgtctctgcactggcgcattggcatggtagatgccacaatgtatgtgcacggcctttctcagagacattagttctgaggccctttgtggggaggttagggggatggtaatagaaaaagactattttatttcctggcaatcacgggtaaggaggattaggaatgagtattccattcctaggtgtcatcagatgaccttgaccaccacaataccaggccctcttggatggacttatagaaagttagagaagaccttgttgaaccgctgctaaacttgccacaggagcgatgtgttttctctgagtgcccctcacttacatgtttatctttgtttgtagaggctatgtttaggatattttgcctgcatcagaatgggtgcatcatctttcttaatggcctatcgggaaatttgagtgtcagtaactgtggtagactcagaaattcgtctttgtcttgcctctggttcctgggatccagtgatctctactggcccagggcttcagctcttggttaatttaggttcatggggaaccctctgaccacctgaatgggatgtcatagcttctaaatggagcttctgtggaatgaagtgctagactgaaggactaccagaataaaacagggtctacaatggggagaacttgttttatagatgaggaaaccaaggctcagaggggcaaagtcacctgcatggtagcacatagtgatagggtagcgatataaatttatcatataaaccaggacatctcggaataaaaggggctctgttagtcattatgttgggtaatagccatggcattcctacagaacagagtgaggacaggctcctgattcctcttccttctttagagagaagcggggagtgggttaactaacagctttattgagatgtcattcacatgccattcagtttacccattgctagtgtccaattgtattcacagaaccaccatcaattcacagaattacagtcaacgttggtacattttcatcacccccagtaaaaccccgtacccttggtctgtcactcctgctttcctaactcctgcagtccaaggcagccatgaatctactttctatgtaagattaacctactctggacatttcatatatctggaatcatgtgatatctcttttgtgactggcttcttccactgaatgttttctagggccgtccaagttgaggatgtatcagtacttcattcttttgtattgctgaataatacttcattgtatagatagaccacatttgtttattgattcatcagttgatggacatttgtgtgtttttactttttggctactctgaatgatgctgctatgaacatatttctacaagattttgtgtggacatatgttttcatttcttttagcaatatacataggagtggaattgctaggtcttacagtaactccgtgttttaactttttgagaaactgccagactgttttctatagcagctgtaccattttacattcccaccagcaatgtatccaggtttcaatttgtctacatcctcatcaacacttgctattatctgtctttttgcttttagcatcctaatgagtatgaaatgctatcttgtggttttgatttgcattcccctgatggcaactgatgctgagtgtcttttcctgtgcttacgggccatgcgtatttctttggagaaaggtctatccaggtcctttgcctatttttaattgagttgtcttttttttttaagttttctgttttcctaaccactagactaccagggatgagccttctttttattattgagttgggtgagctatttgtatattctagacgccagtcttttatcaggtatatgactggtaaaaatgttctccccttctgtggattgttttcagtttcttgttggtgtcctttgagacacaaaactttttaactttgatgatttccaagatacgtattttttttctattgtcacttgtgcttttggtgccatatctagaaaaccattgcctaatccaaggtcaagaagattaatgcctgtgttttcttctaagaacttgtatagttttagttctcacaatggtctttgatccatttcgagtatatttttatatatgatgtgatgtaggggtccagcttcattcttttgcttgtggatctccacttgtcccactgctgattattgagaaaaatatcctttctccacggaattgtcttggcatccttgctaaaggcctctgcttcttactggatcttctttcctgggacatggtgtcgttgggaagcttacctttttttttttttacttagtctgtgtttggttccaccagttttatgctgcctttctactctgttcttgctgtctccctctttacctgagtcaacggtactgagtcctatctctctctgatgttccccagtcttccttggtgcatgttctagctccacacactagtccttggaggaaggttgagaccaatgatttcctgttatgagtcatgaggaaactgaatcacctagaagtggaataatgtgctcagggtcaccatagcccattagtggaaggaccaggactagacctttagtcttctgaggtccagccccttaggctgtctgtcatcactgtacccaagtgatgtcactaccaaggccaaatgatggtgggctaaattttaattctcaaaagtgtaggaggctaatattgtcttctaagttccaaaagaagatgtaataaaagtctgttaccttaagtgtgctattagtagagtcttccatttttctggcatgcccctggcatctgctcttcttaccttctcgtggttgtagttaaagcttatagcttatgaaagaatagaaaataataaataccaaaaaaaagtacacatggtaatttggtaccaaaatatctcagctgcctaatttagcagctcatcccttccacaggggtcagatgagctaaagctccaggttttatttttcatttgattgacatacagaaaagccatagcccttcccacagctgtccagggtctttcctgtgagtccggaggtgctggcctattgagcaggacagctcttcccagggcattcccaccaacctgtggcttctgaactgtagcttctttttacagtgaaccccagagggaaataagacagacacatgtgctcaggccaccatcttgaactggaagcccaaagctgagttccttactcttaggtcgtcacggtttttgcggggtatctgcaaggttgagataaaccctttcctgtttaccaggttgtcctttctggatgaagggacagaggctgttgaatggaggaataataggtttgctggaggaggggcatggtatgcctgtggaaaggacaggatggggtggggaggtcgaggctttgacttggggtcctaaacaaaggtcaggtgttgccctagtgacctcttgcccagacagcccagagccccttacacagagctattaacctagggaaggctttaccagcagtggactggagccagccagggtcacaagtttccaagtccagcattgcttcaggggctggcctgagtaactgaagatctgaaaatcattaacaagtcgatgaaataaacggaaaagcctcttaggctgttgtcagtggagcagagggagaaagtccctaggcgctcagagggggtgagaaagcagtggatgattgggcgggggtgggggattagatgttgacactgcctggggtgtaggaagaggaacagagaacccagagtcagggtcctagatcccagaccctcgctcagtatgagtctctttgcctctctgggtctctatctcctcctcttacaaatataggcttggtgatctctgaagatggcaccaacctgccatgaaatgaatctgaggggttttcccatttttccctccatcaaaatcgtacaaaaagctggacgtggtggcccatgcctctaatcctagcattttgggaggccgaggtgggagaatcacttgacgccaagagttcgagaccagcctgggcatcgtagtgagactccatctctgtctttttgaaaataaaaaatctttgaaaattgcacaacaggcaggagacctttacgtgtgcccatcctggttgtacacagtgccaccagtgctcctgcagtgcaaggcggcatgcttcttgacatgggtcagattgtgtccatcgtgtctttgggaatcagccctagctcctaactgggctgactacttcctccgcaaacttatgggggctcccagatattccttgccagccaggggccagacacagtgcaggcacagtctgtgtcattggtgcacatgtgcgtgtttacatgtgtacctgggttccttcccttgcccatgaatttgccatgagcacagccagaagcagcctcagcttggcaaggtgtggagatgactgctgttcccttcgcatttggggaaaacaggctccctcggtagctcgatgatcctcttttgatcttgtgtgacctcctggagagtggatgaagctggtggccttagcttttctagacagtgtaagtggcactgggcaaggcccccagagcagggcaaggtctctagagcgggtctcccacatgactggcttcacacaggcacttccgctcgggttgcatgctctgtgtcatcttaccggtccagggttgcaggtaggaaatgtttgtaccctcttctgattgccacctccttcccatcgcccctt

SEQ ID NO: 253922 - DNA, 6705 bp, Homo sapiens
  misc_feature (30)..(30): n is a, c, g, or t
ggggttcggagcgcgaagccgccgctgggncctcggcgcgccccgcgtctgcgcttgctgccgcgccccggtcggcgcgctgggagttccagccatgctcttctggcacacgcagcccgagcactacaaccagcacaactccggcagctacctgcgtgatgtgctcgctctgcccatcttcaagcaggaggaaccccagctgtcccccgagaacgaggcccgcctgccacccctgcaatatgtgttgtgtgctgccacgtccccagccgtgaagctgcatgaagagacgctgacctacctcaaccaaggtcagtcttatgaaatccgactactggagaatcggaagctgggagactttcaagatctgaacacaaaatatgtcaagagcatcatccgtgtggtcttccatgaccgccggctgcagtatacggagcaccagcagctggagggctggcggtggagtcggccaggggaccggatcctggacatcgatattccactgtctgttggtatcttggaccccagggccagcccgacccagctgaatgcagtcgagtttttgtgggaccctgcgaagagagcttctgcattcattcaggtacactgcatcagcacagaattcacccccaggaagcacgggggcgagaagggagtgccctttcgagtccagattgacacgtttaagcagaacgagaatggggagtacacggagcacctgcactcagccagctgccagatcaaggtgttcaagccgaagggagccgatcggaaacagaagactgaccgggagaagatggagaaaagaactgcccaagagaaggagaaataccagccgtcctatgaaaccaccatcctcacagagtgctctccatggcccgacgtggcctaccaggtgaacagcgccccgtccccaagctacaatggttctccaaacagctttggcctcggcgaaggcaacgcctctccgacccacccggtggaggccctgcccgtgggcagtgaccacctgctcccatcagcttcgatccaggatgcccagcagtggcttcaccgcaacaggttctcgcagttctgccggctctttgccagcttctcaggtgctgacttgctgaagatgtcccgagatgatttggtccagatctgtggtcccgcagatgggatccggctcttcaacgccatcaaaggccggaatgtgaggccaaagatgaccatttatgtctgtcaggagctggagcagaatcgagtgcccctgcagcagaagcgggacggcagtggagacagcaacctgtctgctgagagcaatgatggctaccacatcatcctgaaatgtggactctgagcagcagtggacctcatacctgtctccagctcccagccctgtggatccccgtggatgtagacattgccccactgtaagctgtggcctcaccaggcaagctgaggccaggagggaccctgcccagtctgtgaaagctacagagcaccaaccagcagaagcctgtggacaccaagtacggtgtacagaaagccagtggctcctttctcccttcctcttggcctccagattttgaatggttccttgttcttttctattggtccaaccctgacgttctaaaagggcaaacagtggagacgtctgctctgaaatccctcatcccttagttggaagctgattgggtatcttggtgctgcctgtattggtcccttctgaccactctcctgcctccagagaaagctctgcttcaccctggaagctggtacctttacctcctcctctgggagttggctgcatggccagcactgccgacttgatgggagcagtttgccctcattctcctgtttcaggtttgcttcccttctcagtgaccctggtgagcatccgcctttcctgttcttggatgaattgatgggagtggggctattctgtgccttctacctctttcttctctacgttgtttctaaggatctgctgctgcggaacccaaagatgtgctcctgtctctgcactggcgcattggcatggtagatgccacaatgtatgtgcacggcctttctcagagacattagttctgaggccctttgtggggaggttagggggatggtaatagaaaaagactattttatttcctggcaatcacgggtaaggaggattaggaatgagtattccattcctaggtgtcatcagatgaccttgaccaccacaataccaggccctcttggatggacttatagaaagttagagaagaccttgttgaaccgctgctaaacttgccacaggagcgatgtgttttctctgagtgcccctcacttacatgtttatctttgtttgtagaggctatgtttaggatattttgcctgcatcagaatgggtgcatcatctttcttaatggcctatcgggaaatttgagtgtcagtaactgtggtagactcagaaattcgtctttgtcttgcctctggttcctgggatccagtgatctctactggcccagggcttcagctcttggttaatttaggttcatggggaaccctctgaccacctgaatgggatgtcatagcttctaaatggagcttctgtggaatgaagtgctagactgaaggactaccagaataaaacagggtctacaatggggagaacttgttttatagatgaggaaaccaaggctcagaggggcaaagtcacctgcatggtagcacatagtgatagggtagcgatataaatttatcatataaaccaggacatctcggaataaaaggggctctgttagtcattatgttgggtaatagccatggcattcctacagaacagagtgaggacaggctcctgattcctcttccttctttagagagaagcggggagtgggttaactaacagctttattgagatgtcattcacatgccattcagtttacccattgctagtgtccaattgtattcacagaaccaccatcaattcacagaattacagtcaacgttggtacattttcatcacccccagtaaaaccccgtacccttggtctgtcactcctgctttcctaactcctgcagtccaaggcagccatgaatctactttctatgtaagattaacctactctggacatttcatatatctggaatcatgtgatatctcttttgtgactggcttcttccactgaatgttttctagggccgtccaagttgaggatgtatcagtacttcattcttttgtattgctgaataatacttcattgtatagatagaccacatttgtttattgattcatcagttgatggacatttgtgtgtttttactttttggctactctgaatgatgctgctatgaacatatttctacaagattttgtgtggacatatgttttcatttcttttagcaatatacataggagtggaattgctaggtcttacagtaactccgtgttttaactttttgagaaactgccagactgttttctatagcagctgtaccattttacattcccaccagcaatgtatccaggtttcaatttgtctacatcctcatcaacacttgctattatctgtctttttgcttttagcatcctaatgagtatgaaatgctatcttgtggttttgatttgcattcccctgatggcaactgatgctgagtgtcttttcctgtgcttacgggccatgcgtatttctttggagaaaggtctatccaggtcctttgcctatttttaattgagttgtcttttttttttaagttttctgttttcctaaccactagactaccagggatgagccttctttttattattgagttgggtgagctatttgtatattctagacgccagtcttttatcaggtatatgactggtaaaaatgttctccccttctgtggattgttttcagtttcttgttggtgtcctttgagacacaaaactttttaactttgatgatttccaagatacgtattttttttctattgtcacttgtgcttttggtgccatatctagaaaaccattgcctaatccaaggtcaagaagattaatgcctgtgttttcttctaagaacttgtatagttttagttctcacaatggtctttgatccatttcgagtatatttttatatatgatgtgatgtaggggtccagcttcattcttttgcttgtggatctccacttgtcccactgctgattattgagaaaaatatcctttctccacggaattgtcttggcatccttgctaaaggcctctgcttcttactggatcttctttcctgggacatggtgtcgttgggaagcttacctttttttttttttacttagtctgtgtttggttccaccagttttatgctgcctttctactctgttcttgctgtctccctctttacctgagtcaacggtactgagtcctatctctctctgatgttccccagtcttccttggtgcatgttctagctccacacactagtccttggaggaaggttgagaccaatgatttcctgttatgagtcatgaggaaactgaatcacctagaagtggaataatgtgctcagggtcaccatagcccattagtggaaggaccaggactagacctttagtcttctgaggtccagccccttaggctgtctgtcatcactgtacccaagtgatgtcactaccaaggccaaatgatggtgggctaaattttaattctcaaaagtgtaggaggctaatattgtcttctaagttccaaaagaagatgtaataaaagtctgttaccttaagtgtgctattagtagagtcttccatttttctggcatgcccctggcatctgctcttcttaccttctcgtggttgtagttaaagcttatagcttatgaaagaatagaaaataataaataccaaaaaaaagtacacatggtaatttggtaccaaaatatctcagctgcctaatttagcagctcatcccttccacaggggtcagatgagctaaagctccaggttttatttttcatttgattgacatacagaaaagccatagcccttcccacagctgtccagggtctttcctgtgagtccggaggtgctggcctattgagcaggacagctcttcccagggcattcccaccaacctgtggcttctgaactgtagcttctttttacagtgaaccccagagggaaataagacagacacatgtgctcaggccaccatcttgaactggaagcccaaagctgagttccttactcttaggtcgtcacggtttttgcggggtatctgcaaggttgagataaaccctttcctgtttaccaggttgtcctttctggatgaagggacagaggctgttgaatggaggaataataggtttgctggaggaggggcatggtatgcctgtggaaaggacaggatggggtggggaggtcgaggctttgacttggggtcctaaacaaaggtcaggtgttgccctagtgacctcttgcccagacagcccagagccccttacacagagctattaacctagggaaggctttaccagcagtggactggagccagccagggtcacaagtttccaagtccagcattgcttcaggggctggcctgagtaactgaagatctgaaaatcattaacaagtcgatgaaataaacggaaaagcctcttaggctgttgtcagtggagcagagggagaaagtccctaggcgctcagagggggtgagaaagcagtggatgattgggcgggggtgggggattagatgttgacactgcctggggtgtaggaagaggaacagagaacccagagtcagggtcctagatcccagaccctcgctcagtatgagtctctttgcctctctgggtctctatctcctcctcttacaaatataggcttggtgatctctgaagatggcaccaacctgccatgaaatgaatctgaggggttttcccatttttccctccatcaaaatcgtacaaaaagctggacgtggtggcccatgcctctaatcctagcattttgggaggccgaggtgggagaatcacttgacgccaagagttcgagaccagcctgggcatcgtagtgagactccatctctgtctttttgaaaataaaaaatctttgaaaattgcacaacaggcaggagacctttacgtgtgcccatcctggttgtacacagtgccaccagtgctcctgcagtgcaaggcggcatgcttcttgacatgggtcagattgtgtccatcgtgtctttgggaatcagccctagctcctaactgggctgactacttcctccgcaaacttatgggggctcccagatattccttgccagccaggggccagacacagtgcaggcacagtctgtgtcattggtgcacatgtgcgtgtttacatgtgtacctgggttccttcccttgcccatgaatttgccatgagcacagccagaagcagcctcagcttggcaaggtgtggagatgactgctgttcccttcgcatttggggaaaacaggctccctcggtagctcgatgatcctcttttgatcttgtgtgacctcctggagagtggatgaagctggtggccttagcttttctagacagtgtaagtggcactgggcaaggcccccagagcagggcaaggtctctagagcgggtctcccacatgactggcttcacacaggcacttccgctcgggttgcatgctctgtgtcatcttaccggtccagggttgcaggtaggaaatgtttgtaccctcttctgattgccacctccttcccatcgcccctt

SEQ ID NO: 253923 - DNA, 1110 bp, Homo sapiens
ctcttgtcctgggaggggcagcctgatctcacctccacctagtaccttggggactgaggaccttttggcttctctggagcctgcaagcctcttcccatgtgtccagctgctcttcctgctacaaaggggactgctcacagtggcctcagcttggtggttttgaggggccgcccccggccctccataagggtatcctgggcctgagaattctgcatctgccattggaggatggacagcctcaaatggaaggagtcccacgggagatgggtccgaggtccggctgtggccatccagccccctgtggcttgtccagcctctgtgcacccctggtgtcttcactccaggggcagacagcagccactgcagttcctttcttcgtgagtaacagtagtgatagcagctggggctaacaggctaggctttgtgttctgcgcatttggtcagcttctcactcgatcctccctaaagcaatggggaggcccccactagcccagttttcaggaagtcaactgggaggttagatgggggccagggtcccacagctactgatggcccgagccaggttgagcttcctggtgtccagtccggatcccacttgcagatctcatgctctcagataggtgggacaagttcttttgtcacagtgctggctctgtcctgaggcctcattgctggctgggtgtgctctgctgggaaaagctttgcggggcttgcttggttaaccacagaagagaaggggactgtttggggtgcctctctgcagcctccccgtgctgggtggaagcacggttactgtgttctctaatgttcatgtatttaaaatgatttctttctaaagatgtaacctccacacctttctccagattgggtgactcttttctaaaggtggtgggagtatctgtcggggtggtgtggcccttggatgggtcaggtgggtgtgagaggtcctggggaggtgggcgttgagctcaaagttgtcctactgccatgtttttgtacctgaaataaagcatattttgcacttgttactgtaccatagtgcggacgagaagtctgtatgtgggatctgtgcttgggttagaatgcaaataaaactcacatttgtagaaa

SEQ ID NO: 253924 - DNA, 4226 bp, Homo sapiens
gcagtgcacgctgcatgcttttggtcgatttagaggtatccccgcaacctctgaccacctgaatgggatgtcatagcttctaaatggagcttctgtggaatgaagtgctagactgaaggactaccagaataaaacagggtctacaatggggagaacttgttttatagatgaggaaaccaaggctcagaggggcaaagtcacctgcatggtagcacatagtgatagggtagcgatataaatttatcatataaaccaggacatctcggaataaaaggggctctgttagtcattatgttgggtaatagccatggcattcctacagaacagagtgaggacaggctcctgattcctcttccttctttagagagaagcggggagtgggttaactaacagctttattgagatgtcattcacatgccattcagtttacccattgctagtgtccaattgtattcacagaaccaccatcaattcacagaattacagtcaacgttggtacattttcatcacccccagtaaaaccccgtacccttggtctgtcactcctgctttcctaactcctgcagtccaaggcagccatgaatctactttctatgtaagattaacctactctggacatttcatatatctggaatcatgtgatatctcttttgtgactggcttcttccactgaatgttttctagggccgtccaagttgaggatgtatcagtacttcattcttttgtattgctgaataatacttcattgtatagatagaccacatttgtttattgattcatcagttgatggacatttgtgtgtttttactttttggctactctgaatgatgctgctatgaacatatttctacaagattttgtgtggacatatgttttcatttcttttagcaatatacataggagtggaattgctaggtcttacagtaactccgtgttttaactttttgagaaactgccagactgttttctatagcagctgtaccattttacattcccaccagcaatgtatccaggtttcaatttgtctacatcctcatcaacacttgctattatctgtctttttgcttttagcatcctaatgagtatgaaatgctatcttgtggttttgatttgcattcccctgatggcaactgatgctgagtgtcttttcctgtgcttacgggccatgcgtatttctttggagaaaggtctatccaggtcctttgcctatttttaattgagttgtcttttttttttaagttttctgttttcctaaccactagactaccagggatgagccttctttttattattgagttgggtgagctatttgtatattctagacgccagtcttttatcaggtatatgactggtaaaaatgttctccccttctgtggattgttttcagtttcttgttggtgtcctttgagacacaaaactttttaactttgatgatttccaagatacgtattttttttctattgtcacttgtgcttttggtgccatatctagaaaaccattgcctaatccaaggtcaagaagattaatgcctgtgttttcttctaagaacttgtatagttttagttctcacaatggtctttgatccatttcgagtatatttttatatatgatgtgatgtaggggtccagcttcattcttttgcttgtggatctccacttgtcccactgctgattattgagaaaaatatcctttctccacggaattgtcttggcatccttgctaaaggcctctgcttcttactggatcttctttcctgggacatggtgtcgttgggaagcttacctttttttttttttacttagtctgtgtttggttccaccagttttatgctgcctttctactctgttcttgctgtctccctctttacctgagtcaacggtactgagtcctatctctctctgatgttccccagtcttccttggtgcatgttctagctccacacactagtccttggaggaaggttgagaccaatgatttcctgttatgagtcatgaggaaactgaatcacctagaagtggaataatgtgctcagggtcaccatagcccattagtggaaggaccaggactagacctttagtcttctgaggtccagccccttaggctgtctgtcatcactgtacccaagtgatgtcactaccaaggccaaatgatggtgggctaaattttaattctcaaaagtgtaggaggctaatattgtcttctaagttccaaaagaagatgtaataaaagtctgttaccttaagtgtgctattagtagagtcttccatttttctggcatgcccctggcatctgctcttcttaccttctcgtggttgtagttaaagcttatagcttatgaaagaatagaaaataataaataccaaaaaaaagtacacatggtaatttggtaccaaaatatctcagctgcctaatttagcagctcatcccttccacaggggtcagatgagctaaagctccaggttttatttttcatttgattgacatacagaaaagccatagcccttcccacagctgtccagggtctttcctgtgagtccggaggtgctggcctattgagcaggacagctcttcccagggcattcccaccaacctgtggcttctgaactgtagcttctttttacagtgaaccccagagggaaataagacagacacatgtgctcaggccaccatcttgaactggaagcccaaagctgagttccttactcttaggtcgtcacggtttttgcggggtatctgcaaggttgagataaaccctttcctgtttaccaggttgtcctttctggatgaagggacagaggctgttgaatggaggaataataggtttgctggaggaggggcatggtatgcctgtggaaaggacaggatggggtggggaggtcgaggctttgacttggggtcctaaacaaaggtcaggtgttgccctagtgacctcttgcccagacagcccagagccccttacacagagctattaacctagggaaggctttaccagcagtggactggagccagccagggtcacaagtttccaagtccagcattgcttcaggggctggcctgagtaactgaagatctgaaaatcattaacaagtcgatgaaataaacggaaaagcctcttaggctgttgtcagtggagcagagggagaaagtccctaggcgctcagagggggtgagaaagcagtggatgattgggcgggggtgggggattagatgttgacactgcctggggtgtaggaagaggaacagagaacccagagtcagggtcctagatcccagaccctcgctcagtatgagtctctttgcctctctgggtctctatctcctcctcttacaaatataggcttggtgatctctgaagatggcaccaacctgccatgaaatgaatctgaggggttttcccatttttccctccatcaaaatcgtacaaaaagctggacgtggtggcccatgcctctaatcctagcattttgggaggccgaggtgggagaatcacttgacgccaagagttcgagaccagcctgggcatcgtagtgagactccatctctgtctttttgaaaataaaaaatctttgaaaattgcacaacaggcaggagacctttacgtgtgcccatcctggttgtacacagtgccaccagtgctcctgcagtgcaaggcggcatgcttcttgacatgggtcagattgtgtccatcgtgtctttgggaatcagccctagctcctaactgggctgactacttcctccgcaaacttatgggggctcccagatattccttgccagccaggggccagacacagtgcaggcacagtctgtgtcattggtgcacatgtgcgtgtttacatgtgtacctgggttccttcccttgcccatgaatttgccatgagcacagccagaagcagcctcagcttggcaaggtgtggagatgactgctgttcccttcgcatttggggaaaacaggctccctcggtagctcgatgatcctcttttgatcttgtgtgacctcctggagagtggatgaagctggtggccttagcttttctagacagtgtaagtggcactgggcaaggcccccagagcagggcaaggtctctagagcgggtctcccacatgactggcttcacacaggcacttccgctcgggttgcatgctctgtgtcatcttaccggtccagggttgcaggtaggaaatgtttgtaccctcttctgattgccacctccttcccatcgcccctt

SEQ ID NO: 253925 - DNA, 456 bp, Homo sapiens
  misc_feature (37)..(37): n is a, c, g, or t
  misc_feature (122)..(122): n is a, c, g, or t
acaagattttgtgtggacatatgttttcatttctttnagcaatatacataggagtggaattgctaggtcttacagtaactccgtgttttaactttttgagaaactgccagactgttttctanagcagctgtcccccgagaacgaggcccgcctgccacccctgcaatatgtgttgtgtgctgccacgtccccagccgtgaagctgcatgaagagacgctgacctacctcaaccaaggtcagtcttatgaaatccgactactggagaatcggaagctgggagactttcaagatctgaacacaaaatatgtcaagctcaaagttgtcctactgccatgtttttgtacctgaaataaagcatattttgcacttgttactgtaccatagtgcggacgagaagtctgtatgtgggatctgtgcttgggttagaatgcaaataaaactcacatttgtagaaa

SEQ ID NO: 253926 - DNA, 336 bp, Homo sapiens
ctcagagtccacatttcaggatgatgtggtagccgtcattgctctcagctttaattgtgctgaggacaaaacaggattcatcttggaagttctgccggctctttgccagcttctcaggtgctgacttgctgaagatgtcccgagatgatttggtccagatctgtggtcccgcagatgggatccggctcttcaacgccatcaaaggccggaatgtgaggccaaagatgaccatttatgtctgtcaggagctggagcagaatcgagtgcccctgcagcagaagcgggacggcagtggagacagcaacctgtctgtgtaccacgccatcttcgtaggta

SEQ ID NO: 253927 - DNA, 543 bp, Homo sapiens
ttacaagcaagccccgcaaagcttttcccagcagatctcatgctctcagataggtgggacaagttcttttgtcacagtgctggctctgtcctgaggcctcattgctggctgggtgtgctctgctgggaaaagctttgcggggcttgcttggttaaccacagaagagaaggggactgtttggggtgcctctctgcagcctccccgtgctgggtggaagcacggttactgtgttctctaatgttcatgtatttaaaatgatttctttctaaagatgtaacctccacacctttctccagattgggtgactcttttctaaaggtggtgggagtatctgtcggggtggtgtggcccttggatgggtcaggtgggtgtgagaggtcctggggaggtgggcgttgagctcaaagttgtcctactgccatgtttttgtacctgaaataaagcatattttgcacttgttactgtaccatagtgcggacgagaagtctgtatgtgggatctgtgcttgggttagaatgcaaataaaactcacatttgtagaaa

SEQ ID NO: 253928 - DNA, 6117 bp, Homo sapiens
tttccttcatgtggccctcgtaacctgccttgccgtggctcactgtgggcactgggtaaacgcaggctgcgtttcacagtgctctccatggcccgacgtggcctaccaggtgaacagcgccccgtccccaagctacaatggttctccaaacagctttggcctcggcgaaggcaacgcctctccgacccacccggtggaggccctgcccgtgggcagtgaccacctgctcccatcagcttcgatccaggatgcccagcagtggcttcaccgcaacaggttctcgcagttctgccggctctttgccagcttctcaggtgctgacttgctgaagatgtcccgagatgatttggtccagatctgtggtcccgcagatgggatccggctcttcaacgccatcaaaggccggaatgtgaggccaaagatgaccatttatgtctgtcaggagctggagcagaatcgagtgcccctgcagcagaagcgggacggcagtggagacagcaacctgtctgtgtaccacgccatcttcctggaagagctgaccaccttggagctgattgagaagattgccaacctgtacagcatctccccccagcacatccaccgagtctaccggcagggccccacgggcatccatgtggtggtgagcaacgagatggtgcagaacttccaagatgaatcctgttttgtcctcagcacaattaaagctgagagcaatgatggctaccacatcatcctgaaatgtggactctgagcagcagtggacctcatacctgtctccagctcccagccctgtggatccccgtggatgtagacattgccccactgtaagctgtggcctcaccaggcaagctgaggccaggagggaccctgcccagtctgtgaaagctacagagcaccaaccagcagaagcctgtggacaccaagtacggtgtacagaaagccagtggctcctttctcccttcctcttggcctccagattttgaatggttccttgttcttttctattggtccaaccctgacgttctaaaagggcaaacagtggagacgtctgctctgaaatccctcatcccttagttggaagctgattgggtatcttggtgctgcctgtattggtcccttctgaccactctcctgcctccagagaaagctctgcttcaccctggaagctggtacctttacctcctcctctgggagttggctgcatggccagcactgccgacttgatgggagcagtttgccctcattctcctgtttcaggtttgcttcccttctcagtgaccctggtgagcatccgcctttcctgttcttggatgaattgatgggagtggggctattctgtgccttctacctctttcttctctacgttgtttctaaggatctgctgctgcggaacccaaagatgtgctcctgtctctgcactggcgcattggcatggtagatgccacaatgtatgtgcacggcctttctcagagacattagttctgaggccctttgtggggaggttagggggatggtaatagaaaaagactattttatttcctggcaatcacgggtaaggaggattaggaatgagtattccattcctaggtgtcatcagatgaccttgaccaccacaataccaggccctcttggatggacttatagaaagttagagaagaccttgttgaaccgctgctaaacttgccacaggagcgatgtgttttctctgagtgcccctcacttacatgtttatctttgtttgtagaggctatgtttaggatattttgcctgcatcagaatgggtgcatcatctttcttaatggcctatcgggaaatttgagtgtcagtaactgtggtagactcagaaattcgtctttgtcttgcctctggttcctgggatccagtgatctctactggcccagggcttcagctcttggttaatttaggttcatggggaaccctctgaccacctgaatgggatgtcatagcttctaaatggagcttctgtggaatgaagtgctagactgaaggactaccagaataaaacagggtctacaatggggagaacttgttttatagatgaggaaaccaaggctcagaggggcaaagtcacctgcatggtagcacatagtgatagggtagcgatataaatttatcatataaaccaggacatctcggaataaaaggggctctgttagtcattatgttgggtaatagccatggcattcctacagaacagagtgaggacaggctcctgattcctcttccttctttagagagaagcggggagtgggttaactaacagctttattgagatgtcattcacatgccattcagtttacccattgctagtgtccaattgtattcacagaaccaccatcaattcacagaattacagtcaacgttggtacattttcatcacccccagtaaaaccccgtacccttggtctgtcactcctgctttcctaactcctgcagtccaaggcagccatgaatctactttctatgtaagattaacctactctggacatttcatatatctggaatcatgtgatatctcttttgtgactggcttcttccactgaatgttttctagggccgtccaagttgaggatgtatcagtacttcattcttttgtattgctgaataatacttcattgtatagatagaccacatttgtttattgattcatcagttgatggacatttgtgtgtttttactttttggctactctgaatgatgctgctatgaacatatttctacaagattttgtgtggacatatgttttcatttcttttagcaatatacataggagtggaattgctaggtcttacagtaactccgtgttttaactttttgagaaactgccagactgttttctatagcagctgtaccattttacattcccaccagcaatgtatccaggtttcaatttgtctacatcctcatcaacacttgctattatctgtctttttgcttttagcatcctaatgagtatgaaatgctatcttgtggttttgatttgcattcccctgatggcaactgatgctgagtgtcttttcctgtgcttacgggccatgcgtatttctttggagaaaggtctatccaggtcctttgcctatttttaattgagttgtcttttttttttaagttttctgttttcctaaccactagactaccagggatgagccttctttttattattgagttgggtgagctatttgtatattctagacgccagtcttttatcaggtatatgactggtaaaaatgttctccccttctgtggattgttttcagtttcttgttggtgtcctttgagacacaaaactttttaactttgatgatttccaagatacgtattttttttctattgtcacttgtgcttttggtgccatatctagaaaaccattgcctaatccaaggtcaagaagattaatgcctgtgttttcttctaagaacttgtatagttttagttctcacaatggtctttgatccatttcgagtatatttttatatatgatgtgatgtaggggtccagcttcattcttttgcttgtggatctccacttgtcccactgctgattattgagaaaaatatcctttctccacggaattgtcttggcatccttgctaaaggcctctgcttcttactggatcttctttcctgggacatggtgtcgttgggaagcttacctttttttttttttacttagtctgtgtttggttccaccagttttatgctgcctttctactctgttcttgctgtctccctctttacctgagtcaacggtactgagtcctatctctctctgatgttccccagtcttccttggtgcatgttctagctccacacactagtccttggaggaaggttgagaccaatgatttcctgttatgagtcatgaggaaactgaatcacctagaagtggaataatgtgctcagggtcaccatagcccattagtggaaggaccaggactagacctttagtcttctgaggtccagccccttaggctgtctgtcatcactgtacccaagtgatgtcactaccaaggccaaatgatggtgggctaaattttaattctcaaaagtgtaggaggctaatattgtcttctaagttccaaaagaagatgtaataaaagtctgttaccttaagtgtgctattagtagagtcttccatttttctggcatgcccctggcatctgctcttcttaccttctcgtggttgtagttaaagcttatagcttatgaaagaatagaaaataataaataccaaaaaaaagtacacatggtaatttggtaccaaaatatctcagctgcctaatttagcagctcatcccttccacaggggtcagatgagctaaagctccaggttttatttttcatttgattgacatacagaaaagccatagcccttcccacagctgtccagggtctttcctgtgagtccggaggtgctggcctattgagcaggacagctcttcccagggcattcccaccaacctgtggcttctgaactgtagcttctttttacagtgaaccccagagggaaataagacagacacatgtgctcaggccaccatcttgaactggaagcccaaagctgagttccttactcttaggtcgtcacggtttttgcggggtatctgcaaggttgagataaaccctttcctgtttaccaggttgtcctttctggatgaagggacagaggctgttgaatggaggaataataggtttgctggaggaggggcatggtatgcctgtggaaaggacaggatggggtggggaggtcgaggctttgacttggggtcctaaacaaaggtcaggtgttgccctagtgacctcttgcccagacagcccagagccccttacacagagctattaacctagggaaggctttaccagcagtggactggagccagccagggtcacaagtttccaagtccagcattgcttcaggggctggcctgagtaactgaagatctgaaaatcattaacaagtcgatgaaataaacggaaaagcctcttaggctgttgtcagtggagcagagggagaaagtccctaggcgctcagagggggtgagaaagcagtggatgattgggcgggggtgggggattagatgttgacactgcctggggtgtaggaagaggaacagagaacccagagtcagggtcctagatcccagaccctcgctcagtatgagtctctttgcctctctgggtctctatctcctcctcttacaaatataggcttggtgatctctgaagatggcaccaacctgccatgaaatgaatctgaggggttttcccatttttccctccatcaaaatcgtacaaaaagctggacgtggtggcccatgcctctaatcctagcattttgggaggccgaggtgggagaatcacttgacgccaagagttcgagaccagcctgggcatcgtagtgagactccatctctgtctttttgaaaataaaaaatctttgaaaattgcacaacaggcaggagacctttacgtgtgcccatcctggttgtacacagtgccaccagtgctcctgcagtgcaaggcggcatgcttcttgacatgggtcagattgtgtccatcgtgtctttgggaatcagccctagctcctaactgggctgactacttcctccgcaaacttatgggggctcccagatattccttgccagccaggggccagacacagtgcaggcacagtctgtgtcattggtgcacatgtgcgtgtttacatgtgtacctgggttccttcccttgcccatgaatttgccatgagcacagccagaagcagcctcagcttggcaaggtgtggagatgactgctgttcccttcgcatttggggaaaacaggctccctcggtagctcgatgatcctcttttgatcttgtgtgacctcctggagagtggatgaagctggtggccttagcttttctagacagtgtaagtggcactgggcaaggcccccagagcagggcaaggtctctagagcgggtctcccacatgactggcttcacacaggcacttccgctcgggttgcatgctctgtgtcatcttaccggtccagggttgcaggtaggaaatgtttgtaccctcttctgattgccacctccttcccatcgcccctt

SEQ ID NO: 253929 - DNA, 336 bp, Homo sapiens
catccttgggcctggggctatggtagaaagacctattgttaaaaagacactaaacgaggcagatgtcagggcatgtgagatccctgcttctgccagcacgctttgctgtatgcagccctattttggtggtctttgctgataccctaacagcgtgccttttgggactccccaatactgtggcactgcaccttttttcctgtgaaatacacccagtgtttctctcttgcagctgagagcaatgatggctaccacatcatcctgaaatgtggactctgagcagcagtggacctcatacctgtctccagctcccagccctgtggatccccgtggatgtag

SEQ ID NO: 253930 - DNA, 458 bp, Homo sapiens
gacccgtggcaggttccgagttcctcaggtggggaagcattcaggcagaatgggaggggagataggtgctgtcctgcccctgagttcctccctgcgccctggggccctgggtgaggtgggaagcaggagagggcttgggggctgctgcctgtgttggttttgggctgattggactctgtactctgctcgcagccgaagggagccgatcggaaacagaagactgaccgggagaagatggagaaaagaactgcccaagagaaggagaaataccagccgtcctatgaaaccaccatcctcacagaggtgagccggctgggtgcggggacagagcctccaagggtcttccaccaggagcagggctgctggtttagattcttggaaaatcgcccatctcgggtgactacttctgagagtgcttattctgttgtggtgggttccagtgtctggagctcgtgttc

SEQ ID NO: 253931 - DNA, 358 bp, Homo sapiens
ctgggacgttctgtctccccagggccctgaaatcctccaaacctgaccagtgcccgtttcccaagtatcatgggcagcccccaaccctgccatggcccattaccacaacaggccactgtctggtccctgacagaccagatgggggcagaaagaagaaactcagaggttgaactggacatctaatgagctgctttaggaagcaggggttaggatcactaatgaggaaagaattacaccgtcctgcagcattttcttcctgcccaggatggactgacctccctgtacccaacagaagcagcccagagttgctttacgcagtcactgggatggccctgccctcagctcccatctcctgaaa

SEQ ID NO: 253932 - DNA, 1079 bp, Homo sapiens
taccaaatgcctatacccctgttgtatcttggaagtaactaacttggttttgattttatgggcttataggcagaagagatttgccttgtcttagatgagactgaactgcggactttctgagttaatggtgaaatgagttaagactctgggggactattgagatggatgattgtattttgcagtgtcagaaggacatgacatttgggaggggtcaggggcagaatgatatagtttgaatttgtgccactgcccaaatctcaggttgaattgtaatccccaggaggagtgggctttgctggatccgtcccagaagaaactctacagagatgtgatgtgggaaatcatcaggaacctgatgtctgtagaaatcatatggcagagagactctgtgaatgtaaagatggtcaatgtggagaaactttcagcctgattccagatggtataatgaacaagaacactcttcctggggtaaaaccatgtgaaagcagtgtgtgtggagaaggcaacgtggatcattcatctctgaattgctacatcagagctgacactggacacaaaccgtatgagtgtcaggaacatggagagaagccacataaatgtaagcagtgtgtaaaaaccttcagctgcctccactccttccaaacacatgaaaagcctcacacaggagagaaaccctatgattgtaaggaatgggaaaaaaccttcgattctccccaaaccgttcgaagatacagggtagtgcacagtggagatggaccttataaatgtaagttttgtgggaaagcctttgataatctcagtttatatctcacacatgaaagatctcatactggacagaagccatatgaatgtaatgaatgtgggaaagcctttggttttcccagctcctttcatagacatgaaagaatgcacaccggggagaaaccatatgaatgtaagcaatgtgggaaaacctttagttgttccagttccattaaaaaacatgaaagaatccacactggagagaagccctatgaatgcaagcaatgtgggaaagccttcgcttcttccaattcctttcagtatcatgaaaggactca

SEQ ID NO: 253933 - DNA, 605 bp, Homo sapiens
gtggtgtgttgaatattatagtttcaaaatccttcatgtgtgttaggactcaatgatctttgaggatgtggctgtgaactttacccaggaggagtgggctttgctggatccgtcccagaagaaactctacagagatgtgatgtgggaaatcatcaggaacctgatgtctgtaggaataaaatgggaagaccggaacattgaagatcagtacaaaaattccaggagaaatccaagaaatcatatggcagagagactctgtgaatgtaaagatggtcaatgtggagaaactttcagcctgattccagatggtataatgaacaagaacactcttcctggggtaaaaccatgtgaaagcagtgtgtgtggagaaggcaacgtggatcattcatctctgaattgctacatcagagctgacactggacacaaaccgtatgagtgtcaggaacatggagagaagccacataaatgtaagcagtgtgtaaaaaccttcagctgcctccactccttccaaacacatgaaaagcctcacacaggagagaaaccctatgattgtaaggaatgtgggaaagcctttaattgttccagttcccttagaaaacatgcaa

SEQ ID NO: 253934 - DNA, 809 bp, Homo sapiens
  misc_feature (7)..(7): n is a, c, g, or t
ttttggnggtacccgtcaattcggccattatggccgtgcctagaacagtgcctcacacacagtatgctgcaagaaacacttgctaggacttctaacgccagccaagatggagtaataggaacccagtttaccccactcccaagaacaacagtgatttccatgacactggacatcaggccacaaaggacagtgatccccaagagacaggaaacaaacaaggtgagccccatgactaccccagctcactgccttgaggaaagtttcaagtcatggaacaggagagggaactcggatggaaccaaggcagttaggattcagagagcaggaggcagagaagagagagctggacagagagaactctggagatctggggaaggtttcaagggttcagccgagaactgatcaacacatgcctgtggggagatgacctaagttcaggaaagacgcacctgaatgatttgagggagcagtgacaggagctctccaggaggctagagtagcaggagcactcacaattcacaaagtattgagtagagtacccaaaagtgttctgcctccatgtgaacagcagttaactctagactaaacacagctctggtcctgcctaacaccttaaaaataagacccaaaggaataaactgtttctaagtaactaaactacatcacggaacaaccaaaaatatttacagtaatacaaaaatagcccccagcagggtgaaattcactatgtcaggtacccaattaaaaaattaccaagtttggctgggtgcagtggctcacgcctgtaatcccagcactttgtgaggcca

SEQ ID NO: 253935 - DNA, 396 bp, Homo sapiens
acgtgagactccatctcaaaaaaagaaaaaagaaaaaaaaaacactattgagaaagacagtgtaagcttgtggtacgtaaatactctgtcttttttaaaagttgtgtgtagccgagtgtggtggtgcatgtctgtagtcccagttagtcgggaggccgtggtgggaggattgcttgagcccaggagtttaagaccagcctgggcaacatagtgagacactgtatctacaaaaaatacaaataattatctgggtatggtggtgcatgcctgtagtcacagctactcaggaggccaaggcgagcggattgctggggcctaggagttcgaggcagcagtgagccatgatcctgccactgcactccagcctggctgacacagcaagaccctgtctcttaa

SEQ ID NO: 253936 - DNA, 585 bp, Homo sapiens
ggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcaaaaaaaaaaaaaa

SEQ ID NO: 253937 - DNA, 935 bp, Homo sapiens
ggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcaaaaaaaaaaaaaaaaaaaaaaaaaaaaaaaaaaaaaaaaaaaaaaaaaaaaaaaaggaaaagaacgcacagcaatcgaagagagaaacaagaaagcaagacagatagacggagaccaaaaggaagcaggcaccgcagagcacctaccgagcatcaaacaggcggacgagctgagaccgacaggaacgaagcagcgctgcgtggacgacgagatttagatagcaggaccagcaatgaggataccaggtacaaaagcggatgtaaccgcgaaaatggacaatagaactagtgggggagacaaactacaacaacaggaagtacacgtatagtgtcatggaacaagccctgctgagagaagacaaac

SEQ ID NO: 253938 - DNA, 303 bp, Homo sapiens
gagacactctctctctctctaaaatttaatgaatgaggaaaccgcgaacatatgtccaataaggtgggacttcaccagctgaggtggaggaggtgccttaaccttccggagcctctgtgtaaaatggggataatatacattgtaatggctacttctcaagatggttgtaggattacgtaaggttagaaatatgaaaagagcttataaattgcaaaacattttaccgatgctaatttaatcgctaacactccagagcattttgaaatttctttatagatttggcacagcagcgggtcataggac

SEQ ID NO: 253939 - DNA, 541 bp, Homo sapiens
cgtaaataactcttttaatctactgggagatggtctatgtaagttcacaaagagcacccaacatctagtatagcatctggcatgttaagtattcaaaactggcagtcatttttattttaacagttacactgtcattacttccttggcttctgagatagctctgccatattcatggtgttggagagaaccactagctacctctcccactgcccctcccacatgacagatctcttgatggagagtacaaaggaagaagaactgaggggacaatcagaactcgggacaggacaaggagtagtgacaacaccgaagtaaataataataaagtaaatgtaccatatttggaataatgtcacttcttgacaatgtgtggtttctctgagactgattaaagcctgacttttgggtggctcacatctgtaatcctagcaactcagaaggctgaggcagcaggatcatgaaggccaggagtttgagagcagcctaagcaatacagtgtgacctgctccctaaaaataataataaaaaaaatttaaatctg

SEQ ID NO: 253940 - DNA, 388 bp, Homo sapiens
aggcacccagggctgcatctccaggttttcccaccacttgctgttgttgaaagtatgaaatacataaactgaagaatggtgttcatggatcttataagattaaccaagacattacagacataagagacaacagtgatattctgaaactctaaagccactgatggattcaaagtccagctgagagtattggtgtaggtgaaaggcatggagatttttaatctttcacttcattatggaaaagcacactcaataagagaatggtcacaaaattattgtattaaatgaagtctgttagcaactaagaaactgttgcatttgcacagagacaggggaataaaccaatgaagaaagaaaacagcataaatacagacgtgtatatatgaacaaa

SEQ ID NO: 253941 - DNA, 578 bp, Homo sapiens
gaatgtgaccccatacaccatactggaacttggagtggactgaaatcccattaggattgtggaaaagcttacattaatgttttctaccttctagaaggtgtaagaagtcgaactggagagaagccttttacctgtaatgcatgtaggaagccttacattaattccacagaattttttttacacatgtaaaattacctcagaaccctgggaaggtaaggaatatggtataacctttaaatatttcacatgccataataagtacatgaattctgataatactgtaccgtttcttgagtagtgttagtaccttatactatcaaaataatcctaaatcctccctctcagaccttccatcattactatatttcacttttatgcctataagcacacacaaattagcatatgtaatctaatacattgtagctatttttcagaagttatcagatcaattaagtattagaaaaataaacatttttattttaccttcacttcttccttctatgctcaaagttggatgtaattcttatacttgatcctcaatacttaaagcatttccccccctctggcttctatgaaaa

SEQ ID NO: 253942 - DNA, 464 bp, Homo sapiens
aattacaacagaacccaaagtgtgagataacactgaatcattaaatgggatttaattattctcccaactctcaggaattaagggacttcggaggaaatgcatgttttcacataacaaagcacgtgttcccctcctaattcctccaatctctcaaggcagaaggcaaagggccaagatggcagcacatgtagcacagtggctacaggtatcctatctgtgcaaagggtctaggtgttccactgggtttggagtattcccagcagtcagggtggtagatgtgttcattcagccattcattcactcaacagaaattcatggagtgcctactgctatgtgccaggcattgctcgttctaggccttagggagacaaggtgggcaaggcagacaaaatcccccctcaaatgctgattacactctagtcgtggagactagactaataaacaagtggaatattggacaatga

SEQ ID NO: 253943 - DNA, 472 bp, Homo sapiens
aaaattaaaatcataccaactacattcttggatcacagtgcaataaaaatagaaattgatagcaaaaaaaatctatagtatacaaatacatgaaaattaaacaatttactcctgaataatccctgggtgaacattaaaataaaaaaaattctttgaaattaatgaaaataggtataaaacttatccaaatctctaggatacaactgaagcaatgttaagagggaagtctatagccctaaataccttcattaaaaagttagaaagagttcaaattagcactctaactttgcactgaaaggacctaggaaaaataaaaagaagaaaccaaccccaaaactagcagacataaagaaataactaaaattagagaacaataaaattgacatgcaaaaatatattttaaaaattgatgaaaccaagacttgttttttgaaaaaataagcaaggttgacatactactagctatattagc

SEQ ID NO: 253944 - DNA, 325 bp, Homo sapiens
gagacacagagtctcactctgtcaccaggctggggtgcagtggcgcgatctcagctcattgcaacctctacctcccgggttcaagcaattctcccacctcagcctcccaaagtgctgggattataggcatgaaccactgcatccagccagttcatttattatatatggaacttatatatttggttgggtttatttctggattagagtgttatacaactgtctcatgctttgctgtttttaccagttgtaaatagtagtttattaagtattttagtgcctacttggtgctactgttttaggcagtggaaatacaataaaacataat

SEQ ID NO: 253945 - DNA, 432 bp, Homo sapiens
gagacggggtttcgccgtgttggccaggctggtctcgaactcctgatctcaggtgatccgtccgcctcggcctcccaaagtgctgagattacaggcctgagccaccacgcccggccgagtcttagtttctttatccggaaaggccacttcctcatattcaaggcctctgccaacccagtttttgttttcttctcacagcatgtgagagtctttgtttcacccatacatgttagaattccgtagacaatgtaatcattcaaaaactatttattgaatgcctactgtgtgcctggtactggggatactccaacaatatccctcactcagctcattttccaggggatggaggcatgtaaaaatattatttcaaataatataagtactctaataaaaattagctggcgggggcatgtagaaaagctgttttacaca

SEQ ID NO: 253946 - DNA, 397 bp, Homo sapiens
acagttaataaatgttaaggaacatttgttgtggtctcatccattcagcataggtgtcgaggctgcaacttggcaaccagttgcaaatcttaccttgattgcggtgatgaggtaggtcttggcgtatttattaataggtatctacaggaaacttctctagaattttcaataagaatattcctgtgtgaggagtttgagaccagcctggccaacatggtgaaaccctatgtctactaaaaatacaaaaattagctgggcatggtggtgcgtgcctgtaatcccagctactggggaggctgaggcaggagaatggcttgaacccaggaggcgggggttgcagtgagccgagatcatgccactacactgcagcctgggtgacagatcaagactctgtctc

SEQ ID NO: 253947 - DNA, 414 bp, Homo sapiens
ctggtttgttacagaggtaaacttgtgtcttgggagtttgatgtgcagattatttcatcacccaggtattaagcctagtacccatcaggtatttttcctgatcttctcccttctcctactccctcctcctactccctcccctctgatggacccgtgtctattgttcccctctatgtatccatgtgttcgcatcatttagcttccacttttaagtgagaacatgtggtattttgttttctgttcctgtgtcagtttgctaaggaaatggcctccacctccattcacgtccctataaatcattctattttttatttttttaaaacacataaatttcttacagatacagctctaccttcagatataaaattcaaaaaactttaagccacaagcttataatttcagcatcttctctcc

SEQ ID NO: 253948 - DNA, 610 bp, Homo sapiens
cagtggtcaccaggaatagggattcagaaaggcaaaacataaaaggatggggaaaatcttagtgtgctctattaatatcacacaaagtagacattaaagttgagaaagagtaaagtttaaataataatatggactcacactgctgcctgattccatttctataaagtgctaaatcatattatttagaaattcttacagaagtgacaaaattgtggaaggacaagagggagaaaaggaagtgaggcagttttctaaggtccgaataatgattgtgtttcaggtagaggaagtgggttgtgaacaggcagaggcactcagcaagcttcaggcaatgttctgtttcttaacctgagcagtgattatatgcgtgtttataataattcattaagccatgcaatttttatgtatgtcttttataagaacaaggtttagaaattgacacttgtaacagctacaaaaataaagcttttgcagaaaattataactctatggaaaggtattaaaaagacctaagtggaaaaacatggatagaaagattcaattctgtgaagatatcaattccatccaaattatcatatagatttaatgtaatatacattgaaacccaaac

SEQ ID NO: 253949 - DNA, 603 bp, Homo sapiens
agccgcctgggactgctgccgtccagtacttctcccaggggagccagggaagcatcacagtttatgttgcagaatcctcaaaaatgaagggtgtaacagcaccaaatcgctctggagctggtgaggagtggaagccatcatatggagattggtggcagtggcttgagctttgagcaagaccctgatccactgccctccccttcccaaaatgcagctggtttttaaagtgaagagaggatcttggaaccagggaatgagaagcaaattggacagttctggcgaatactgaagaagagaactgatggtcactgacatatggacccctcactccacccctctttgctcgtcatagcagctgtttggaatgttcctctctcagaatctaatcagctcaagaggagagacccaaagacgctgatattgcagttctcccagtgaggtggcctggcacgttgacttttagcaaatacttatactttgttttatttttctttcttctgtgctggccagaacctctatctactatattgaaaagaagaggtgctatcaaatgccattttcattttgctgattaaaaaaaattcttctaatgtttcataatta

SEQ ID NO: 253950 - DNA, 387 bp, Homo sapiens
actaaaaaagaggtaccagatttaagtgagctcgtttatgtgaaaagggaagaactgaggagaaaggaattcatctcaaattttccctctagacagtttcataatccagattgtagaagtcattacagttcaattaccaaaaaaaaaaaattattcctagcctgctgtatgccaggccccttgccagatgctaaagataaaaaatgagcaagactggctgctcctgggcagcttggacaaatagatgatacagatgaggaaataatgtagtaagtgctacgatgagctatctgtactgagctgagaacacaggtatgggctcaataaaggttgctcccttagctgggtggaggaagcagagagaaccataaagtgtaaaaaagaaaa

SEQ ID NO: 253951 - DNA, 623 bp, Homo sapiens
attctgtgtgttctgccttctagtactagttatctgtgtaacccaacttctctagaactcaattgtctcagttgtttttttctagttccaaaattctacagattttcaaagcataaggatgataatggcacattacttccttcactggaccatttatttcttgagtggaaaggttccaaccaagatattaactccacagagaatagagtacaagttaattttaaatcttttaaaataaatacactctcaagaacataacttgattttagaaaagataacagagtgttttcaattaacaggaatgaccaaggcaaaacgtccatctacttgcatcagaatggagatgcagatgcagataatgaattaaagggactcaaagaaggtcactattctgccttgaatttgttttcatggttctctgagaagtgtctagaggtgagaaagtcaatttaactgattattttctaaaaatagaataaacagaaaattttgtttaaaaaatattttcttagcatagttaagtacaacattttctatagctatccacagtactttaagaaatttacaatgtactgctagaaatttgagtgaaacttaggaattttatgtgctttggatgaaag

SEQ ID NO: 253952 - DNA, 405 bp, Homo sapiens
attttttttttttttttggtttgtgtctttcttatggtttagtcattgtttattcctttatttttccttggttctctaatgaaaaataaaattcaaacttaccttttccactaattcacaacaaattaaatccctaaaacaggataaatagacatgataaaaatattttgtagcatacattttgtacatatagtcttattttctcctcttaattaattgcattaggcaggattatattcagtttatgtgcctatgtactgaggctcagtgaaatacaaaatcttttccaaggttatcaagcaaattagtggtaacaacttcagtgggttgtttcctaactttctcgtaagatttaacagtaaagcacactcagaaattcagagagagccgaggactcacagagaa

SEQ ID NO: 253953 - DNA, 499 bp, Homo sapiens
gcacatccatgtaatagtaccgcggtgaggagcattcaggagtgattctgccgtaatgcttaggtgtgtatctgatttatggaagataggctgtaggctgtataacccgtgtacatatatgttaggggccgaattatgtctccccccaaaaagatagttggaagtcctaacgctgagtaccacagactgtgaccttatttagaaacaaggtcattgcagatgaaattagttaaaatgagatcctgctaaagtagcatgggccccttatccaatactactggtgtccttatgtgaagacagacacacagaaagccatgtgatgatgaaggcagagattggagggatgcagcaaaaattgccaaagattttcagcaaactagcagaagctaagaagagacttcttccccttcagaaggaaggagcatggccttagtaacaccgcgattttggacttctatccccagaatcgtgagaaataaattcgtgttgttttaagcca

SEQ ID NO: 253954 - DNA, 371 bp, Homo sapiens
tcccctgaaaccagaacgcagggcctctttgcgctcggaaacgacgtacaacccagacttccagccttgtctttcagcatcagcactagccgggccgtgctgggggatcacccgatgatcaaccatgtcctctccacagagcacttcagtctggaggcctgagtggctacagatggcacatattaaatacagaaggtttccccttgctccctccacctcccacattcgcaatgtgcagcatgtcccatttccttttgaaacatactaagtaacaacacagcttttattttattttgtttttatttttttcccctgaggtcctggatggactttaacaaagggattttatggtcaaaacctccctttcccca

SEQ ID NO: 253955 - DNA, 434 bp, Homo sapiens
cattctaaagggtcagaaggctcattgtgaaactgaatacaggaggtattttagtgttcttcagtgttcaatactgctttctgtattttaattgccagttagctatcaaatggtcccatctccacatttttcaagatcaagctttcttatttctagctgtcttggtactgtgttctaacctatattcagtttcatacagttgtccttacatagatagtaaagcccctggatttaaagaaaaaaactacattgattctcatatgattctcatctctcaaatgattctgttagtgttcatgtccctcagtattgaacaacagtattgaatactgtagggttttctgtcactaattagaaaacaataggaagagtggctcacgcctgtaatcccagcactttgggaggctgaggcagtcttactgcctgagctcagg

SEQ ID NO: 253956 - DNA, 175 bp, Homo sapiens
gagacggggtttcaccatcttggccaggctggtcttcaactcctgaccttgtgatccacctgcctcggtggaaatggctggctttgattgcctgatggtggagggattcagccaccactctatagtccaccattagaggtgaacagctgctgagagatcaccgtacagatggggt

SEQ ID NO: 253957 - DNA, 434 bp, Homo sapiens
cacattaaattgtggctagcctgtgtgactaaaagaatactgagaaagcgacagtgtttgccttctgaggctgggttatgaaagatattgcagctttctccttgttctctcttggattgcctgttctggagaggaagtcagccaccatgttgtgaggacagccaagcagccctctggagccctataaaaaggtccacatggggaagaactgaggtctcctaccaacagactgcaccagcttaccagatatatgagtgagccatcttggaaggggatccttcatacccatttgagccatcagatggctgcagccctggccaacatcttactgcaaccttgtgagagacttttagccagaccacctaggtaaactactcccaaatttctgacccacagaaactgtaaggtaataaatgttcgttattttttaaacc

SEQ ID NO: 253958 - DNA, 262 bp, Homo sapiens
taatggaaaataaaaagaagatcccaaatgcaagcattccatctgtccctgatacgctgggatttcctgcagtcgtgtttgcttttcaccgtccactgaaagatgtgcataatctgacagccttgtgaaacacaaaggctgcgcgagtgagttttcctcatttacttcaaccaaaacagcatatcacaaaagagagaatgaagaagtaaatacaagaatccagctgtctttattaagccagacattaaagagctttatttgc

SEQ ID NO: 253959 - DNA, 716 bp, Homo sapiens
ggagaattggctgaacctgggaggcggaggttgcagtgagccgagattgcgccactgcactccagcctgggagatggagcgagactccatctcaaaaagaaaggaaaggaaggaaggaaggaaggaaggaaggaaggaaggaaggaaggaaggaaggaaggaaggaaggaaggaaggaaggaaggaaggaagggaaataaacttgcatgcggttaaggcactggattgtgagggctatttgttactgcaaagtaatacaacctatcctgattcaagaatgcagcagaatggagtggagtggattagaaagcattcatcacacatagtgaggctcagcccagggcagcgcacagtgcatcgaccaccctttcctggttccacagacgctgggcatagagccagtcctctaagctttggcctccaccaagagttcaggcttttccagcacaaaagccagagactagcaggttagttttggttgccaccctgcagaattaagcacagtactaaagtgggagttcgcttgctttctctctctctctctctcctcccctccttaattttgagaagtaaggtggaggagggaagagaaataaagagagaaccaatggctaatagcttataaatattatcctgccacatgtgcagaatgctatggaaaggttcagaaggaatgagcacatcccatagaaaaatcaataaaattgttcatgcag

SEQ ID NO: 253960 - DNA, 376 bp, Homo sapiens
ctcagggctgctctgattatggagtagccattcttttatcctttactttcctaattaacttgctttcactttatcctttggactcatcctgaattctttcctgtgtgtgatccaagaaccctctctttcggtctggatcaggaaccctttcctataagaatttgctaaagtgcctactttggtttgtgcagctcacatggaatcaaggtttaaagctgctgccggggctacttgcactcttcttcctgatagggaatgtggactgaacaagctatcactggtggttgcaacagatactattctcagttcctcccagaaattgcaagcctgctgtggtcactttcctgtgtcccctttctaaacatagctcccctta

SEQ ID NO: 253961 - DNA, 442 bp, Homo sapiens
cagaataggagaaaatatttgcaaatcatattgtctgataagggtctaggatccagaatatataaagaactcttacaactcaacagcaaaaggacaaacaacccaagagaaaataggcaaaatacttgaatagacatttctccaaagaagataaagaaatggccagccaggtgcggtggctcacacttgtaatcttagtactttgggaggctgaggtgggcagatcatgaggtcaggagatcgagaccaccctggccaatgtggtgaaaccccgtctctactagaaatacaaaaattagctgggcgtggtggtacgcacctgtagtcccagctactcggggggctgaggcagaagaatcacttgaatctgggaggcggaggttgcagtgagctgagattgtgccattgcactccagcctggcaccagggcaagattctgtct

SEQ ID NO: 253962 - DNA, 684 bp, Homo sapiens
gcggctgcgctgctgggcgggggcgggagctggagccggagctggagccggggccggggcccgggtcagcgcttgagccgggagaagagtttgagatcgtggaccgaagccagctgcccggcccaggcgacctgcggagcgcaacgaggccgcgggcggccgagggctggtcggcgcccatcctgaccctggcacgcagggccaccgggaacctgtcggcgagctgcgggagcgcgctgcgcgcggcgcggggctgggcggcggggacagcggggacggcacggcgcgcgcagttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgcctcaaacatgggctgaaagttaagaagagttttattggccaaaataaatcattctttggtcctttggagctggtggagaaactttgtccagaagcatcagatatagcgacctagcttgtcagaaatcttccagaattaaagacagtgtgggaagaggccgaagcgtggtttatcttgcactcatgcaaaaggaaactggcagattatctgaaagtgcttatagacataaacatctct

SEQ ID NO: 253963 - DNA, 453 bp, Homo sapiens
aacagttcttaaccttcttatttaatcacaagcccctttatgaatcacatgaaaattttgcacctctcctccagaaaaatgttcacacatataaacacacacatggaattttgcatataatcccaaatggttcacaaagaccatttattacaggtttcataaatcagcatctctgaatacctgatttaacctagtcctcttactttacagcttaggaaacaaacctaaagagaggaagtgacttgcccaaattcacagtttgggcatgggcacagtttgagaatggattaaaagtcaagttttgccaccacacccagtcttatacctgtattcaaatttgatatttgccccttgctagtaactatctcctagagtttactgtgagaataaatgaaataatgcatgtaaagataaatgtatgtagtagggatgaaataaatgtcacatctttcc

SEQ ID NO: 253964 - DNA, 357 bp, Homo sapiens
ctgcagtgtaccatgaagatgactggagttctatggcaacaacattgcaagcactgctaaacccactgtggtttcttgcctacattcctagccaaagtcaacactaaatttctgttagaggtgatgaaaataaaagtttatttttccccatctatgctcatatagtcctcccccaaattccatctatggacttttgggagatccatggaccccaggttaggaatgttagaattagatgcattatttctttataggtatagataaggaaaagattagaaggatcaactgatctggccattaactagttcaaatactaaggagtaaaatgaaataaaagttttatgtttttaccagaga

SEQ ID NO: 253965 - DNA, 356 bp, Homo sapiens
cgggaatattgtaaactaaccaagaaccaagagatttgcttggttggggattggcagaagaaccggggtgctcccagcactgctggagtgccgtcagcctggggctggggggatgtggggccacctgagtgcctcctagagaagggcacgggagccttggccgggggtgctgtggctattttttttttttttcctggagatggagtcttgctgttcccaggtggagtgtggtggcacaatctcggctcactgcaacttccgcctcccgggttcaagcgattcttctgcctcagcctcctgagtagctgggattacaggcatgagccaacatgcccagctaattttttgtattttta

SEQ ID NO: 253966 - DNA, 719 bp, Homo sapiens
agcgggcgctggccctctctcctgggacacgcaccgcctccaatcctggtttatgctgggatgtagtcaggcagccctgtgagcaatttttcagattaactcttaagtactccacggctacatgctcctgaagctgtcataggcccagcctcagatctgtgcagggcggatgcacaagagcagaatctccgtggacatctttctggagcatcaattttactgcaagattttgaagaaacacatttaattgattttcaaggtgagaaattaaacctcgaaaactagactggaaagtcatctacgcctgaactatcagactttcttcagaagaaaactctaaggagaacatattttccattattataaatattacaaatgagaaatcatagcaagttacctgaaaatgctgccctggcagtttcctaaatcacaacatgtcctgggtatggttttaggtgtattttctttttggggtgtgttcaccttttggatataaaaattggggtttttgacacatcgttgtaagttttgctgctattattagtttctttacttttgtaccatatttaatttttctgtgtcttcctcttcttctcagactcagtcactccacaagtctctaaaggctctgttcattttcttcaaacatgtttcatgttggatgatttctattgctgtcttctgtttctactctgtggataagctcaagggtgtgtgtg

SEQ ID NO: 253967 - DNA, 599 bp, Homo sapiens
taacatggatggatctcgaagatgttatgttaagtaaattaagtcagtcataaaaggacaaattgtatatggttccacttatatgagaatcatcaaatttgacagaaagtaagatggtggttgccagggtctgggagtagggagggaggaatgatgacttactgttggatacatgattttacttagggagatgaaaaaagttctggagatggatttttgtgatggttgcacaatgatgtcaatgtacttaatgccagcaaactgtacacttaaaaatggttaaaatggaaaacattacattatacacacacagatacacacacacacacacacaacaccacacatgtataatcacaactttttaaaggatttcaatgagatctgtagtacattcacatttggtaatatcttcagaatttttttttttttttttgagagggagtctcctctcctgggttcaagagattctcctgcctcagcctcacaagtagctgggactacaggcacgcaccaccacacccagctaatttttgtatttttagtagagatggggtttcaccatgttgaacaggatggcctcaatctcttgacctcgtgat

SEQ ID NO: 253968 - DNA, 673 bp, Homo sapiens
tcgtctcctaatataatattggcttgctggactttggaacattggctcagtggacacagttttatttttgagcaaccaaatggtaattaacactgacaaaaagcaatgctctgaacttggagctgtgggtgtccaaagaagagggccatggtctggcttttgggaaattataatcaaatggaaattggatttttatttttgttttttaatatttgcttttaaagaattatctgaaacatatttcattgacttatcttttctgaatatgaattttagaacattgatttgtactttttttgctacttacctttttcactaacttcatattgtatttaaaaagaaatattatactgtccaataagtacaaaaatgagtgacactgttcttgctctcgcctagtttgtaatctacagaatttaaaactagctcactcacaattgtaccaaagagtgaaacataacaaccacattaggaaggtggaaagaaagtgacaaaggagcccacaggaaggagttactttttgctgctatggagagaagggtttcatggagaaggcagcattgtaattgggacttgaaggctcacaggttttagataggcagatgctaaagtgtagaacattctagctaaaatccttcagaaaaacaacagcaaaagctaaaagaaatttgtg

SEQ ID NO: 253969 - DNA, 523 bp, Homo sapiens
cagtttaagagcgcaggcattcagctcttacaggattggcttgagaagctaatattatgttgggaaaattatataactagacatcaggacatatggattatagttccagctctgatattcattactaactatgtgaatattgtcatgtcttctgatgcctaatttttctcataggcaaaatgaggaggttagactaagtgatgattaagatcacttataaaatcctagagttcatggaaaacacataccatgactagtcctttcggtcaatttacgagattggttgttgactgtagataaatcccttaattttgttgtctttgtttttcttgcctttcaaatggctttgataattcctggtgcacctaatttatagaaattccgtgaggatttagtgagatattgggaatataagtgctctgaataattaacgcattacatgaacacaagatgatattatttgtactgaaagttaacagaaagatgtcgagtttctcgttacctccttccttccccctcaaaa

SEQ ID NO: 253970 - DNA, 690 bp, Homo sapiens
ttaaaattaacttttgattattatcgaataacttcatccttggtatacaaaaattcaggtttatgtgatttagactaactgtagatttaatttaaattctggggttgctgtgtgtaaatattctctaaccttctcctgtatctgccaatgctttgcatttccaaaagcacttgtgttagcaacttcttcaagttttctattaaagactaataaaattgtgacctatgatttcatttacagttttaaccgaagctaatttttcatctctacactttaagtaatttcacagatgaatttctcttagttttgtttttgaattcttttatgttaacctaagttttttttttcaaagctggagcatatttttattcatcaatttgcagagatataatcttactgtgagaaacttaagttgttttgtgtgttttcaaaaatgttttcccactaaattttcttttgctatattctccctggtatgttattcattgtcagtaattaaaatgctattttgtcctcatcttttctaattatgtgtaaattacagttttcttatattgtcattttaattctatcatctcaaatccaaaatgtcataatgtctagctactttgcaagtatgatattattgaatctcctatgtaaatgtgtaacagcctgaaaaatgtccttcagaatatctttggtaaatag

SEQ ID NO: 253971 - DNA, 294 bp, Homo sapiens
ttcatttatatcctagagaaacattaacacagttggacaatgatgcatatgtaagaatgcttcagtaagcatttaaatttagatttctaatttaaaaaattagaaacgaatatcctcagcacagaaataagtaaaatccccattgtcaagaatatacttttggtgatcatttcttttttaaaaactggcctgtcgagtcaaagggatcatttctataggtcattactagagaagtttctctgaatgtgtaaagaactaaaaaataagaatcaacttaaaaaatgtaaaaaccca

SEQ ID NO: 253972 - DNA, 445 bp, Homo sapiens
gcaaacatgtctgtcctagaacagtgtgcctctgacatcattcaggaaaatggtatgtctttgcagcattgtacatgttatgtggattatctggatgtaggggactgtgtctttgtgcttgtgtgaatgcctgtgcaggtatgtaaataggtacatgtggccgggcgcaggaatcatgcctgtaatcccagcactttgggaagcagaggtgggcggatcaactgaggtaaggagttcgagaccagcctgagcaacatggtgaaaccctgtctccactaaaaatacagaaattagctgggtgtggtggtgggcgcctgtaatctcagctactcaggaggctgaggcaggagaatcacttgaacctgggaggcggaggttgcagtgagctgagatcacgccattgcactccatcctgggcaacagagcgagactctgtctcaaaaaa

SEQ ID NO: 253973 - DNA, 566 bp, Homo sapiens
  misc_feature (493)..(493): n is a, c, g, or t
  misc_feature (522)..(522): n is a, c, g, or t
  misc_feature (553)..(554): n is a, c, g, or t
tagatataatctgcattacttatcactgttgatgttgatcttgatcacctggctgaggtgatgtttgctagatttttttattgcaaaattaattttcgtttccgatctttcatactaccttctttgtaaagaggtcagtttgcagaggacacacttaaggagtgggcaattatgctccttttccatgaggtatcatatctacaataaattatttggaatttttccatagaggggaaatgaaacttgtctcatctctctcatttgtttacttattcaatcatttacttatttcagaatagactcacaggtatatattttatactttgggtaataactctgtactgccttatttattttattgtgaaaattattttatctttggccattgggagctttttcacttggctcttgtgtccctttgacacattcctatcagggtagggttttttttgttgttgttattgttgttttttgtgggttttttttttttttnttttttttttttttttttttttttttttnttttttttttttttttttttttttttttttnntttttttttttt

SEQ ID NO: 253974 - DNA, 305 bp, Homo sapiens
agggtccattctgatctgtatatatgtataatatatattatatatggtcctcagggtccattctgatctgtatatatgtatcatgtaaacatgagttcctgctggcatatctgtctataactgaccaccttagggtccattctgatctgtatacatgtataatatatattatatatggacctcagggtccccgctggcttttccatgacttccttatccagctgtgagaaccctgactcttactactgtattgacttatttgtgaaaccttagtatatataaaagtagtttcaaagttgctaaca

SEQ ID NO: 253975 - DNA, 399 bp, Homo sapiens
tatatacccaattaaaactatagatatatgcagaaaagagaaacaagcacaaaaatctaggcacaagtagacatgagtctatcacggtagctgagattaagaagtcagagagaggggtggaggatctagaaaagcaaaagcaaaaagagacaagaatttcaaacaggaggacacaactagtttcaagtatatcagaggtcaaactagataaggagcagaagcgtccccgagatttggcaattaggtcaccactttgaggtggagtcagagaagagaatggaactaaagattaaagaaataaaaactggcaagtagagtctacttgtcagaaaaacttaagaaatggattcagggtggtagatgttagagagcattttgtatgtttttataatagaatgt

SEQ ID NO: 253976 - DNA, 573 bp, Homo sapiens
gctttgggggatccctggcttctttttatttcttttcattaggaggagctgggggagaacccagtcagccccttttccccaccttctctttcactagaatcacgtcggtatgtccacaagtacccagtgtttagcttccatttataagtgagaacttgcagtatttggttttctgttcctgcattaattcacttaggataatggcctccagctgcatccgtgttgctgcaaaagacatgattttgttcttttttgtgctgcgcagtactccttggtgtatatgtactgcattttctttatccagaccaccattgatgggcaccttagctagattccatgtctttactactgtgaatattgcaatcacatgtgtccttttggtagaaagatttgttttattttggatatatacccagtaatgggattgaaactctatattcaatgacataacatcggtagtttgaaattggccatggtaggagaatttacgtcatggaaatcagcaaaccaggctccacccacacccctgacacctgcacaaaatggcaaaactctatctctacaaaaattaaa

SEQ ID NO: 253977 - DNA, 707 bp, Homo sapiens
gctttgggggatccctggcttctttttatttcttttcattaggaggagctgggggagaacccagtcagccccttttccccaccttctctttcactagaatcacgtcggtatgtccacaagtacccagtgtttagcttccatttataagtgagaacttgcagtatttggttttctgttcctgcattaattcacttaggataatggcctccagctgcatccgtgttgctgcaaaagacatgattttgttcttttttgtgctgcgcagtactccttggtgtatatgtactgcattttctttatccagaccaccattgatgggcaccttagctagattccatgtctttactactgtgaatattgcaatcacatgtgtccttttggtagaaagatttgttttattttggatatatacccagtaatgggattgaaactctatattcaatgacataacatcggtagtttgaaattggccatggtaggagaatttacgtcatggaaatcagcaaaccaggctccacccacacccctgacagccagcagttaaacatttaccatctcatcactagatatataggaaaacttcaagtatttggaaatatacacttctaaataactcacaggtctccaaggcaggcagatcacttgaggccaggagtttgagaccagcctgcacaaaatggcaaaactctatctctacaaaaattaaa

SEQ ID NO: 253978 - DNA, 465 bp, Homo sapiens
tgtgtgtgtgtgtgtgtgtatctaaagtaggcttcacaggtcttctcggctccctcctgaaactctcatgaaataaaggaagaagcgggtataaccccagaaggaaagacagaagtgagaagtgatgatactagatgagagatggtcacatttgagaaagtggaaaggagacagaggggtctgctggagcaaagtcgagaagcaggaagtagactcaaaactcagaaccctaggaagttcaggaaatgaaaggaccacgtaatctggagaccagggcgcaggcacaggatggcgctaagagctcggctggtaatgattttgactaacgagcagtttgagtcccagacgctttcctgcagcagttacctgtgggtaactgtcctccctcactcaggcagatacctcgatatctgctttccaggtatagacccaagtatagggtgagggcaaagtagcaagccgcca

SEQ ID NO: 253979 - DNA, 341 bp, Homo sapiens
aaatctagagtaggtcaattgagcctaggatgtcatccagcaacagaaagcttgtcaaaataggaaccatttccatccctaccactgggcctctatgatggtgccctttgggctgagtcagggtctggaagtacactctgctccttgtctcccttggacactcttgcctgggtagatgtgaatgcaggtcatccatgctggggacacagtgcctggaaattgaattcacacagaaatcatatatcgctccagggtacctggaagttttttcctcaaaaatgtacagaactggtatgacaggataacattcttaattaaacatttttaatgaaactataatt

SEQ ID NO: 253980 - DNA, 431 bp, Homo sapiens
aatgggggactatgtgagctgccacagattttaaagatcagatgagggagttttgacatcagcataaaaggaagtgtgtcctcttatattcctaacgaccaaacaagattagagaaaaaatcttctgtcatagctaagaagaagaagcgcctaggtagatatgatcagaaggataagtggaggaggcagaacttaagctggccttgaaggatagaagttactgaagcagagaggagtggtgaagccaccctaggcagggagaacagtatgtggacaagaaatgtgtgtgttataaaccaggtagttgcaatgggtgtcataatttggtacactgggcatctgcacagaatgctctcttcctggtgggatctccctagagagtcaactcgtttatcatatagctatttggcaagcaaagaaacagaaccaaa

SEQ ID NO: 253981 - DNA, 404 bp, Homo sapiens
  misc_feature (294)..(294): n is a, c, g, or t
  misc_feature (308)..(308): n is a, c, g, or t
ggcagcaggcaagagagcttgtgcaggggaactcccctttaaaaaccatcaggtcttgtgagacttattcagtatcatgagaatagcacagggaagccccaccccacaattcaattaccttcccccaggtctcttctagcacacatgggaattatggaagctataattcaagatggagtttggtggggacacagccaaaccatatcaggcatcacacagagcaacccctgggaggcattgatatccccaggcaaggcccacggcaggccttgagagcatggaacagtggtgctngcatcagtgaatcntactagttgaaataaagaaagccatctttccacccctcacttcatgtaagtctgactccaggtcccatctcattccttggcacaggtggtcttatt

SEQ ID NO: 253982 - DNA, 712 bp, Homo sapiens
cttcaatctcaatagatatttatttattgtcataaatatatgctgttatccagagacaaataataaaggctttttaaagtcaaagatggtcaaaagtcagaatttgaaacacaggtattcctcaaagatattgggagttcagttccagactactgcaataaagcaaattctgaaatgaggcaagtcacacaattttttggtttcctagtgaatattaaatttatagttacattatattgttgtctattaagtgtgcaatagcattatgtctaaaaagtgtacatagctgaactaaaaatactttattgttaaaaaatgtttgcaatcatctgaacctttagtgagtcatagtatttttgctggtggagggtcttgccttgatgtttatggctgctgactcaatgcggtggtggttactgaaggctgtggcaatttcttaagataaaacaacagtgaagtttgccacattgattaactcatcatttcatttcatgaaagatttatctgtagcatgtcatgatgtttgatagcattttgcccacagtaaaacttctttcaaaattggagtcaatcctctcaaaccctgccactgctttatcaatgaacattatgtaatgttctaaatccttcgtggtaatttcaacaatgttcacggcatcttcactagaagtagattctatctcaagaaaccactatctttgcttctccataa

SEQ ID NO: 253983 - DNA, 205 bp, Homo sapiens
cccatgcagacaccaggacctccactggttaggtttaaactcaggacatgttatttagcctctttaattctttgtttcctcatatgtaaaaggaaaatcaaaatagctctccctcaccaggttgttgtgaagattacctgagtggtgatgtctgcctgtgaagttctcagaaccatttctaatgcaccctaaatcctcaaaaaaa

SEQ ID NO: 253984 - DNA, 668 bp, Homo sapiens
gctcactgcaacctttacctcccgtgatcaagcaattctcctgtctcagcctcccaagtagctgggactataggcgcctgccatcacacccagctaattttaatttttgtatttttagtagagacggggtttcaccatattggtcaggctggtctcgaactcttggccttaggtgatccacccactttggccttccaaagtcctgggattacaggcatgagccactgcacccagccatttgctttgttttttaaaatttttatttattttaatatttttagtagagatggggtttcaccatgttggccaggctggtctcgaactcccggtctcaagtgatctgcctgcctctgcctcccaaggtgccaggattacaggagtgagccactgtgcctggccactattttcattattgttcattatacaggcatcttttaacattaggtatctgacttgtctgcatcttttgttctaatattgagctttgctgggggaaaaaaagtttatcagttgcataatttggggaaactttctaaagatacttattaagagagaatttctcttagatattctcactctctctgaagcatctttcttttaattaattaattaattaattaatttttttttttttttttttttttttgagacggagtctcgctctgtcg

SEQ ID NO: 253985 - DNA, 346 bp, Homo sapiens
  misc_feature (338)..(338): n is a, c, g, or t
caggagggccttgatattgacccaaggattagtcaatagaggccaggctgcctcatgacttccgcccttctgcaggcatttcccaagcagtgtttcctaaagggatcttctgaagttgagccatgaattaagcagaactcttccttcccctggccccacagttttggcttctgggttctggacatgggagtcctgacaacacagatgtgtgagaaatacaaagaagaccctcagggcagtgctggaggacaagagtctttcatctagggtccccgtagtctccaggactgtcactactcatgtattgaggatcccagaaattcccgagttagtagtantaatccaa

SEQ ID NO: 253986 - DNA, 455 bp, Homo sapiens
aaaaagatgaagcacagataatggttttattttgtctgaaccaaataggaaatcacgtgctaaaccctttcaatcactttgcaatgtcattaccccactccatcaacactgctcataacctctgacagctacaagaagacctccatgatggcatttatttcagggaaatggatgtatcagctatttgtgtgacctcggagaggaaacatttgcaagctgggaagtgtccacagaagccgttcttcttggtggctgtggaggagtgaagtcgacactttgttgctggaatcggatcctttttgaaaatagatgtatggaagaaaatgccaccccactctctccttaccacctcttctctattcaagttttccctagcatcatgataaacatccctctcgaaaataagcaaacaaagaaatggggctgcgtactccattctggaactttcaaaagcc

SEQ ID NO: 253987 - DNA, 274 bp, Homo sapiens
tcccagctactagggaggctgaggtgggagaatcacctgagcccaaggactcaaggttgaagtaagcaaagatcacaccactacactccagcctatgtgacagagagagaccatgtctcaaaaaaagattcagaaatggccagtaagcacatgaaaagatgctcaacattagttattaaggcacatctcaaaaccacagacagttggtgcgagggttgtgcgttattgttatgctgattaacattgtctcctccacaaccatgcttgataaggg

SEQ ID NO: 253988 - DNA, 645 bp, Homo sapiens
attgtgaggcctcccctgctgtgtggaacagtgagtccattaaacctctttcctttataaatcacccagtctcaagtatgtctttattagcagagtgagagcagactaatacacattctcaacctagggggattttgcccccacacaattggcaatgtctggaaacttttctggttgtgaaactaaggagtggagagggggtgatattggcatcaagtacatagagatcagagatgctgctacacaccctacaatgaacaaaacagcccccacaacagagaaagatccagccctcagatgttacttgtactgatattaagaaatcttgctataaggtctttggagcccatattcagtgacagaggcagccatacagagttcaaaatggaagtgttttcagaaagacacagtcacagttggtctccttacccttccatgaactcaccacatctgctttgttctggttctttcctagctttctttggtccacctcgaaggcccatcccaatgtcatggtcaattgtctttcaaggcccagctcaaatgccccctctctccatttttccccagcaaagtcagggagggcagacctttctggtcctcccattgcaatctctattttgacttggcctgattacttctgcc

SEQ ID NO: 253989 - DNA, 238 bp, Homo sapiens
tccagtccccgcttctccgcagctgggttttttttttctttgcgccaggtgcctcaccttcctctcttgtgccttctgcacggtttggggtacccctagcggcccgaggcacaccctgggctcgaaccatggaatccaggttccaaagggccaagcgcagtggctgatgggaagatactgtcttccttggggacccaggctctgcttctctgtggcgtttttttttttttcttttccc

SEQ ID NO: 253990 - DNA, 462 bp, Homo sapiens
ctatctaaatggatggatctggattcctgtagaaaagatttagaaacataggccaggtcattgtatagggagtaagatgaaggtgaatttgcagctagttgaataattagcaaatgtccaagtgaaagggatacccagagggcattatcctttacccatccttctcaacgtctttatccgtgatgtagatggagatacagaaggcatcctcatcaaattaatggagtcatcaagcaagaaggaatggtcaaactgtgggaagtcagagttaggttgcgaactatctacgcaggtttaataatggtccgaaaacaaaaggggaaattttacaaggatctgatgcatttggagtctacatctaagtaaaacaaaaagaataaagaaaaagaaaagaaaatcaacagcatggttacagagtaaagaagacaggaatttttagccattcatgtgaaaaaaaaaaaa

SEQ ID NO: 253991 - DNA, 499 bp, Homo sapiens
ctatctaaatggatggatctggattcctgtagaaaagatttagaaacataggccaggtcattgtatagggagtaagatgaaggtgaatttgcagctagttgaataattagcaaatgtccaagtgaaagggatacccagagggcattatcctttacccatccttctcaacgtctttatccgtgatgtagatggagatacagaaggcatcctcatcaaattaatggagtcatcaagcaagaaggaatggtcaaactgtgggaagtcagagttaggttgcgaactatctacgcaggtttaataatggtccgaaaacaaaaggggaaattttacaaggatctgatgcatttggagtctacatctaagtaaaacaaaaagaataaagaaaaagaaaagaaaatcaacagcatggttacagagtgctgggattattggtgtgagctaccgtgcttggccagaatgtattctttatccctgatctaggcaataggtgtttaaaaaa

SEQ ID NO: 253992 - DNA, 430 bp, Homo sapiens
aaggtttatgtttatcatttacatgagcacaatctttttaaaatgtatatgcacccaatctcactaataccttctactcttcatttatattgaaagccctcctaaagtaaggcttactgattcacaaattagagtttaaacacttctggctgggaacagtggctcacacctgtaatcctagtactttgggaggtcaaggcaggcagattacttgaggtcaggggtccgagaccagcctggccaatatggcggaaccctgtctctactaaaactacaaaaactggccagggatggtggcgcacacctgtcatcccggcttctcaggaggctgaggcaggagaatcgcttgaaccggggacgcaaatgttgcagtgagccaagattgtaccactgcgctccagcctggacaacagagcgagactccatctca

SEQ ID NO: 253993 - DNA, 565 bp, Homo sapiens
agttctttattgcaaacttcttgtttgtatgtgaaatcttatgccatccttatatttagtgctctgtatgtaacatgttctttccctttttattccttttaggatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactggggcgtttaaagttttgatgccgatggtgtttttatgttttcaagtcatttgttactgtgtgtttcatttatgttagtttcaacttctattccttctagttcaataatcttctcttctgcaatgtttaatccactgccttcttccatttcagactgtaaatcatactttttatctacagaatttgatatttaaaaaatcttcaacctccccatttaattaaaatacaattatactaactgctctaa

SEQ ID NO: 253994 - DNA, 687 bp, Homo sapiens
gttttcttactagagtgctacaggagaaactgtgtaccaatgctaattcatccttgtaaaaaggaaccaaagatgtcagtcttaatcctttgtttacaaatagtcattaattactgctctatgtaagggaatgattttcttttatccatcaggaaacagaaaggaaacgatggctcagtctttgttccttatgaattaattacaacattgcatcaatgagcaaaagagaaaacactattgttataaattgtcctcgtctctccagtctcttgaatatacatattttttgcatttcctttctctgccatcaagttttccctttgtgaaaaaatttcctctagatacaaatttccttctaggtatcttcatatttttctcctttcattcacaaatgaatgtcctatatctattccctctaattccttaccatactatatatttataacaagcatcctcccaagacacacacaaatgaagaattaatcaaactctataatctaactttgggtctttacctagaacttgggaaatacattttctctcaacattgttcttgcgagtgttgtcttggaatgccaatttcctcttgtttgctacttctgcgaacccaatcaaaacttgtctgtgggtggggagattcggcccatgggtaccatgttgctgtcttgttctaaactggtagctttt

SEQ ID NO: 253995 - DNA, 523 bp, Homo sapiens
ttttacgtaagagcagaggaaaaactgtgtgagtttaagtagttgactcacaaaccctaatcttaatttaggttccagaatggcccaaggcaaaggttttaaatagtccttctccatctgccctagagggtttatttgttatcacaggggttgttagaaggaaattttctttgaagaaatgagtgatgctaaggcatgtagttggctgaagagacttccactggcacctcctcccttgatctggcaaacccagcagctgaccacctttggagtgacagaatctctctctctttatggatagaattctgtcctatggtccccacctaatggagagccacctatgtcatctctgtcacctactctgatgttaaaattttgttgtgaccacaacaaagtaaatatttcctgcaagatgctttccaaagtacctaaaaagacaagagaatgagaggaggaggttgcatggctatttttgtacttacctcccaataaatgttcgtgtgtatgaggcagaatttggtct

SEQ ID NO: 253996 - DNA, 903 bp, Homo sapiens
tagtagagatggggtttcaccacgttggccaggctggtctcgaactcctgacctcaggtgatccgcccgcctcggcctcccaaagtgctgggattacaggcatgagccaccgtgcccggccttttacagataattttaagtcaaactttgcatagttttccaagttgagttaaaattctctatgaaaataatttatctatcatttaccaaatgtaatactgaaaatatgtgaaagatactgattcacagattcaacaaacccaaagaatcccaagcatcataaatacgaagaaatactcaactagattcatctcagtgaagttgtcaaaaatagagatcataaaattagcatagaaagcagcaaaaattagatactttctcgtccatgtggtaatgtattagaacttaattcctttttatggctgaataatactccattgtatgtatatactacattttgtttatccattcatctgttttttggacacttggattgtttccatttttggctatgtgaataatgccactctgaaaattcatatacaagtatctgctttcagtttcttttgaaaacctgcttatttttgacatatcttttgtttataagcacaaatctatttagaataaagccagtggatattttatttccacaatcctttcataaatactgtaagctcttactctgagccatcaatagttaccaagagcactatataataatcagaagcagcagccagcagttatctactgacaaactcgttttttattttattttattttttgagacggaatcttgccctgtcttccaggctggagtgcaatggcatgatcttggctcaccgcaacctctgcctcccgggctcaaattattctcctgcctcagccttccgagtggctgggatt

SEQ ID NO: 253997 - DNA, 684 bp, Homo sapiens
atactttttctggttgagtcagattcaagaaaagaaacaatttaagcagtaagggattcagtactgactctaccaacatttatttttgcttattcaatgcacaaaaagaatgatgagaaatcatttctctctagtttaatgttatttcccattttttatttcgatatatattccaacctgttaactttatttcttctttcctgtgatgatctcccccattccctcttctgcagcattttctcttcttgttattcaattaacaagagaccctaggataacaacctttcttctttacagactaattgttcttttttcttagacataaaaaactagatgggcatacaaatatacatcaattgagttgtgaaggttaaaaacgattcacttttcttttcatcttttcttcattttcctcatgctttttttctattcatgttttcaatgcccatcttcaattttacttatctttctgttctttagagataattagcagtgtgtcactttttacactcaatctccaaggcagaatctacttcataattagtttgaatagttatgccaacctgagcagtccttggcagcagtttagttaggtactagaagcatatggtaaggattttgttcagtatatagcagaatcaatatgaagttgagttaaatttatttattgtaacaacacctgaa

SEQ ID NO: 253998 - DNA, 765 bp, Homo sapiens
attctactcttcaggctcctgattaagcatccttccacagtaacttcatctgacatccccctgcatagtaaaactttgccctttggctatatttaacacattacttaatgttttatattgctttcccagacttaagaattaacaaaagtatattaccaaaaagcactatatatagtactatatagagagtaatacaaagtactgtatgtaatctactagatatatgaaatcttttcatatagctacatatattaataatcacgatgatatacatcaaaacatcaatagtgttcacatctgaattgtgtggttcaaggtatgtgtgtgtcttctaatgccttataaaatgaatatatttctccttttgaaagtagtatgaagtatttttattgatgactgactaatataacattatatcccacttgtggacaggatgcataatatatgcatttatacctttgcaacattttgcaatgatagaaacatagaggacatagatgctctcagtaagaagtctgagttgtctagaatggaatggagcagaaacaaatcattttatcattatctatgtccaaactggccaaacagtatcctcatcagcacctcactatgaaatctgccattttaagacattaaactggtggttttcgcctgggagaagcactgcccgctcctgcaggggtagttttgaaatgttttagatcatgtttttgtatcgtctaataacaaggtaaggcaaaatggtatttagtgagtgctggccag

SEQ ID NO: 253999 - DNA, 439 bp, Homo sapiens
agtggtgagagtgggcatccttatcgtgttccagttctcaaggagaacagttccagcttttgtttcttcaggatgatgttgtctctgtgtttgtcatagatggctcttattattttgaggtgctggtattcctttgactgtggtataagttctgtgtagtcagttgggttcatttccagatactttaagatggccaaagccctgtagaagatctttatttcccggtcaatccttgctcctggtttcccaggcattgtggagacaaagttgaataaacatggaaattttacaatacgtttaaaattcagtagatcaaaaataagatttaaacatctgttggagatgattattcaacaaacttcaaggtagatttcatcaaaattacgtaaatacaacaaaagaaagtgacatatataaatgatattaacacatcatgctt

SEQ ID NO: 254000 - DNA, 493 bp, Homo sapiens
ttttttttgagacagagtctcgctcttgtcacccaggctggagtgcagtggcacgatctgggctcactgcaacctctgcctcctgggttcaaaccattctcctgcctcagcctcccgagtagctaggattacaggcaaccgacaccacgcccggctaaattttgtatttttagtagagacggggttttgccatgttggccaggctggtctccatctgttgacctcgtgatggtctgtatacataggcagtgctatgtatgcagactactgtatatgactgctaactaggtctagacgaaaatatgagtctataaattctttgttaattggacattttaaattatttttccaattacagtggtggatttgcacagattattttattctctttttaggccccattttgctcaagaaaagacccttgtcaagcagttggctggggtcaggggtgcatgttatgattaaggaaactagtagagataaatgagccaca

SEQ ID NO: 254001 - DNA, 460 bp, Homo sapiens
gtaaagcataaataaaaagggcaagtatttagtcattataacttgacctcttgtccaaggcaattcttggcttcagagagaactagttcccctgaacttttaaggaaaaacagtatctttgcatagcctcaaaacattatttactgtcattgtttttaacacatgcccagaaattcctccttccatggatgaagcttactcgcatcgtcttgagtgtgagcaggacttagtgactcgctgctagtgaacaataaatggaaagggaaaaacagggagtttacagggagaaacctgacggaggtttctaagtggtaactaagagtaactaagtgatcagagttaacatcatcagcagtaagtcctataaatattttgtgtccactgacatgatccaacaagaaaggtacatcatcttagggtattctcccccagaatccataatctcagcctcatcatgaaa

SEQ ID NO: 254002 - DNA, 174 bp, Homo sapiens
agccggtaccatcctccatgctccctccatatgcatgaaagacaacagactatttcctgtactaatacagccagtgattgtctccaacattccagagttgaccattttatacataagtaaacgtgtcttaggatcaactgctttttctgctgtagaatgctcctttttctcatg

SEQ ID NO: 254003 - DNA, 493 bp, Homo sapiens
cctagttctgtgataaacctatatttgtgttcccttaaccttctaactcacaggttggcaaacattagcctgagtgccttttctgtaaataaagttttattggaacacagccacacctattcaccagcagaattgagtagttgctacaaagagtatatggcccacaaaactgaaaatatttattatctggccctttatagaaaaagttggctgtttttcacaaataccacagacacacgattctgtctagcaaactcctaggcagctacaaggcctaactagagtattctttctcccttccaagtattaatcaggcccagccctgcttagcttccaaaatcagacaatattgggcatgttcagggtggtatggctgtacactagagtattctttctcctgagagaccttctagtagctacccaagcccaaggcaaagctaaccacatcctcctcgggacctccaaggggctcttaatagccaaaaaaaaaaaa

SEQ ID NO: 254004 - DNA, 505 bp, Homo sapiens
cattataaaaatttatttactatgtagctttatttgacaaaagcatctttcacattatcaatcatgaattataaatttgattcttcatgcttacgagcagatatagtactactgtaaaatctagtaggaacaatatagtaaccatggagtgaaagactcaatttttaggtcctttaggtagctctttaagtacttaggtttttaagtgcaaaatcatttttattaactatgttactgtattagaatgatatatagtgagataaagacaaatttgaagattgagggatgtcagtacgctttgacgtataagttgactcctatgaaagtgattagtttggctttccctctgtagctttctcacctccacatctcaaggataaataaagtacaaccaggcgttttccattttttcccccagttctcagtggagtatatagcacacagttggtgtttagcaagtgtggaaaaaaggattacttaataactttataatgagtgttatatt

SEQ ID NO: 254005 - DNA, 533 bp, Homo sapiens
gtcccttcccccgctggggcgacgggctccggtccagccggctcctctcggattgaaattctccggacttcaaaagctcccagcttggcttccgccggggctgggctggcctggcccgggccggaggggggtgggtgggaaccccggggaggcgacggagataagatgcgcgggtcgttttaaatggaatcggaagccgggcctaggcccccagacgcgcgggtcagctggaacagcttcgctcctgaagaaaaccgggctcggaaaagcggcgcgtgtggggcctgcctccgcagtctgcccgcccggctcgggggagatggcccgcggccccgatcaccctccccagcctgcagcgggcctttcaacggcgacagggccccgagaagggagagagcgaggagtcctgagccgggggccaggagctggcttgtcggctcaggtgtcggtgaaaatgtgatcaggaaaaaaatgttttcgcttctctttggttaaaaagtaagaacaaagggagcttccttctaaacaataaa

SEQ ID NO: 254006 - DNA, 431 bp, Homo sapiens
agtggggaaaagatgagggaagattgattctctctggctgcctgtgtcaccctcagtgacatgcaatccagccacttacagttgactttttcagctgaatgttttcgtttcatgaaagtcttttaaaaattccccctaagttatgcagcacatatagtgacttgaagaggggaaaaatacacccaacagtttaaacaaccctgaatgctggctggaaaagtagcaccagaaagatggcaatgcaaactagactaagcgacctcatggcactgctttgttcctggatgattaagatgcccaggaagaggggggagaaagcccactgcatcgagtgactttgggtctattatgccttctgcgccatgtttatcttttgatcttaaagatactgaaactgacaggtaattaaagagctgttactgttatgccct

SEQ ID NO: 254007 - DNA, 565 bp, Homo sapiens
tattataaattatgagttactgtcaaaataactcaaagcattgttttaatatagtttatcctaagaccattagaacaattctgaaaattaatggagtttattttggtatgattaccctacaacagtaattcttaactggagtgattttgcctcccaggagacatttggtaacatggagacaatttttggctgtcactatttggaaggggtactataggtatcttgcaggtagaagtcagggatgcggccgggcgcggtggctcacgcctgtaatccagcactttgggaggccgaggtgggcggatcacgaggccaggagatcaagaccgtcctggctaacacggtgaaaaacccatctctactaaaaatacaaaaaataaaataaaataaaataaaataaaataaaataaaataattagccgggcgtggtggcaggcacctgtagctccagctactcaggaggctgaggcaggagaatggcgtgaacccaggaggcggagcttgcagtgagccgagacagcgccactgcactccagcctgggcgacagagcgagactccgtctca

SEQ ID NO: 254008 - DNA, 294 bp, Homo sapiens
cagaagcaccagagcacgtgatttatttctggtcataaaggaatcaattactgtaccaggataaagcagcgattttttttttctactctgcttttgcaatcttctttcttctccgtttctatttcactctcatttagctataactgaggagtactcagtccactcttccccattcattttccatcatgtcattttattttgcattgagaactcaaatccttgtttacatgtaaataactcactgttcttcatgcttatttaaaaacaaataaaaagagaccactaattatcaaa

SEQ ID NO: 254009 - DNA, 434 bp, Homo sapiens
aggaaggcagggttactattccacacattatctaggtcatcaaaagcccctggcccaagagtattttatttccttgggaaataaaacagtcatttattaaaggaatatgttgagaactagataaatgattaaaaccaattataaggctgggcgtggtggctcacgcctgtaatcttaacagttttgggaggccgaggtgggcagatctcttgaggccaggagttcaagaccagtttggcctacatagtgaaaccccgtctgtactaaaaatataaaaattagccaggcatggtggcacacacctgtaatcccagccacttgggaggctgaggcaggaaaatcccttgaacctgggaggtagaggttgcagtgagctgagattgcactactgtactcaagcctgggcgacacagcaagaccctgtctcaaaaaaa

SEQ ID NO: 254010 - DNA, 464 bp, Homo sapiens
ttgggtttatctattgggacttcagaaagtaagcatgttgggagttgctaatgtcaattagccaaatctgaaggattgatgattatctattctaacaaagaatctccccaagaccttaattaacagcacagaaagtatgggaatttttaccacccccgaaacgtgctacaacagttttacaatcttacctttgttttgacagtgagattatttaagagttggcagaaatgttcgacttctggcaaatgcatagtgtcttctttgaatacagttaattcctcctcagctaagatgctttctgaaataatcatgcagacctaaagaccaggtttccttaacttttatcaaccccaagcacaaagcaggtaacatgtagatatagaacagaagatgttgatgaagccgaatgtttttataaaatcccagcattcacacacaaaaattattttcatgattttaatata

SEQ ID NO: 254011 - DNA, 116 bp, Homo sapiens
ccatcctggctaacatggtgaaacctcgtctctactaaaaatacaaaaaattagactccaccgccccccgcaaaaaaaaaaagattctgctgttttttggtcaccattactatttc

SEQ ID NO: 254012 - DNA, 507 bp, Homo sapiens
ggaccaggtgaagggcaggagctggcccaggggacagtgtcctaagtggagggatttgccactgcgtgaagagcttgatgggcctgcggagtgtcatctagctaggcacctttttccctgttaatgctggctttagttatagtcatttgtaatgtgtagattttcagtgtcttaacttttcaacagggtaaataggaccatccggagtacaccaatattgagctttgtgataccttttggtcgatttgttgatcagttatgcttcattgtccatgaacatttcagaaaaaaaagaaaaaaggaaaaaaagaaatggaaaattcaggctacttaaatcacgcctttgaaacctagaaacccttaggggcacagacccttcttgtgtaataacagagctctattttctgctgggaagttccctattgagatttgggacacttcctaattttttctgggtaaaataaaagtgacaacttttttttctaatgacttggtaccgagctcgat

SEQ ID NO: 254013 - DNA, 354 bp, Homo sapiens
gggccagcatctcaccctgtcactcaggctagagtgcagtggtgggatcatgattcattgcagcctcaccctcctgagtagctgggaccacagctgtgcactatcaagcccagcttaaaaatttttcgtagagatgggttctttccatgttgcccaggcttcagtgcctgaccaggcttcagtgcctgaccaggcttcagtgcctgaccaggcttcagtgcctgaccaggcttcagtgcctgaccaggcttcagtgcctgaccaggcttcagtgcctgaccaggcttcagtgcctgaccaggcttcagtgcctgaccaggcttcagttgcctgaccaggcttcagtgcctgacc

SEQ ID NO: 254014 - DNA, 216 bp, Homo sapiens
gggccagcatctcaccctgtcactcaggctagagtgcagtggtgggatcatgattcattgcagcctcaccctcctgagtagctgggaccacagctgtgcactatcaagcccagcttaaaaatttttcgtagagatgggttctttccatgttgcccaggctggtctcgaacacgtggactcgagcgatcatcatgcctcggcctctcagagtgctgg

SEQ ID NO: 254015 - DNA, 468 bp, Homo sapiens
caaacttgaagacaaagacatataatctatccaaattgaatgatacaaaaataaaagcaaaaacagcaccagtaacttcagttttttaaaaatttgaatatttttcttgtgtgggtcagattttcctgcttctttgcatgcctaataatttttcattatataactgaatttcagaattttatgttgttggttgctgaatgctgttgcaatatcaagtttcagcaaatgtgtaattagagcctcagaggagaggatattgtggtgaagtcagaaaaatatttgaaaaaaagtggctgaagattttacaaattttatggaagccataatttatggatccaagagtcttaaggacccctaagcaaaataaaactaaataaaattataagacacatcatagtcaaattgctaaaaaccagatataaagaaaaaatcttaaaagcatccaggaaaaagagacaaatgacatac

SEQ ID NO: 254016 - DNA, 328 bp, Homo sapiens
ggaaatctctgcctgtccatctgggatcatttcctttttgtctgaagtttatcctttagcacaggagtcagcaagctacggtccacaggccaaatgcacccacggcctatttttgtgaataaagtttcacaaaaattcgaatactgccaggctcgttcatttacatattgttgtggttgcttttgccccacaatagagttgggtggtttgtgagggatcccatactgtgtggcctacaacactcaaatatttactatctgactttttttttttttttttaacgcaggttttcaccatgttggccaggctggtctcaaacctgcgttaa

SEQ ID NO: 254017 - DNA, 406 bp, Homo sapiens
cagtagaaacttaagttcctgttttcttttattttatttggagttttattgttttgttttattttcttgtttgcagtctctcttaaaataagagagagctgaacaaacatctaaaggtttttttctgtaaacttttcatgaacaaccgtcgtgaatcatctactctgcaaaacttttgggcctttcaagtttcatcttattcaagtataaaaattaattccattgaaggtggcttcagaagagcaattttattcactgaagttgaaaaagggatattttgccaggtctagtggctcacacctgttatccaagcactttgggagactgaggagggaggatcacctgaggtcaggagtttgagaccagcctggctaacgtggcgaaaccctgtctctactaaaaatac

SEQ ID NO: 254018 - DNA, 503 bp, Homo sapiens
  misc_feature (484)..(487): n is a, c, g, or t
  misc_feature (489)..(489): n is a, c, g, or t
caagaaaggacagagtgatccagtaggggtctttaggtataaagttctaaaacttatcttctgcatccactggtgaaaagagacaataagtataaattatagcaagaataatttcctgacatcttcaaggccctggtaagggttagccagtgagaatgtgaaatagtctcttcttgagatctttcaaagcaagtcatggttatccacttgtagagatgatcctcatgtagtactatccagagcccaagctatagagtaaactgggactcctttccaacagcattgttctttgtgatatatcttcttgtgatatatgaaagaataaatgtatatctatacaaatatgacattgagttggaaaaaagacacgtgactgagctaaagtgttggcttcattggctgccaagattttttttttcaaactagttagtatctgtccacaaagtgctgggattacagatgtgagccactgcactccgcctcnnnnangcattaaaaaaaaa

SEQ ID NO: 254019 - DNA, 1002 bp, Homo sapiens
tggtgcaatgttataaactttatttgtggaatgtgctagacaggaactcagattttctgacacctactctgatggtgtctctaaaataatctttctaactttatagtttatcaagggtaaccccattctatcacatgccttttgagaatttgggttcaatatttggagtactctggactcatcagacatctttaataaattgtaatacattgccactgtcattcaaggtcctatgtgtgtctttttgcctattcataccaaaaatatcttttgatccctgactctgggtcgggcatagtattaagggcaggggacacaaagatgtatgagagcacattttctgtgaataaaaagctcagagtttggagttctgtatgtagcatattcaaatggaaggccttctatgcaataaaggctaaataatacatcaacttggtggcattttatttagataaggtgcaaacattattgtacatatgccccccgcccccaccaccccattgtatcctatagcacagttgaactggtttaaaagccatgcatggggaggtatgatttcactagtttttgtgtctctttcttttcctctgtacaattgagtgcataaatattatgaattgtatcctctgaacacagtattaatgctttaactgtagatgattggctggggtatcacctctggttctttccatctgtgattagaaatggagaggacatttttatttctatgtaaaagtagaagctttaagaatcagcttctgatatttatatcagaagaggtaagcacccagattcttgttgaattctgaggtcttctcatctttgcttgattatagggtataaagtattagaacaattgaatcttaaaaattgtgcttaaggaaggtactaagacaaaaatgtttgcttaaggtaatcttcatatgtatacaataactgagacatggatagtgcctacgtctttggttaaagtgcaataaacaaagaactatataaattata

SEQ ID NO: 254020 - DNA, 434 bp, Homo sapiens
atggcatttgcagcaacctggatggaattgtagactattattctaagtgaagtaactcaggaatggaaacccaaacatcacatgttctcactcataagtgggagctaagctatgaggatgaaaaggcataagaatgaaactttggggacttgggggaaagggtcaggggaggtaagcaataaaagactacacattgggtacaatgtacactgctcaggtgatgggtgcaccaaaatctcagaaatcaccactaaagaacttattcatgtaaccaaacaccacgagttccccccaaacctactgaaatttaaaaaaaataaaataaaatgttaatttcacaataaaatgtgaaaaaatatgcagaaattttttaaaaatgtgcacaaagatttatgtacatagatacaaatgagaaaactggtcatgaaagcaaa

SEQ ID NO: 254021 - DNA, 736 bp, Homo sapiens
cattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgttt

SEQ ID NO: 254022 - DNA, 449 bp, Homo sapiens
gcaatttataaaagttgaataagattgattacttcgagaaaagttggagtgtctttttctgtctctaccagatacccccagaaaatgaggactatatttaactatacttaatatgtagcagtgtaattatttgcatacattccattagacttataaaatgccgttataagcagttgttatcttaccaaagtttttttctgcaatggcatactttcagatataaagagactgctttaaaaatcaaagttgacttatacagctttttaaaagaccattggaaaatctatctctattttttgtttatgggattcctctacaggctccctgaactctgatgattaaatcatgtacttttctgacaggcccaggatctccaaattatcctgggaccctcagtagagaagtttatccaattaacacaaatatatgcaggcacacacaaaacattg

SEQ ID NO: 254023 - DNA, 468 bp, Homo sapiens
taaacaagactgagagaccactagctagattaacaaagaaaaaagaatttccaaataagtactgtgagaaatgacaaagatattacaattcatcttcatttgcagatgaagatactgcagcttagtcagcagactaagtcacctaaatgctctgccagaagcagaatttgtactcaggaatgtccaactgcaaagtccatgtgcttgaacagtatggcatactgatacatgcagaaatacaaaagatcctcagaaaatactgtgagtaattctatgcacacaaattagaaaatctagaggaaatggataaattcctgggaacatacaatctcccaagattgaatcaggaagagactgataccctgactagaccaatatcaagctctgaaattaaaccaataataaaaaacctaccaacgacaacaacaaaaagccctggactagatggattcacagctaaattctatc

SEQ ID NO: 254024 - DNA, 576 bp, Homo sapiens
tgccaaataaagtaacatgcacaggttccatggataaggatgtggacattttggggaggccattattctgcctaacactggtaacttccataaacatcacccacaacaaaaatttcatttgccttctttctatatctcattgttttgtgtgaatcacaggcaagagcacaaactttgaggtgaaacacaccagctctgctatgaactggctggatgatcctggaccactcacttcacctcctacagcgttttctcatctgcagcacaaagatgactcttactgttatcagaaaatgacagtcaaagagtaaattaagatgtgtaaggtattagacacagaggctggtacctgatgagcacttggtaaacattcctttcagtctgttcttttctctatcccatttctctcatcctcacccatcttctccttcatctcctctctcttcatcgacttacatactcttaacttgccatttagaaagaagtcatgctccccattctctcgtgactctgctagaatgttcttgtgatagagtctgccatccactcaagacagcccacattttttatacaaag

SEQ ID NO: 254025 - DNA, 456 bp, Homo sapiens
cttaaagaccacttagtcccactccctctttttacagaagaaactcaggcccaagaaggacagtgaccagtctgaggtcacaacccaaagctggcagggctggggtgaaaagctaggctcctgtgacctccttctgtggccatcccacctgcctcattccatttctggggatagagatgtctgtggggttttttcctccccattttttctccccctagttccagcctggctgacagagcgagtctgtctcaaacgtctcaaaaacaaacaaacaaacaaaaaacctctttgaaggggattaaggggatgtgtcccaattaactagcaaacacctgtgaatgccagctttgtgtcaaggggagagggatttgtatagctaaaagatatttattgcttaggaaaaacatgactgaataaatgcatcctcattaaataaaaaatgctccagttaaaaaa

SEQ ID NO: 254026 - DNA, 364 bp, Homo sapiens
cttaaagaccacttagtcccactccctctttttacagaagaaactcaggcccaagaaggacagtgaccagtctgaggtcacaacccaaagctggcagggctggggtgaaaagctaggctcctgtgactccagcctggctgacagagcgagtctgtctcaaacgtctcaaaaacaaacaaacaaacaaaaaacctctttgaaggggattaaggggatgtgtcccaattaactagcaaacacctgtgaatgccagctttgtgtcaaggggagagggatttgtatagctaaaagatatttattgcttaggaaaaacatgactgaataaatgcatcctcattaaataaaaaatgctccagttaaaaaa

SEQ ID NO: 254027 - DNA, 1090 bp, Homo sapiens
cttaaagaccacttagtcccactccctctttttacagaagaaactcaggcccaagaaggacagtgaccagtctgaggtcacaacccaaagctggcagggctggggtgaaaagctaggctcctgtgacctccttctgtggccatcccacctgcctcattccatttctggggatagagatgtctgtggggttttttcctccccattttttctccccctagtgtccagcattcgttaaatacctaagaactacttagtgacctccctccctcgagacctgggaggaggctgggatctctcctaggatgggggctagaagtgggagctgttagttcaggtataagactgatacatagactgttttcctggcccaggcccatctgtcaccaactgactttgtatgtggctcaggagacctctaggcaagggaacgaggttcctaagaaccctgactcaggtgaggttctggcctctctctccagaacataggaaattcaggtgtagctgcatgaaacctctccctagaagaggaatggtgataccccaccattcctgggacccaggatgcccttcttggcatttccctaccttccatgaccagattagtccctctccttccagaatgtctccttgggtttattcaccatgttctactcctccaccccacctgatcgtcactgcattagcatatgggattagaacatcatcttgttatgtacttgggtcccagtcactaatatgtgggtgtcctatgtctttaaactgggggttcccctcagacacctcccaaaagatgagggatgagaggtgaagtagacttttttcttttttttttttttttgagacggagtctcactccagcctggctgacagagcgagtctgtctcaaacgtctcaaaaacaaacaaacaaacaaaaaacctctttgaaggggattaaggggatgtgtcccaattaactagcaaacacctgtgaatgccagctttgtgtcaaggggagagggatttgtatagctaaaagatatttattgcttaggaaaaacatgactgaataaatgcatcctcattaaataaaaaatgctccagttaaaaaa

SEQ ID NO: 254028 - DNA, 716 bp, Homo sapiens
cttaaagaccacttagtcccactccctctttttacagaagaaactcaggcccaagaaggacagtgaccagtctgaggtcacaacccaaagctggcagggctggggtgaaaagctaggctcctgtgacctccttctgtggccatcccacctgcctcattccatttctggggatagagatgtctgtggggttttttcctccccattttttctccccctagtgtccagcattcgttaaatacctaagaactacttagtgacctccctccctcgagacctgggaggaggctgggatctctcctaggatgggggctagaagtgggagctgttagttcaggtataagactgatacatagactgttttcctggcccaggcccatctgtcaccaactgactttgtatgtggctcaggagacctctaggcaagggaacgaggttcctaagaaccctgactcaggtgaggttctggcctctctctccagtccagcctggctgacagagcgagtctgtctcaaacgtctcaaaaacaaacaaacaaacaaaaaacctctttgaaggggattaaggggatgtgtcccaattaactagcaaacacctgtgaatgccagctttgtgtcaaggggagagggatttgtatagctaaaagatatttattgcttaggaaaaacatgactgaataaatgcatcctcattaaataaaaaatgctccagttaaaaaa

SEQ ID NO: 254029 - DNA, 860 bp, Homo sapiens
cttaaagaccacttagtcccactccctctttttacagaagaaactcaggcccaagaaggacagtgaccagtctgaggtcacaacccaaagctggcagggctggggtgaaaagctaggctcctgtgacctccttctgtggccatcccacctgcctcattccatttctggggatagagatgtctgtggggttttttcctccccattttttctccccctagtgtccagcattcgttaaatacctaagaactacttagtgacctccctccctcgagacctgggaggaggctgggatctctcctaggatgggggctagaagtgggagctgttagttcaggtataagactgatacatagactgttttcctggcccaggcccatctgtcaccaactgactttgtatgtggctcaggagacctctaggcaagggaacgaggttcctaagaaccctgactcaggtgaggttctggcctctctctccagaacataggaaattcaggtgtagctgcatgaaacctctccctagaagaggaatggtgataccccaccattcctgggacccaggatgcccttcttggcatttccctaccttccatgaccagattagtccctctccttccagaatgttccagcctggctgacagagcgagtctgtctcaaacgtctcaaaaacaaacaaacaaacaaaaaacctctttgaaggggattaaggggatgtgtcccaattaactagcaaacacctgtgaatgccagctttgtgtcaaggggagagggatttgtatagctaaaagatatttattgcttaggaaaaacatgactgaataaatgcatcctcattaaataaaaaatgctccagttaaaaaa

SEQ ID NO: 254030 - DNA, 738 bp, Homo sapiens
cttaaagaccacttagtcccactccctctttttacagaagaaactcaggcccaagaaggacagtgaccagtctgaggtcacaacccaaagctggcagggctggggtgaaaagctaggctcctgtgacctccttctgtggccatcccacctgcctcattccatttctggggatagagatgtctgtggggttttttcctccccattttttctccccctagtgtccagcattcgttaaatacctaagaactacttagtgacctccctccctcgagacctgggaggaggctgggatctctcctaggatgggggctagaagtgggagctgttagttcaggtataagactgatacatagactgttttcctggcccaggcccatctgtcaccaactgactttgtatgtggctcaggagacctctaggcaagggaacgaggttcctaagaaccctgactcaggtgaggttctggcctctctctccagaacataggaaattcaggtgtagtccagcctggctgacagagcgagtctgtctcaaacgtctcaaaaacaaacaaacaaacaaaaaacctctttgaaggggattaaggggatgtgtcccaattaactagcaaacacctgtgaatgccagctttgtgtcaaggggagagggatttgtatagctaaaagatatttattgcttaggaaaaacatgactgaataaatgcatcctcattaaataaaaaatgctccagttaaaaaa

SEQ ID NO: 254031 - DNA, 1963 bp, Homo sapiens
cacattccagaaaaaaataccgctttcacaaaactcgctccgcatgacccacagaacacccaaggtcaaaaagagtccaaagttcagaaagaaaagttatctgagtagactgatgctcgcaaacaggcctccgttctctgcagcgaagagcctcataaattccccttcacaaggggctttttcatccttaggagacctgagtcctcaagaaaacccttttctggaagtatctgctccttcagaacattttatagaaaccactaatataaaagacacaactgcaagaaatgccttggaagaaaatgtttttatggaaaacactaacatgccagaagtcaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctcagtttgaaattcagctaacccagcagctacagtcccttatccccaacaacaatgtgagaaggctcatttctcatgttatccggaccttgaagatggactgctctggggcccatgtgcaagtgacctgtgccaagctcatctccaggacaggccacctgatgaagcttctcagtgggcagcaggaagtaaaggcatctgagatagaatgggatacggaccaatggaagactgagaactacattaatgagagcacggaagcccagagtgaacagaaagagaagtcgcttgagctcacaaaagaagttccaggatacggctatactgacaaactcatcttggcattaattgtgactgaaatactaatgattttgattatacttttctgcctcattgtggtttaggattgggtgtgtgtgtctcctctctgaatggcactcaaatgtttgctgactcctactctgcgtgactggggtgtacagctatggactgatgcatcccatcccatcatctttcacgagcaaagcagtctcttttttgacagctgaagaagaacctgtagggaatccagaaggagcattcatgaaggtgttacaagcccggaagaattacacaagcactgagctgactgttgagccggaggagccctcagacagcagtggcatcaacttgtcaggctttgggagtgagcagctagacaccaatgacgagagtgatgttatcagtgcactaagttacatttgccatatttctcagcagtaaacctagatgtggaatcaatgttactaccgttcattaaactgccaaccacaggaaacagcctggcaaagattcaaactgtaggccaaaaccggcaaaaagtgaatagagtcctcatgggcccaatgagcatccagaaaaggcacttcaaagaggtgggaaggcagagcatcaggagggaacagggtgcccaggcatctgtggagaacgctgccgaagaaaaaaggctcgggagtccagccccaagggagctggaacagcctcacacacagcaggggcctgagaagttagcgggaaacgccatctacaccaagccttcgttcagccaagagcataaggcagcagtctctgtgctgacacccttctccaagggcgcgccttctacctccagccctgcaaaagccctaccacaggtgagagacagattgaaagacaacacacactatttccattttagaaagtgcaaaggctagagttacaaatatgaaggcttctaaaccaatttcacattccagaaaaaaataccgctttcacaaaactcgctccgcatgacccacagaacacccaaggtcaaaaagagtccaaagttcagaaagaaaagttatctgagtagactgatgctcgcaaacaggcctcacgttctctgcagcgaagagcctcataaattccccttcacaaggggctttttcatccttagggacctga

SEQ ID NO: 254032 - DNA, 1230 bp, Homo sapiens
cacattccagaaaaaaataccgctttcacaaaactcgctccgcatgacccacagaacacccaaggtcaaaaagagtccaaagttcagaaagaaaagttatctgagtagactgatgctcgcaaacaggcctccgttctctgcagcgaagagcctcataaattccccttcacaaggggctttttcatccttaggagacctgagtcctcaagaaaacccttttctggaagtatctgctccttcagaacattttatagaaaccactaatataaaagacacaactgcaagaaatgccttggaagaaaatgtttttatggaaaacactaacatgccagaagtcaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctcagtttgaaattcagctaacccagcagctacagtcccttatccccaacaacaatgtgagaaggctcatttctcatgttatccggaccttgaagatggactgctctggggcccatgtgcaagtgacctgtgccaagctcatctccaggacaggccacctgatgaagcttctcagtgggcagcaggaagtaaaggcatctgagatagaatgggatacggaccaatggaagactgagaactacattaatgagagcacggaagcccagagtgaacagaaagagaagtcgcttgagctcacaaaagaagttccaggatacggctatactgacaaactcatcttggcattaattgtgactgaaatactaatgattttgattatacttttctgcctcattgtggtaaggacaataattaattcaggttttcagaatgcagtcctgtttttgtgtggattcagagctcacaaactgaaaaccaaagccactttcccacctgctgctacttgacatacttcttcagtcatttaaggctgaggtgtatgctttgttcttttattgcagtgtatatttcaggatttttaaaagatcctcgcttccagatctctgtgaattgaaaccaagttaatcccactagactattttaagaagtcgatataatagcaaaatttctccacccaaaactatgtcaacaattggatgtactcatcaagtcacccttactctgccactaat

SEQ ID NO: 254033 - DNA, 561 bp, Homo sapiens
  misc_feature (42)..(42): n is a, c, g, or t
tattagggataatattcatttagccttctgagctttctggcnagacttggtgaccttgccagctccagcagccttcttgtccactgctttgggagtgagcagctagacaccaatgacgagagtgatgttatcagtgcactaagttacatttgccatatttctcagcagtaaacctagatgtggaatcaatgttactaccgttcattaaactgccaaccacaggaaacagcctggcaaagattcaaactgtaggccaaaaccggcaaaaagtgaatagagtcctcatgggcccaatgagcatccagaaaaggcacttcaaagaggtgggaaggcagagcatcaggagggaacagggtgcccaggcatctgtggagaacgctgccgaagaaaaaaggctcgggagtccagccccaagggagctggaacagcctcacacacagcaggggcctgagaagttagcgggaaacgccatctacaccaagccttcgttcagccaagagcataaggcagcagtctctgtgctgacacccttctccaagggcgcgccttctacctccagcc

SEQ ID NO: 254034 - DNA, 404 bp, Homo sapiens
  misc_feature (42)..(42): n is a, c, g, or t
tattagggataatattcatttagccttctgagctttctggcnagacttggtgaccttgccagctccagcagccttcttgtccactgctttgggagtgagcagctagacaccaatgacgagagtgatgttatcagtgcactaagttacatttgccatatttctcagcagtaaacctagatgtggaatcaatgttactaccgttcattaaactgccaaccacaggaaacagcctggcaaagattcaaactgtaggccaaaaccggcaaaaagtgaatagagtcctcatgggcccaatgagcatccagaaaaggcacttcaaagaggtgggaaggcagagcatcaggaggggcagctccctgcggggaggtagtgacgaaaaataacacgatcttcgagcctgtaat

SEQ ID NO: 254035 - DNA, 1919 bp, Homo sapiens
cacattccagaaaaaaataccgctttcacaaaactcgctccgcatgacccacagaacacccaaggtcaaaaagagtccaaagttcagaaagaaaagttatctgagtagactgatgctcgcaaacaggcctccgttctctgcagcgaagagcctcataaattccccttcacaaggggctttttcatccttaggagacctgagtcctcaagaaaacccttttctggaagtatctgctccttcagaacattttatagaaaccactaatataaaagacacaactgcaagaaatgccttggaagaaaatgtttttatggaaaacactaacatgccagaagtcaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctcagtttgaaattcagctaacccagcagctacagtcccttatccccaacaacaatgtgagaaggctcatttctcatgttatccggaccttgaagatggactgctctggggcccatgtgcaagtgacctgtgccaagctcatctccaggacaggccacctgatgaagcttctcagtgggcagcaggaagtaaaggcatctgagatagaatgggatacggaccaatggaagactgagaactacattaatgagagcacggaagcccagagtgaacagaaagagaagtcgcttgagctcacaaaagaagttccaggatacggctatactgacaaactcatcttggcattaattgtgactgaaatactaatgattttgattatacttttctgcctcattgtgatgtgttgtcaccgaaggtcattacaagaagatgaagaaggattctcaaggggcattttcaggtttctgccacggaggagatgctcttcacgaagggagagtcaggtacattggaggattcattgctgtggccagggaaggcagaggacatgcaaaattagtatttccctttctatcttctaggatggacttttttcattcagacggccgctctggcttaaagatatgtacaaacctctcagtgccacaagagtaaataatcacgcatggaagctgcacaagaagtcatctaatgaggacgagatcctcaacagggaccctgggtaaatgacggagccctcacaggtcccatctaaaatgaggagggggtgagaagcttaattgctcctttcaagaatcaaaaccttggcattgttattcttatcccagggacagcgaagccccaacagagaagggggaggagagtgaagccctgccataggaggagaacccagcccacctcaggcctcctgcaaaaacacatagcataaacaataccatcagaaagaaaagcaggactgaagccagcggcccacacatccacagaggcagcgggcagagcaagcacagggccatcgttcctgcccttgtttcccagtctaattagtcacccagacctgaaaacatatcctcagggggtggagattttacaattaccattgtttttggtgccctctcccttgcttcatcaagcatcagtcatataataccacagatttgaactcctgcccacaggggacctcccatctcctggcccctatcataggatcactgggcctacctgcactgtggggccaagccctgtctttttcccaagccctcaagcacacgcatgagtgttcatcccgacttggtagggggcttttcacccttacaagatggcaaaagattcacattgcttttttaaaaatttgtttttctttttaaaaatcccaacccttggatagcagggaggtgctggaggggtagagtcaagaagagtg

SEQ ID NO: 254036 - DNA, 1841 bp, Homo sapiens
cacattccagaaaaaaataccgctttcacaaaactcgctccgcatgacccacagaacacccaaggtcaaaaagagtccaaagttcagaaagaaaagttatctgagtagactgatgctcgcaaacaggcctccgttctctgcagcgaagagcctcataaattccccttcacaaggggctttttcatccttaggagacctgagtcctcaagaaaacccttttctggaagtatctgctccttcagaacattttatagaaaccactaatataaaagacacaactgcaagaaatgccttggaagaaaatgtttttatggaaaacactaacatgccagaagtcaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctcagtttgaaattcagctaacccagcagctacagtcccttatccccaacaacaatgtgagaaggctcatttctcatgttatccggaccttgaagatggactgctctggggcccatgtgcaagtgacctgtgccaagctcatctccaggacaggccacctgatgaagcttctcagtgggcagcaggaagtaaaggcatctgagatagaatgggatacggaccaatggaagactgagaactacattaatgagagcacggaagcccagagtgaacagaaagagaagtcgcttgagctcacaaaagaagttccaggatacggctatactgacaaactcatcttggcattaattgtgactgaaatactaatgattttgattatacttttctgcctcattgtgatgtgttgtcaccgaaggtcattacaagaagatgaagaaggattctcaaggggcattttcaggtttctgccacggaggagatgctcttcacgaagggagagtcaggatggacttttttcattcagacggccgctctggcttaaagatatgtacaaacctctcagtgccacaagagtaaataatcacgcatggaagctgcacaagaagtcatctaatgaggacgagatcctcaacagggaccctgggtaaatgacggagccctcacaggtcccatctaaaatgaggagggggtgagaagcttaattgctcctttcaagaatcaaaaccttggcattgttattcttatcccagggacagcgaagccccaacagagaagggggaggagagtgaagccctgccataggaggagaacccagcccacctcaggcctcctgcaaaaacacatagcataaacaataccatcagaaagaaaagcaggactgaagccagcggcccacacatccacagaggcagcgggcagagcaagcacagggccatcgttcctgcccttgtttcccagtctaattagtcacccagacctgaaaacatatcctcagggggtggagattttacaattaccattgtttttggtgccctctcccttgcttcatcaagcatcagtcatataataccacagatttgaactcctgcccacaggggacctcccatctcctggcccctatcataggatcactgggcctacctgcactgtggggccaagccctgtctttttcccaagccctcaagcacacgcatgagtgttcatcccgacttggtagggggcttttcacccttacaagatggcaaaagattcacattgcttttttaaaaatttgtttttctttttaaaaatcccaacccttggatagcagggaggtgctggaggggtagagtcaagaagagtg

SEQ ID NO: 254037 - DNA, 1077 bp, Homo sapiens
tcttcatgatatttctggcaagctcatagtctcccagagaagtacattgtgagatacgtgggaaatggctgcatcactcactgtcttgtgcatgtgtctccccaggggcattttcaggtttctgccacggaggagatgctcttcacgaagggagagtcaggtacattggaggattcattgctgtggccagggaaggcagaggacatgcaaaattagtatttccctttctatcttctaggatggacttttttcattcagacggccgctctggcttaaagatatgtacaaacctctcagtgccacaagagtaaataatcacgcatggaagctgcacaagaagtcatctaatgaggacgagatcctcaacagggaccctgggtaaatgacggagccctcacaggtcccatctaaaatgaggagggggtgagaagcttaattgctcctttcaagaatcaaaaccttggcattgttattcttatcccagggacagcgaagccccaacagagaagggggaggagagtgaagccctgccataggaggagaacccagcccacctcaggcctcctgcaaaaacacatagcataaacaataccatcagaaagaaaagcaggactgaagccagcggcccacacatccacagaggcagcgggcagagcaagcacagggccatcgttcctgcccttgtttcccagtctaattagtcacccagacctgaaaacatatcctcagggggtggagattttacaattaccattgtttttggtgccctctcccttgcttcatcaagcatcagtcatataataccacagatttgaactcctgcccacaggggacctcccatctcctggcccctatcataggatcactgggcctacctgcactgtggggccaagccctgtctttttcccaagccctcaagcacacgcatgagtgttcatcccgacttggtagggggcttttcacccttacaagatggcaaaagattcacattgcttttttaaaaatttgtttttctttttaaaaatcccaacccttggatagcagggaggtgctggaggggtagagtcaagaagagtg

SEQ ID NO: 254038 - DNA, 1814 bp, Homo sapiens
cacattccagaaaaaaataccgctttcacaaaactcgctccgcatgacccacagaacacccaaggtcaaaaagagtccaaagttcagaaagaaaagttatctgagtagactgatgctcgcaaacaggcctccgttctctgcagcgaagagcctcataaattccccttcacaaggggctttttcatccttaggagacctgagtcctcaagaaaacccttttctggaagtatctgctccttcagaacattttatagaaaccactaatataaaagacacaactgcaagaaatgccttggaagaaaatgtttttatggaaaacactaacatgccagaagtcaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctcagtttgaaattcagctaacccagcagctacagtcccttatccccaacaacaatgtgagaaggctcatttctcatgttatccggaccttgaagatggactgctctggggcccatgtgcaagtgacctgtgccaagctcatctccaggacaggccacctgatgaagcttctcagtgggcagcaggaagtaaaggcatctgagatagaatgggatacggaccaatggaagactgagaactacattaatgagagcacggaagcccagagtgaacagaaagagaagtcgcttgagatgtgttgtcaccgaaggtcattacaagaagatgaagaaggattctcaaggggcattttcaggtttctgccacggaggagatgctcttcacgaagggagagtcaggtacattggaggattcattgctgtggccagggaaggcagaggacatgcaaaattagtatttccctttctatcttctaggatggacttttttcattcagacggccgctctggcttaaagatatgtacaaacctctcagtgccacaagagtaaataatcacgcatggaagctgcacaagaagtcatctaatgaggacgagatcctcaacagggaccctgggtaaatgacggagccctcacaggtcccatctaaaatgaggagggggtgagaagcttaattgctcctttcaagaatcaaaaccttggcattgttattcttatcccagggacagcgaagccccaacagagaagggggaggagagtgaagccctgccataggaggagaacccagcccacctcaggcctcctgcaaaaacacatagcataaacaataccatcagaaagaaaagcaggactgaagccagcggcccacacatccacagaggcagcgggcagagcaagcacagggccatcgttcctgcccttgtttcccagtctaattagtcacccagacctgaaaacatatcctcagggggtggagattttacaattaccattgtttttggtgccctctcccttgcttcatcaagcatcagtcatataataccacagatttgaactcctgcccacaggggacctcccatctcctggcccctatcataggatcactgggcctacctgcactgtggggccaagccctgtctttttcccaagccctcaagcacacgcatgagtgttcatcccgacttggtagggggcttttcacccttacaagatggcaaaagattcacattgcttttttaaaaatttgtttttctttttaaaaatcccaacccttggatagcagggaggtgctggaggggtagagtcaagaagagtg

SEQ ID NO: 254039 - DNA, 1735 bp, Homo sapiens
cacattccagaaaaaaataccgctttcacaaaactcgctccgcatgacccacagaacacccaaggtcaaaaagagtccaaagttcagaaagaaaagttatctgagtagactgatgctcgcaaacaggcctccgttctctgcagcgaagagcctcataaattccccttcacaaggggctttttcatccttaggagacctgagtcctcaagaaaacccttttctggaagtatctgctccttcagaacattttatagaaaccactaatataaaagacacaactgcaagaaatgccttggaagaaaatgtttttatggaaaacactaacatgccagaagtcaccatctctgaaaacacaaactacaatcatcctcctgaggcagattccgctgggactgcattcaacttagggccaactgttaaacaaactgagacaaaatgggaatacaacaacgtgggcactgacctgtcccccgagcccaaaagcttcaattacccattgctcagtttgaaattcagctaacccagcagctacagtcccttatccccaacaacaatgtgagaaggctcatttctcatgttatccggaccttgaagatggactgctctggggcccatgtgcaagtgacctgtgccaagctcatctccaggacaggccacctgatgaagcttctcagtgggcagcaggaagtaaaggcatctgagatagaatgggatacggaccaatggaagactgagaactacattaatgagagcacggaagcccagagtgaacagaaagagaagtcgcttgagctcacaaaagaagttccaggatacggctatactgacaaactcatcttggcattaattgtgactgaaatactaatgattttgattatacttttctgcctcattgtgatgtgttgtcaccgaaggtcattacaagaagatgaagaaggattctcaaggggcattttcaggtttctgccacggaggagatgctcttcacgaagggagagtcaggatggacttttttcattcagacggccgctctggcttaaagatatgtacaaacctctcagtgccacaagagtaaataatcacgcatggaagctgcacaagaagtcatctaatgaggacgagatcctcaacagggaccctggggacagcgaagccccaacagagaagggggaggagagtgaagccctgccataggaggagaacccagcccacctcaggcctcctgcaaaaacacatagcataaacaataccatcagaaagaaaagcaggactgaagccagcggcccacacatccacagaggcagcgggcagagcaagcacagggccatcgttcctgcccttgtttcccagtctaattagtcacccagacctgaaaacatatcctcagggggtggagattttacaattaccattgtttttggtgccctctcccttgcttcatcaagcatcagtcatataataccacagatttgaactcctgcccacaggggacctcccatctcctggcccctatcataggatcactgggcctacctgcactgtggggccaagccctgtctttttcccaagccctcaagcacacgcatgagtgttcatcccgacttggtagggggcttttcacccttacaagatggcaaaagattcacattgcttttttaaaaatttgtttttctttttaaaaatcccaacccttggatagcagggaggtgctggaggggtagagtcaagaagagtg

SEQ ID NO: 254040 - DNA, 191 bp, Homo sapiens
ccttctggtggatcaaacttagttacctagcacaccagcctgctgaaatgtgggagaataaaccacacacagtcatttagggattgtgtcacatgtagaagcccattttgccccagtgtgggtctaggggagagagactgagtgatatgggaaggagccaggctaggcacaggtttttcaggccttgcctg

SEQ ID NO: 254041 - DNA, 361 bp, Homo sapiens
ctgcagtgagccataatcacactgtactccagcctgggcgacagagggagaccctggctcaatcaataaacaaataaaatgttgtccttccagtctaattgcattgaaaaatatagctattacccaggcatatcacccatagttcagagtttgatattctaccattagattaattttttttctttttggttcatcagtgcctctctcaatcttgtaggtacctgattcactctaaagtaccaaggacgttcatctctattagcactagcctcctggggtgtaacgtgactcttcacaaaaactgcactactcttgaagaaagcaattgtgttcatttcagcaacatggaaagtccaggaaa

SEQ ID NO: 254042 - DNA, 96 bp, Homo sapiens
gtcttggagttctcataattcttctttccaccatggtaacttctattactgggttgtcaacttctgcgatagcaactaacgggtttgttcgtggag

SEQ ID NO: 254043 - DNA, 532 bp, Homo sapiens
aataataataataataataattacaacttttatttcagattcagggggtacatatgcaggcttgttacatgagtaaattgtgtgacactgaggtttgcagtatgaatgatcccatcacccaggtagtgagcatagtacccaataggtagtttttcagcacttgccccctccctcccccatctagtagttttcagtgtctatcgttcccatctttatgtccatgtgtacccaatgattacattgtttttcaccctgtgatgaaattcgtaaatgccaggtgctaatgataaatgattaagatgaaaggaaacttttgcttaataaagttactatgcattttttaacaatgaagctttaggtcatttttttaaggtttgttagctaattgtttaatatttttgtctggtttttaaaaccattggagttagagaaagacacaagaaatgaaaaaaaaagcaagttttaaaacggaatgtataggattccattttgaacgaaattatatatgatattggattaaaacgatatacaa

SEQ ID NO: 254044 - DNA, 440 bp, Homo sapiens
gcaaccaaaatgatcttttgaaaataagtcactaaatgtaatgtgatatcctggattatattctggaagataaaaagctcattagtggaaaagttggtgaaatctgaataaagtttgaaatttacttaatagcaatataccagtgttaatgtctagcttagacaaatgtaacgtggtttatgtaagatttacttagtctagttttccaacattatatgggaactttgtatttttttataactgtctataaatttaaaattattaaaaggtaaagattttaaaaatgaaaataggaaaattagccgggtatggtggcgtgtacctgtaatctcagctactcggggctgaggtaggagaattggttgaaaccgggaggcagaggttgcagtgagctgagatcacactgctgcagtccagtctgggtgaatgagacctgtctt

SEQ ID NO: 254045 - DNA, 406 bp, Homo sapiens
acggataacaaacaagcacgtgaaaaggtactcagcatccttagtcatgaaaccatcagaaggctccatgacacacctctcacgatggctgaaatgaaaaaagattgaccttaccagctgatgacaaggatgcagagcaaatagaactctcatgcactgctgatgagaatgtaaaagggtacaaccactttggaaaataattcagcactttgttgaaaagttaaacagtactaccctatgatcaagccattgcattcctagatatttacccaggagaaatggaagttcctcttggtaggaacacgatgtccatcaacaggtaactgaaaaaaacaaactgtggtatatgcatacagcactatgtcactcaacaatcaaaaaataaaaataaaaataaagaactggc

SEQ ID NO: 254046 - DNA, 385 bp, Homo sapiens
cttccaaacatacctatgccttccggtcaccctactaagccttattcatccagcataaggggagatggtactaggtttcctttgacagtctgccccaaactcattgaactaggaaagatcaggttgtgtagacggagtagttcccaaggaggaagttttagcaacagcacgctttgatccccagaaggaagcaactattagcctaatcctaatcttaatttctgcaacttctatagccccaaactgctataagactcaaaatatcgccgggcgcggtggctcatgcctgtaatcccagcacattgggaggccgaggcgggtggatcacctgaggtcaggagtttgagaccagcctgaccaacatggagaaactccatctctacta

SEQ ID NO: 254047 - DNA, 457 bp, Homo sapiens
tgtgtctcctatgcatcaatccaagtgattccacatggggtacagtggtatatgtgggtggacatggaaggtgggagaaatggaggcaagatccatccctatcacagtgccaaagagtaattggattatggcggcattgattgtaatggagagaagcacaaggcatgggaaaggattgagctaggtttgctgaaatcttagaccagtccaatttacacctaggtcttcttacttccacatttgtgctttttttttttttcttatattagtttgaagacttctagccagaaggtgaataatgtagaaattccttctgaagatcatctatgtgacactgggttttgttatttttggcatcactacttagaaacagaaatattcagctgtgtttcttgaaatgattggactttagggtttggtaagcatttcctgagatggcatgtgtcagtggccagaa

SEQ ID NO: 254048 - DNA, 270 bp, Homo sapiens
atttattatactttaagttctagggtacatgtgcacgtatacaccctgaatagagtttttaaaacaaatatagtagccatctctacatagcattctgcaattgatgaactactttgcataatctgtataacataaaatatggtaggaaaattggatgtttaaaatataggaatgagttgaacgtttagttagtggaaaaagctagaatgatgaatagtttcaaaggttgttaagaaaaattccaagatttacatattcaaatatttttgt

SEQ ID NO: 254049 - DNA, 306 bp, Homo sapiens
tgtcagatgatcctatttgcttataggttactcacccccaacttctcacttcctcactatccccacccaaccaaccctggccaagtgaggtttttctggtatttcataaaggtgaatttagtatgaatcttttgtttatggtgttggatcctgagcgaaactctcatcctaaagatctgcatctcttagctctaaacatttttcttctattactttttagaaaatttcttctgcctcttactagtctgattttgcacttaatggtttgattcttaatatatagtctttctgtcctgttctagattt

SEQ ID NO: 254050 - DNA, 534 bp, Homo sapiens
cagctcccagcccctcctcgccagcttcccaccagatgctccctcctttcctgtcctcagaagcctggttgctgcttgccctgtgtggactcccctgccttctgctctcccggcactctgggtctccgcgagggtctctctttgaccccacacgtgcagactttgtctgtggatggcagtgcactccacgaaggggtggagaggtgccggggcctcggtgcgggcgagagggcgcagtgcagtccaagcggctgcagagggctctagcgcagcaaagctggttggacccaagctctgacccctctgccctcaaagcccgggttaccgagccctcatgagcaccaagaacgaagagaagtaaaaagggacacttgtgacctgctgggggctgagccaccgctaaccccaagaaaagtctagagaacaagaaaagaaccacagcaaacctgggaccctgcaggacgaatcggggagggattcgtgctttttacttgcaataaaatctgtaaagttcttgaataggaaacaccaaca

SEQ ID NO: 254051 - DNA, 358 bp, Homo sapiens
gggagaggaagcatacacacttatgtgcacttgtgtgtgtgtgagagcgagagcatgcgtgtgaatacacatgtgtgtatgtgcttgaatatgtgtgtgtatatatgtgtgtgtgtgtctatgtgtgcacgtgtatatgcatgtgtgagagagcatgcatgtgcaccgtgtgcatgtgtgtctagtcgggggagccagcaagaggaggggaagtgggaaaggggagttgtttgtttatttgaaaccagctaggccctctaatgcagactttcaccagagcagggcagtcaatgtttgctttgggagatgctcaaagcctgaaacacagcttcagtcaaacaaggggtgtggtggaggc

SEQ ID NO: 254052 - DNA, 303 bp, Homo sapiens
atgagccaccatacctaattattttaaactttttgtagagatagagcctcgccatgttgcacaggctggtctcaaactcctgaactcgaacaatactccctcctcagcctcccaaagagctgtgattacaggcatgagccaccctgcccggctagcaagatcattttataaagtagcaatattgcagtaaaataatggatattaaaatgactaaaatgcttcaacagatagcaaacacaataaattcaaccctttttattgggaggcaggcccctgaaaaaatcgtggttttaaaaatcagcc

SEQ ID NO: 254053 - DNA, 197 bp, Homo sapiens
ctagaattggtagggcttagcagttggttggctgagggagttgacggggagagtcctgagaagccctcttagtttttcagctcttccattactaagtggtatccttttcagcaaaagggacataaggagagaattcaggcaaacgtccacaaaggtcacaggcagcggacatacgggtctgttataccccatatata

SEQ ID NO: 254054 - DNA, 649 bp, Homo sapiens
gtttaagaaacctgttttacaggatactggatctagtctttaaaattttgcctttttttttttaagtccgattcattaaaagtttaagctggtaggatttatccttgttatacctaagacagactaataatctgtattatttaccttaattatatgctttcccccgaggaggcattctggtgtgaaatggttaagatggcagactttaaagaagccagcttacctggatttgcgtcccagctctgccatttgccggctgtgtgccttggtttccttatctgtaaactagggatcatagggtttttgtgagggttaatgaataatcattcaatataggttagctgttgtagttgtgggctgtgctgttgctcactttaagagagtggagtttgctgtactgtattagataggcagtctaaagaccagtcttggctaattctgatacttgacagaacgctagcctatttgccacttctgattatactcttagtttaattcatactataacatataacccaaacgtaattatgttagattttataaagttatgttcctccaactttgctccatggtatttgttcactttgtgaaagttcattacgctgcatgtcagattcgtatacttttctgaataatgttatacttcaat

SEQ ID NO: 254055 - DNA, 494 bp, Homo sapiens
atgagctactacggcagctactatggaggcctgggctatggctgtggaggctttggtggcctgggctatggctatggctgtggatgtggcagcttccgcagactgggttctggctgtggctatggaggctacggatatggctctggctttggaggctatggatatggctctggcttcggaggctacggatatggctgctaccgcccatcatactatggaggatatggattctctggattctattaaactactgccccagcaacacaatgtgtgaaattataagaggactttcccagagctgacttcaatcattggacaacaaagatcatgctggagctatttgcacaaaagaatttaacatctcagaatttcaggcaattttttttctctgtatacccacatctctataataatcctagtattctctagttttgcttttaaagctgattgaattatctgtttatcttccaataaaacattctattttcaaacac

SEQ ID NO: 254056 - DNA, 106 bp, Homo sapiens
tgctcaacactcaacttattctcatgtttatatttaaccaatgtaatcctcatgaaagacttttatagttgaagtcacagtgaaaactagagaataaaattttaat

SEQ ID NO: 254057 - DNA, 381 bp, Homo sapiens
tatggctgtatgggttaaaaaaaaattacaatgtggatttatatcacataacaaaaattaatctagttttcaaatgtaaaaatatttagaaatgttctatgtactatagtaaacataaaagcatacccatttgaaggaattcattcaggcccagttgacagctgtcatgctgtagagatgagcaacaacagtagagagccattgtgtatcttatgtgtttctcagcctgatttgtgttccatgatgctatcatttttttagtgtcatattcctccaggtcacattagacgtattctgctgttgggtgtccttggagtcacagagtaacagctgatctagactaaatcctatgttaaccagaaataaactccagagaaagga

SEQ ID NO: 254058 - DNA, 924 bp, Homo sapiens
ccagtgactgagagcagcagggagacaaaggcaggtccattctagggatacacaggactcctctaatggctgacttggatcaaggactccctgacagcctggcccagctttccttagatggcatggcagcctgggatacttctccaacttctcttccttctctactaaactcagacttcagattgtatcatagtctgatgattctctgaggctttccaggttccctccccattttctgtcacaggcatttctcctaaaatatttgatcccatgttgtggcatctgcttctcagaagacccagacgaacacagtagaaattaaagtgcattagaatagcacaaaagataggcagtaattggagctaagttctgtatgggtcctgcttgcgttaattggtaagtggtaaagagttaatttaaggcccactgtagtaaatcaagagaaagtaataagatttttttaagtgtataaataataagctgatgggagaactggagtaataaataattgataaaaagaagacaagaatggagaaaaagagacaaagaatagatggaatatatagaaaactaataataaaatggtctacttaaatccaaatcatcagtaactatattatatttacttaattttttcaattaaagacaaaagcctaggcacagtggctcatttctgtaatcctggcactttgggaggctgatgggggaggattgcttaaggccaggcattggagaccagcctgggcaacatagcaagacccccatctctacagaaaaattttaaattagcaggcataggctggttgcagtggctcacacctgtaatcccagcacttcgggaggccgagctggggaggatcacctgaggtcaggagttcaagaccagcctggccaacatggtgaaaccctgtctctaccaaaaat

SEQ ID NO: 254059 - DNA, 460 bp, Homo sapiens
tagtatccggttctcagttccccaccccctgctaggtacaattttcagattattctagagctccctgagctcctttctcagctgtggagaaagctgataggaggggaaaatggagcaaagcagagaataaaagtagaaggcaggtgctgtctccattaggttatctcatcattagcctctccctccttgaccagtcagtgcccaaatgggagactgattatggtctctggcttcatctctggctacctaactgcagcaaaacagaatagctggagagcgcccatcaaaccaatgacaacaactgtatgtttcattgtcatataagaatcagtggagcttactacactggaagttaaaacagttttactgaagtctaatttctctgataaagcattcaattttctgtgaaatttgaaaggtgaaattggggcacacattctgtagttaccgatcaaaaatg

SEQ ID NO: 254060 - DNA, 575 bp, Homo sapiens
ggggggcaactccaatataaagaatggatgatgttattttaactatctcgattaattttgtaagtttacatttcaaagatttattgtagatagactatctactgtgccatccaggatggcagccacttaactacatgttgttacttaaatttaaatgaaaagtaaaggcagacatggcggctcatgcctataatcgtagcgctttgggaggctgaagtgagaggatccattgagcttgggagtttaagaccagcctgggcaacatagtgagaccccatctgtattttaaatataaaaagtttttggctgggtgcaatggcttatgactgtaatcccagcactttgggaggctgaggtgggtggatcacttgaggtcaggagttcgagaccagcctggccaacatggtgaaaccctgtctctactgaaaatacaaaaattaggcaggtatggtggtgcttgcctgtaaacccagctattcaggaggctgaggcaggagaattgttggaaaccaggaggtggaggttgtagtgaactgagattgcaccactgcactccagcctgggtgacagagcaa

SEQ ID NO: 254061 - DNA, 418 bp, Homo sapiens
gaccttctttcttcagtttgctgtgatccacattaattgagtagaacttgaattgatcatcgggacccagtttgttccagggatctgggtgattctttcagtcccaactaacatctggattgaaaaatgccagacgcaagagatacagtcctgctccagtacctctagctccaataaatactaagagggagatcaagtttggatgcttcttggcctgaccgatgatctggtggagcgtgtctgcggcagaggcctccaattggaaaggagagaaccagcctagccaccaggccctgggctaagtagtatcttgccagtgtattttaaaaggcctttgggaattttctattctgcctggcccactcctactacagatgtaagattatagttgtacaattggtcttgtttcatttaaatt

SEQ ID NO: 254062 - DNA, 187 bp, Homo sapiens
agtgttcacaagataaaacagcaaactccacaaactcaaagacatcacaatggagaggggcaggatacgggaggtgatcgctcatgtctgtgtgcggtgtgctgcgtaatctgctccttaaacaaaccagcaagaaaggctcaaatcagtcccagcctgacatttgagaggcccaaagtgaatgcac

SEQ ID NO: 254063 - DNA, 691 bp, Homo sapiens
atagactcataagaaatggtgattaagcgggtattaaatgaattatataagcaacaagtatcaacatattttaaaatacaaacagaacacttcttgtagggttggtcagaaagtgtttcaagaagaaaaataggaggaaactggactttgaaggatttttttgtttcttgtagtccaagtagaattgctaggagatatagaacaggcattgcaagggtaatgatcttgagctaattccacctaataaaatggacttgggccaggtgcggtggctcacgcctgtaatcccagcactttgggagggtggggccaacggatcaggaggtcaggagttcgagacaagcctgaccaacatggtgaagccccatctctactaaaaaatacaaaaaatacaaaaattagctgggcgtggtggtgcgtgcctgtaatcccagctactcaggaggctgaggcagaagaatcacttgaatccaggaggtggaggttgcattgagctgagatcatgccactgcactctagcctgggcaacagagtgagactctgtctcaaaaataaatagatagatagatagatagatagatagatagatagacagacagataaaatagacttggactccactggatcttacttcacaaatgtttgatgagtatcactatgagccagctaacatgtaaaattttggggatag

SEQ ID NO: 254064 - DNA, 694 bp, Homo sapiens
gccagtacagttggaagcctccaggacccaaggccagccctttggccagcttccgtcctgattagttggtgttcttgctgactgtaaaaataatttaaaactcctagaattatgtgtctattactgtatggatcacaatggattgtacttattggtttgtctgttttctgattgtcactagtctaaggacaagaactatatttgtcattttctccagtgtctaatatgagtagtgttttgcagttgaaaagatgatagaagatagccagaatggaggacctacatttcctgttgtttgaccacctgtttcctgtgctataggaagccattcataactaggaaggaggcagtttatggttttgttttaaatctgtaaaattttttttatactcttggctatctgtcctaatatgtttgtcttatattttccttcagaaatggatattaatttctagtttatgttctactttcaacatttgtcatcttctcttacattaatgtctcttatcatgcctcctccattatgttcctggaatctacctgtggtttcactaatatgattcctcacaggacttcctaggctttttagtgccactactttcaacctgtgtagtcctaaattcaacctggtctatacttgccgtttcttttctttttttcccatcttgtaaggatagttaatagttcttacttg

SEQ ID NO: 254065 - DNA, 570 bp, Homo sapiens
gagaaggtgcctgagaatatttcctaatcgttttgagaagtgccttcctgtgacatcttatgtatttcctaattgatcaaaagtagtgctgcttctctaagccctgagatttaatgagccccattcaaactgttattaatgtaaccttctttcccagtgcaggatgacttgtaatcaccttgaaagagaaggagggttcttcgtattcaggtagggtatggtagggatgtggagtgccaagcaggaaatctgacaagtgacccccggaactttggattacctagcaactagccaggtaactggctaatctgattgagggttgccctctttgctgggcagatcatggctaatctcagcttcacatgagtcttgtgaaccatctagttgttttgtaactgctaagagctgcaagtgctgagcagctggtttatacagcattccctgaaacagcctagtatgtgtccatttatgtgcccggcttattatgtgtccacttatgtgtccaattagtaatcactttttctttcggtcaaggtatgtgtattaatcaatattttttgaacccgtcct

SEQ ID NO: 254066 - DNA, 367 bp, Homo sapiens
tctttattgaatattactgaaatcgccttaagcattataagtatgttttcatttctcacagtgctcttttcactaattaatggttgacaatattcaaatattggatattttttggaaaagaaaccactaattaaacatcgtgggccaaattggaagtattggtacatactggaagtgtatttagtctgagtaaaagtgatgctactgcttttctcaattcattgagaggaacaaattatttacatagaaaaggagatatactttagcaaatgttttagaagcttgtcttttgaaaaaagttatagtgatacatgcacataattaaaaaaaaaataagttagttctgaagagcttataatggaaatca

SEQ ID NO: 254067 - DNA, 1082 bp, Homo sapiens
ccgcctctccccgctgcgctccctcgctccttccctgagctcccgggctccggcagcgcgctggcggggcgccgcattgcacactctgggggcgccgcagtgttcgtgggatggggcagcgggctgcagctggcggccggaatccgcgcgcagcccgggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagact

SEQ ID NO: 254068 - DNA, 878 bp, Homo sapiens
actgtgcagggcatgaaagaccaaccactctgtaaatgcacataaagaacaacctccttgagcaatctcaagcaagagaaagaagaggcttccgagctccagcaaaacaatgggaaaaaacatacccttatcttttccttctcattttcaaaggtaccgtgaatataagtagaagaaagacaccgtctcttcctttaaggaacttacagtcttatggaagagacacagatggaagtgcacaattaccgaatatcatcaaaaagcctgagaaaaagttatgcaaaagctactgtgtgagcacagaggctgtaaacctaatcctaagttgcagggtgagcaacaaggcactattttggaagcagagaacagccctcaccagacacggaatctgctggtgccctgatcttggaattcccaccgtctagaactgtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgaggaaccatgatctagaagaaaagccagatatcccaaatgagaaagttaagaaggactaagacaacatggagaagagagaagattagcattgacctggttgggaggaagatcaggaagatttcacagaatttatcacatttggattgagccttgaagaatatc

SEQ ID NO: 254069 - DNA, 1353 bp, Homo sapiens
actgtgcagggcatgaaagaccaaccactctgtaaatgcacataaagaacaacctccttgagcaatctcaagcaagagaaagaagaggcttccgagctccagcaaaacaatgggaaaaaacatacccttatcttttccttctcattttcaaaggtaccgtgaatataagtagaagaaagacaccgtctcttcctttaaggaacttacagtcttatggaagagacacagatggaagtgcacaattaccgaatatcatcaaaaagcctgagaaaaagttatgcaaaagctactgtgtgagcacagaggctgtaaacctaatcctaagttgcagggtgagcaacaaggcactattttggaagcagagaacagccctcaccagacacggaatctgctggtgccctgatcttggaattcccaccgtctagaactgtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgcacttcttgttgtgaaggaaatatctgtaacttgccactgccccgaaatgaaactgatgccacatttgccacgacgtcacctataaatcagacaaatgggcacccacgctgtatgtcagtgatagtgtcctgcttgtggttgtggttagggctcatgttatagtggctcagtggctccatgtgttaatagcgatccatggggatctcgatggtccacagacctgcatgagtcattggcctgacagtaattacacatgtgagacacaacactcttggaggtcatcacagccaagcattgccacttaccatgaggaataaatgttgcttcattgtagccattttgagtctaaccgagactcatcaaagccttctgtcagtacagcccaagttccataccataaacgtttgttttcattccaagaagtagttctgcatttatcgagatctggggttcttaatttggaagaatacatgcatgagatgcagtaggtcctgagact

SEQ ID NO: 254070 - DNA, 800 bp, Homo sapiens
ccgcctctccccgctgcgctccctcgctccttccctgagctcccgggctccggcagcgcgctggcggggcgccgcattgcacactctgggggcgccgcagtgttcgtgggatggggcagcgggctgcagctggcggccggaatccgcgcgcagcccgggtgcaagttctctcctgttgccctgagtgcccactcccaggccctctgtatgagtgacacttcagtctgccatggaacctggccctgctctggcctggctcctgctcctgagcctgctggcggattgtctgaaagctgctcagtcccgagacttcacagtgaaagacattatctacctccatccttcaaccacaccatatcctggtggatttaaatgtttcacctgtgaaaaggcagcagacaattatgagtgcaaccgatgggctccagacatctactgccctcgagagaccagatactgctacactcagcacacaatggaagtcacaggaaacagtatctcagtcaccaaacgctgtgtcccactggaagagtgcttatccactggctgcagagactccgagcatgaaggccacaaggtctgggcaacagagcaagtgaccagtactacatagccagctgccttctcttcagacatctgccagtactcatgagcagattcttactcccccgtgaaggctgtcttttgattgtctttatgctctatgaaaagacgcttcctttcctgtttactctaaaagaatacacatttataccagagcataggacaactgatataaattgtgtaaacacacatgaaga

SEQ ID NO: 254071 - DNA, 561 bp, Homo sapiens
atgtagctggagttaaattagtggctgaagtcaagagactggctttggagcctgtgttctgcctcttctgagagagcacagtgagcttgagaaagatagtctaccttcagcatctctgcttcctcttctgtaatgtggggataacaaaaatcacatgtggattttgtgatgaatgaatgacagcagctctacatagcgcattacacaatgtagggcctattagaggtggggatgaggtttcaattatgggctaatggtgcaaagcttgagatcacagtgctttgccattcacctcttctccctaaaagggtcctaacagagggagattttcacataaggaatacccgccaagcaggaagcaggccactgctttattaataacggatatgaatgaataacctagccaacattcaatggcaccaaatgctgagctttctagcagggctaggtttgggatataaatgagggcttggtttgggatataaatgagggttcctgctgctataccctcatggcaagttcctagccagactagcttcctcatttcggagaaggaagaat

SEQ ID NO: 254072 - DNA, 434 bp, Homo sapiens
ctgaaatggaggttggttatgaggtgttaacaggacctctgggccaccaaggagaaagggctggggaagccaagagaaacacccagctcccaattttaaaatgaaattagtaaaataaagaaataaaataaaatagtaaaataaaggaagaaatttgaaactgtaaaaaatttaaagcttttagtgaaaaaaaaaaggaggggataatgattaacagagcaggctttggaattaaacaaactagtttaaaattctgattcctcagactgcctttgcgacacagggcaagttcttgatggtgagcctcggctgtcttgtctgtcttgtctggtactggggtctgtctctcaggtaagcattagctaatgcatgtgaagtatctaaaaccactccaactatatagcaaaggctcaataaaaggtcgttgttattca

SEQ ID NO: 254073 - DNA, 639 bp, Homo sapiens
agaaagaatagggcactgcaaaaaaacaaaacaaaacaaaaacaaaaacatgcaatataattccttgtatatcaaattcaaaacctttaaatactgagcaatatattgtttaaggatacaaataaatgtggtaatggaaatcaggggaatgataacacaagattgaagacagttgttgcctctgtgaaaggagagaatagaatgagactgagaggtactccactcagaggacttcaaaggtaatggtaatatactttttcttaaacttgatattgagtatatgagtatttgttgtttcattattatttatactttacatgtattttactgatacttatatctattcactgtttaataaaaacaagtatgaaacaaagtaaggaaataaatataaattcaggattcagggaagtagttgctggggtacaggaatgagcacggcgtagggggaatgaatgcgtttaaaaactgggacataggaaacctctatgtggtcttaaatagtggtactgaaatgttctacttcttgggggatgagtccatatgtctgttgtattcttttgcttaataatttgcttgtacgtcaaatatacacttttgtatatattaaataattcataataaaaaaatttcaaggcc

SEQ ID NO: 254074 - DNA, 691 bp, Homo sapiens
attcagccatgaaaagaaggaaattctgtcatttatgacaacctgggtgaacttggaggacatggagtagaataagccaggtacagaagaaggacaattctgcatattctcacttagatgcggaatctaaaaaagttgaactcatagaagcagaagaatggtggttaccaagacaaaatcttgatattatcttggttcttagaaatgcaggatattcacctagactgtcatgatgtggttaaaatgggtgaagatgctgcgtgacacagggagaggcagcaggacttagaaatgtgtaggctttataagtttgtaaaagattaaaatattatcattatttatagagcattacttagtgaaataccagtgagctctctctctctctctctctctctctctctctctctctctctccccctctctctctctctctctctctctccgtctctctctctctctctctcctcgtgccgaattcggcacgagccagtatttgaagtgatgtttaaatatcctatggctgaaaataattccttctaattgtgtggcaatttgcttttactgttttcacagtatttcaggtctttggtcatttactcagtgatactgagcacttaccatgaccacgattttactaggcacaaccatgaattaaaatacaattttcttgcaccattaaaaaaagaaaaaa

SEQ ID NO: 254075 - DNA, 288 bp, Homo sapiens
agacaactcaagttgccccaagtcctggtggtaggccaacaccctcacaattccagaaatgcctccttatcagctgaaagctccagcccattgacaactgctttctgaattctgaggacgctccctatcctgtagcgctgtggatggctcctgtggactccagtttatctcagcctcaaagctaatagagttaaaccagctgctcaatttaaagaggaactgaagcagtgagatgttactgtattctgagatggggctaataaactttaatagatttcagctaacaat

SEQ ID NO: 254076 - DNA, 689 bp, Homo sapiens
ttctctcccttaataaatatattgagcattccaaacatattttaaaagactgagattgttgaattgttttatagtcttgtccttaaaatataaattagtgagtttattatttattctctctatttctcccaagcaaaagaaaatctcccacaatggcaaataaattaatataaggtattttaaaaatattttgtgtggttacataaatcattaacattgataaaagttatataaatcagggccgggtgcagtggctcacgcctgtaatcccagcactttgggaggctgaggcaggtggatcacctgaggtcaggagtttgagaccagcctggccagcatggtgaaaccctgtctctactaaaaatataaaagttagtcgggtgtggcggcatgcacctgtaatcccagctactcaggaggctgaggcaggagaatcgcctgtacccaggaggtggaggttgaagtgagctgagattgtgccactgcactccagccagggtgacaagagcgagactccatctcaaaaaacaaaacaaaaaagttatataaatcaattaacattaatttcatttgtttttgttaggggaagagagattgtttaattggctttaggaaaaaagtcttctttctttgctgtaacagaaaggaacagtgtaaatgtataaattatagttagacaagattatttt

SEQ ID NO: 254077 - DNA, 461 bp, Homo sapiens
tttgagtggcagcctataatgtatatggaacacattttgggaacttttttcccctagaatcatacattttaagaactgaaggatctttgggaatctaatccacctgcctcatttttacagatgagcaaactgatgcccagagaagttaagtgacttgttcaaattcacacagctaggaaagggcaaaatcaagactaaattgtacttctgactcccagttctgcgctcttctcgccataatgaactatttctactttctagttaaaactgtcctcccaattgtttgtgtttctctaaatatgtctctcaattccatgaaacatttatttaaatccaactttactagcagagcacagtggctcccgcctgtaattccagctactcaggaggctgaggcaggaggatgacttaaggccaggagttcaagactggcctaggcaacatagtctctaaaaaaataa

SEQ ID NO: 254078 - DNA, 406 bp, Homo sapiens
tgcatgcttctataatttatttctactaactagacatggacagtatttgcatctgttgaaaataggtaaattatttgttttcttaaattataggtggcatatttatgacaagcacatataaattgtgagtgcacattataaatatataatcctgtttgcagacatttatgggctgtatgctgtgtgccaagctttgtgctgagcactttacagtcattatttcattttatcttcattgctgtcccgtggagaagataaaatgcactggctttcaactttctctttgtaaaatagaacctattttaaaaataaaatatagcacagaaacttcaacatacagaagagacagaagctttgcagcatcctggagatgctcttagcattcctgcctccatctctaccctac

SEQ ID NO: 254079 - DNA, 964 bp, Homo sapiens
atcaaacacttatcctgcactgggcgctgcaccaggccccggagttcaaaggtggccaagatgccacttttgaaaaaaatgttttttgaatgtgttttttggttttgttttgtttttgtggtcattttcttaaaaaacctgggtgtggtcaagagcacagccccctgttttgacgctgcattagtggagggaatgagtttaacgaagcgggtgacttcacctgggtcacctgccaggattctatctggggtcacagttacttcaataaagtgaagcaggaacgaggcagaggggacatgggcctttgtgagaatgaacgatggaaactctttgaactcctgggatagaaaggccaagctgtcactagagctgttcgtgatgggagagtgattaaagctcgttggagtttcctgccttcttctggcatcagaactttatgcctgctctgtgttcggaaccagtgcagctccgagtcctgagctttgacgtgggaatcagatttccctgggcctgagtcagattctgggccccacagaagtcagtggctcccatttggctgagggggttcccaccggaccctttgctgggtagaaaacacagcagccaagaaagatctgttggtccttgagtcagctgttgagaaatggagccacaggggatgctggggggttctccgaagcttgacaccctgccttcagatcctggcatcatcatttggcaggaacacgtgtggcctttcacaagcaacaggatttctttgagcctcagctgtcccatctgtaagatggacatggtgttgccttcccaactggcttgccctgagactaaatttggaaattgccaacattcctcgaatgctccttatgtgccagctattgtggggagggcctcagctcagcccctccaaggcctgatagtttgaaggcactgaggtagaggttttgtgtctgttcctagaattagg

SEQ ID NO: 254080 - DNA, 443 bp, Homo sapiens
gtctcagaggtttagtgcaataaatgtttgtcattttctcacatgacagtgagtaggtgaaggagctctgatccacatggccattcagggtcccagaattcttccgtgtagtggatctacctttctttacaacatggaattaattacatattggattatctgcatctggcagagagtgtgtatgtgttttctcataggccgggactggaagtagagtagcatcatttctgactacttctttttggccagaagtcagttgcatagtcctgtctagcaagggaaactgggaaatagcatgtagctatgtattaagggaagcaataaaattatttgatgaacacatggcagtcatgtgatcctgttaaaacgtaagaatcaaattggtttattgtttaatactttccaatgttttccttctctctctctgtaaaaaacaaaacaaa

SEQ ID NO: 254081 - DNA, 410 bp, Homo sapiens
gccaacatggtgaaaccccatctctactaaaaatacaaaaaattagcaggcatgatggtgggaacctgtattctcagctactcgggagcctgaggcaggagaatagcttgaacctgggaggcggaggctgcagtgagccaagatgatggcactgcactccagcttgggcaacagagtgagactctgtctcaaaaaaagaaaagaaaagacaacttgttaatcctcatcagttttttatattcttctgtgaatgtgtcagattattttgtaggagcaggttttgcttagagcgggagggtagcggcagaaggtacaactgaggtcgggggaaggattccaaaagaagacactaggaaggccaaagatcaaattcagaactaaattttgcctagctttttgagtcaaaaaat

SEQ ID NO: 254082 - DNA, 326 bp, Homo sapiens
ctgggggaaagtttagaaatttctgagaaaaacccataaattgaagttgtaagctgtgaggtggaagccttgcaaatgatttgcagtttacagcagttactcaaagcagtcagattctaactgggggtcaagagagcgtccatgttttacagatggataaactgaggcatagagcttaaagaccggctctttagagtttaaagccatgccatgtcactgatagagactccttcctgggaggaaaaagacaaaagacctctctccagcagaggctagtataacctcagagaaatctatctgaagatatgaaagcatcactaacaacc

SEQ ID NO: 254083 - DNA, 642 bp, Homo sapiens
acctgatccatttaagacggacgtggtgacacatgcctgtaaccccagctatttgggaggctgaggtgggaggatcgcttgagcccaggagtttgaggctgcggtgagctataattatgccactgcactccagcctgggtgacacagtaagaccccatctcttaaaaaagttaaaaataaataaatgaataatccactcaagcttaaatgaaaatgtgtatattaaaatcatatgctattttaggttattttttcataatctttattaacatgtaacttcagttgatagattgatctgtatatataatctataaaaccaatatatgtagtatacacgtttgcacttgaaaactatttactaggctgggcgcgctggctcacgcctgtaatcccagcactttgggaggccgaggtgggcggatcacgaggtcaggagatcgagatcatcctggctaacacagtgaaactgcatctctactaaaaatacaaaaaattggccaggcgtggtggtgggtgcctgtagtcccagctacttgggaggctgtggcaggagaatggcgtgaacccgggaggcggagcttgcagtgagctgagatcgctccactgcactccagcctgggcgacagagtgagattctgtcta

SEQ ID NO: 254084 - DNA, 327 bp, Homo sapiens
atttatttttgacttacctaatttctcagtgatacaggtgttagtatatcgataaactaggagggagaagttttatgatagtctctggggaatagggaaagaaagatgtcttggccgagtaaaagtttactgggattgatggtgtttaggaaatcaaaatagctattaagtgtgtggggttcacaacttttgcaccacacaaaagtgaattgtatggtgaaatttttgtcacttagagtaacttgcttgattattcttttttgcgaatgtctcccttgttggcttttgtggtggtggtctatctttatttcctgttcttctctgacc

SEQ ID NO: 254085 - DNA, 319 bp, Homo sapiens
acagagtccccaggtattgtggatgtaattaaggcatgaggcccaccgaggaacttgctcatcctatcacccaagtcatactgtcactctggagcccaacgtgtgcctccaaaacatcattaaatgtttctacaagcagttctacaccacagcacgaagagaaggtggcacacgtctctagagaagctccacagtatacagcacatctctcttccttgtgaacatgtcagcggccttaagcatgtaccacactgtcccttgaaggcacatcgtatgcctggaggttgcaaggggcactgtcagctgtcagagagcagct

SEQ ID NO: 254086 - DNA, 161 bp, Homo sapiens
taaagctgggggtagcaagctcgatgatttatttggataacctagcagctgccatacctcttctcctggcacccaggtagaatggaaggtaagtcatgttctcatctatgacccatccctctttttgtacttttgaaataaacaggaagggtttttgttca

SEQ ID NO: 254087 - DNA, 494 bp, Homo sapiens
ccactgcactctagcctgggtaacaaaacgagaccctctctctcaaaaaaaaaaaaaggaacagaaaggagaggagaggaaggggtgaaggaaggagggagggcaggaggagagggaaagaaagaaaggacgaaaaagagaaaaacaggaaggaagcagggaggggagaaaaggaaggaaagaaaggagggaagggaagaaagagggcaggcatcatagactattgaagaatttggggtcttggcttctgactgagtttgaatctatgcttactgtgtgccattaggcaagttaaccctgctgtgccccagatccctcacctggaaattagggataattgtacctatcttatatatgttatgtgcttaacacataatctagcatgtagttactggtattatttgagcctaaaccgtgacttagttaatgaatgtcaccctttccttgattcttttgggaaatatttaaaattagtactttgatgtaaaaaaaaa

SEQ ID NO: 254088 - DNA, 448 bp, Homo sapiens
cagaaggtttcaagtcaaaatcctaaccaatctgctttgatctcattgaacaagactcgcttgcaatgaatgactgaagtggatataaaacatgagttcacttatatgtgtcccatgaaacttttattactcatttatccttcttacctagaacaatgaacatcatcgcagtgacaaccatgcagaattagcagaacctgaattactccagatattctcattcttaagttctgctcaggaagtgtatattcatgccaaggccatggcactcagggacttttaaataattctcaggaagaaagaaactgcagagcccaagtggaattctggatataatgaaatgctgccccagcctggtggcttctctcagatctttcctcccggcttgccgcttcatcgtctctgaacctcctgtgtctccttcgtgataaacttgcatttttagaaa

SEQ ID NO: 254089 - DNA, 679 bp, Homo sapiens
tggtgctccccaaacctcgacagtcatcagaaactcccctcttcataaacacatcactgggccccacatcagaactaaccagaatccctaggggtgatccctgcacccctgagtttgtgtagagcatccccagatccctcagatcatcatccagttttagaactccccatctctattagctggttctggtggcaggtgccataaaggtgcccaaccaggtctgggcttacctgacatcttgcagccaggattctgtgtgaagtcagccaaccagagctatcccactgcactgtgagagcacagaggaaagaggctgattctgcttgggaagcagggaaggcttcctggaggaaggggggtcttgaaagatggaagatgggaatatcaggagatggtgccgtaggggctgtgtaggggagtgctgtgcagcagaagagccaagggtttgttcagggggcagcaaagcagctctgggtgggctggagagatcccatatgcaaaggcagagcagagacatggccacagaggcagagagaggacttgaggctctacctcagggcgctggggagctggagatgctgttagacagaggagtgctggggttagatttgcgatgtacaggaatcaccatggaaacactgcggaggataataataaagccagccacaccaagcatacc

SEQ ID NO: 254090 - DNA, 450 bp, Homo sapiens
ccagttctctgatgtatgttcttccctttcctctgctgtttccttcttgttttgttctgttgcccacaacctgttttcacccgtttctctttttccactctctcttttgtttctttcctctcaattcttttctaggtttcctgttggttttcttatctgcctatttcccgaccatcttctcctatttcctggggagccctgaggcttttcttctcctgcccccaagcacctccagcggtgatgagctccacacccccacacccattgcagctgtggcgccacgtcctcccaaggggccttctgcccgcccccgccctagccctagctgtgccttagtcagtgtgtacttgtgtgtgtttgggggagtgggaattgggccccctttctcccagtggaggaaggtgtgctgtgcacctcccctttaaattaaaaaaaatgtatgtaaaaatg

SEQ ID NO: 254091 - DNA, 518 bp, Homo sapiens
tcctgatacctgtattttttaccagaaaaaaattctaacagcagaaaagtcaatgtgatgggttacgcctccttaacgtgccccatttgaccttgtaagcttccttccacaggctgaccttgttttgtgcaatcagtgtgatcttttgtcagctatgcaaaacagtttttgtttactgaatctggtttaaaaggcaagaagttgcttcccatagggcactttgatccttggtgtagggcactttgatcctcggtggaaagggatgtgtatgccttgaaacatggagagtcacatgcgatgcttggttttgtgtagaactaacatgagataatcttttcactggttttcagaattgtggagaattcacttaggaaaataagcatgtgtatcaatggatgactaatatggacatgtactttaactgatttcacagaagcagtgctcctgatattttgagacactaattttatttggttcttctttaccatatgatcaattagctgcttacctcataaggt

SEQ ID NO: 254092 - DNA, 517 bp, Homo sapiens
tcttcttttaatgttaatacttagttatatcccactgaactagcattctaaagaacacactttgggaaatgctgatctcaaatggcatttattcaaccaggactgataatcaacgtgtacaccaattcaattgtatcagctgtttgcaaatggtgattattctgattgatcaatttatatatcccaatgggttgattcctttgctgtattggttgttaatgttttgaatattacccggtattcaagtaatgctcattgaatttcaagtaattgtgattaaacgttgattaaaatccagtcatacttgccagaagcccctgcctttaaacattcttatcctacttcccatttcccactcttctcatttcattgaacgcatagtaaccttccttccccacttcaaagcctatctggaatgcttatttctcttatttctatgggtgactccatatcccgtcagttcacagcttaaatgtcacctcatcggaaagacacccagatcataaagtttcacatg

SEQ ID NO: 254093 - DNA, 3923 bp, Homo sapiens
gtgggccgctcccctctgggaggagggctgcccagaggggtgcgggtgtcgctagcggcccctccccgtgtggggccacgtggcgggtgcgggccgagcccgaggggaagaacctggcccgtggggaggtgggggggaccgaaacggcgctgagccgagccgagagctacggggttcggagcagaggcagcggcagcggcagcggcagtaagagggaggggaggaggcaggagggcgcatggggcgccccggcccctccgacagcgcgccccctccggcccggccgcgctgaaagctccccagcgccgcgccttgaacccacgccccggggccatgccggtcatgaaggggttgctggccccgcaaaacaccttcctggacaccatcgccacccgttttgacggaacgcacagcaacttcctgctggccaacgcacagggcacacggggctttcccatcgtctactgctccgacggcttctgcgagctcacaggctacggtcgcaccgaggtcatgcagaagacctgcagctgccgtttcctctacggcccagagaccagtgagccagccctgcagcgtctgcacaaagccctggagggccaccaggagcaccgggctgaaatctgcttctaccgcaaggatggctcagccttttggtgcctcctggacatgatgcccatcaagaatgagatgggggaggtcgtgctgttcctcttttccttcaaggatatcactcagagtggaagcccaggacttggcccccaaggaggccgcggggacagtaatcacgaaaactcccttggtagaaggggagccacctggaaatttcggtctgccagaagacggagccgtactgtcctacaccgactgaccggccactttggccgccggggccagggaggcatgaaggccaataataacgtgtttgagccaaagccatcagtgcccgagtacaaggtggcctccgtgggggggtctcgctgcctcctcctccactacagcgtctccaaggccatctgggacggccttatcctccttgccaccttctacgttgcggtcaccgtcccctacaatgtctgtttctcgggtgacgatgacacccccatcacttcgcgacacacccttgtcagcgacatcgccgtggaaatgctcttcatcctagatatcatcctgaacttccgcaccacctatgtgtcccagtccggccaggtaatctctgctcctcgttccattggcctccactacctggccacctggttcttcatcgaccttattgctgctctgccctttgacctgctttacatcttcaacatcaccgtgacctcgctggtgcacctactgaagacagtgcggctgttgcggctgctgcggctgctgcagaagctggagcggtactctcagtgcagtgctgtggtgctcacgctgctcatgtcggtctttgcgctccttgcccactggatggcctgcatctggtatgtcatcgggcgccgggagatggaggccaatgacccgctgctctgggacattggctggttgcatgagttgggcaagcgtctggaggtgccctatgtcaatggctcggtgggcggcccatcacggcgcagcgcctacatcgcggcactgtacttcactctaagcagcctcaccagtgtgggctttggcaacgtgtgtgccaacaccgacgcggagaagatcttctccatctgcacgatgctcataggcgccctgatgcacgctgtggtgttcgggaacgtgacagccatcatccagcgcatgtactcgcgccgctcgctctaccacagccgcatgaaggacctcaaggacttcatccgtgtgcaccgcctgccgcggccgctcaagcagcgcatgctcgaatacttccagaccacgtgggccgtcaacagcggcatcgacgccaacgagttactgcgtgacttcccagacgagctgagagctgacattgctatgcacctgaatcgggagatcctgcagctgccgttgttcggggcagcgagcaggggctgcctgcgggccctatcgctgcacatcaagacctcgttctgcgctccgggcgagtacctgttgcgccgtggggatgccctgcaggcacattactatgtctgctccggctcgcttgaggtgctccgagacaacatggtgctggccatcctggggaagggggacctgattggagcagatatccctgagccggggcaggagcctgggttgggagcagacccaaacttcgtgctaaagaccagtgctgatgtgaaagctctgacctactgtggcctgcagcagctgagcagccgagggctggctgaggtcctgaggctctatcctgagtatggggctgccttccgggctggcctgccccgggacctcaccttcaacctgcgccagggctctgacaccagtggcctcagccgcttttcccgatcccctcgcctctcccagccccgctcagaaagcctcggctcctcctcagacaagacgctgccatccatcacagaggccgagagtggcgcggagcctgggggtggtcccaggccccgacggcccctcctgctgcccaacctcagcccagcacggcctcggggctccctggtcagccttttgggcgaggagctgcccccattctcagcccttgtctcctctccttccttatccccatccctgtcccctgccctggctggccagggccacagtgcctcccctcacggcccccccaggtgctctgctgcctggaagccccctcagcttctcattcccccactgggaacctttggacctccggacctcagtccccggatagtggatggcattgaggactctggcagcacagctgaggccccttcattccgattcagcaggaggcctgaactgccaaggccccgctcccaggcgccccctacagggaccaggcccagcccagaattggccagtgaggctgaggaggtgaaggaaaaggtttgccggctgaaccaggagatctctcgtctcaatcaggaggtgtctcagcttagccgggagctgcggcacatcatgggcctgctgcaggccaggctgggtcccccaggccacccagcaggctccgcttggaccccagaccctccttgtccacagctgaggccaccatgcctctctccttgtgcgtccagaccaccacccagcctccaggatactacgcttgctgaagttcactgcccagccagtgtggggaccatggagacagggactgcgctcctggacttgagaccttccatattgcccccctacccctcagagcctgaccctctgggaccctctccagtgccagaggcctcacccccaaccccaagcctcttgaggcacagtttccagtccaggtcagacacgttccactgaccctggcccagggcccaggcctgtctggggtgggcgctgccgctcaccactcagggaggacctgggccccttggcttcctgccttggggtcagcagccaccagctggcctggttggctctggatttctggactttttaatgaagcgtggttacctctgacgctattcccttttccaagccttccccaacctccccctctgtgaggggagccacctgagggctgtggaacccagcaggcatgagatgaaccgcagtgcccattgggctgggcagatgagatcctactttctccccaggacctggaggcaggctgtctctcaaggtggtcttttctgctgctagcaactcaaaaatcccaacagcactccctatcctttccctgaccccagaccgctgccaagcctgttctcccccattacaacatggtctcactcagggcctggactgctccaaaactcgcccaggtctccagctctcctctaccccccaacaccctgggctcacttttggataggaaataaactctttatttttgt

SEQ ID NO: 254094 - DNA, 769 bp, Homo sapiens
gaaaaaaggatagcaggaccctggaaacctttacaactgaggacactaacagcccttactgctgttgcttgctgcaacaggcacctgcagcctttgccactgaataccacagagtcttcgccaatgctcatcctagctgacagagctgcccaaagtccatagcactgtgccctccagagccagagccatcactgctcctttcctgggacctgagtcaccactatgcctcccccagggctggagtcaccaccatgtgcattcttgcaccccatcgcattgtatatgtacccaccaatcagacccatcactaatggtggccatgtgcccactggccagacctagcatcaccatgtgcacccagaaatggcacctctgcatgccttagaatcagcatccctggaccttgtgccaaacccagcactgctcacgccctttccagccagtgcccttgtgcccacccataggtaaaggccttttcctaccaaagctggtttgtaaagtctggaagaggtggctactcctttatgtgaaggcacaaggcaagggtaaaaggtgcaccaaaaaatcaaggaaacatgacagcaacaaattaacacaataaatatctagtgaataaccccctcaaaattgagatctatgaatttcctgacaaagaattcaaaatatcattttaaagaagctcagtgagttacaagaaaacagagttcctgaactcaggaaaagagtacatgaacaaaaggagatgttcaggagatagaaataattaaaa

SEQ ID NO: 254095 - DNA, 466 bp, Homo sapiens
gtcggtacccgattgagataagcacaaagtacatttctcacaagatttgcttttttattcaagtttactctctactcttgtgttgactatattttcttattttctatatttttgatgctctggcatttggggccttgatcccagagaggctgcccctcccagggctacttaattctcagagatagcagatggctccctgcgagtgtgcctctgatatatgaaccagcaaatccagagctcacaccccctcgccatctcctttatcaaactcacacaccaaaccaatatttccctggccttaatagagggccgtgcacgaggaaccaccccatagctcagagcctgctaaaatattcaaactgttcaatcctaaacttccccagtgtagctacgctgcatcacccattcttccctgcaaaaccccactaaagactctgggccatgctccccactcttcctcttctgc

SEQ ID NO: 254096 - DNA, 389 bp, Homo sapiens
agtagatgtgctgagaacagaggccttaagtgtgcttgcagggtttggcttggctcttgcactgctcctatttgccaggaataaaatgtattccacatagtctctggtccaaggaggattagaggctgctggagctgacctaaaccccatgcacagcctccgtgggagctgcccagccagtctgtagacttgtgagtgagaaactacataatcgttttgtgagccactgaacgttaaggcagttttgttatctatatttttttattttattttattttattttttttttttttgagacaggttctcattctttttcccaggctggagtgagccatgatcgtgccactgcactccagcctgggtgacagagtgactgacagcttgtcttt

SEQ ID NO: 254097 - DNA, 189 bp, Homo sapiens
tgcccaagttcttagatatagtaagtggtggagctggaattcatactcagttccattagatcacctcactgtactgttcagagacaggggcatgcattttctggtttgaatctagacggtcattttgtacatacttggtaatgtcttctagttcatttcttagttttgtagtttgcttattatcttgta

SEQ ID NO: 254098 - DNA, 308 bp, Homo sapiens
gttgacaatgcaagactccgtctcaaaaacaacaacaacaaaaaaaaaaaaaaacaaaagaaaaaaaccaacgaatacctatagtatcatgccacacacgcaatgatctaaaactctgttaggagaacataagtaggtggtaaagctataaagaacaaggaaattattatcacaaaactcaggatagcgggtacctctcaacggaagcgagaggattgcgctgggggatcacctgggggtcgggagtgttcatgttttcttgacctggggaatagtgtacatgcttacaataaatgttttacattgtg

SEQ ID NO: 254099 - DNA, 361 bp, Homo sapiens
gacgcgctcccgattcctggtttccatttgcggagaatgcagggcttcctcttggagttaaagactcattggctcctggaaagccctcgctctccgcgccccccgcggacttagctgtgactgtccttgcctgtggagcagaaggcttgccctcctcaggggccacccgagaccgccaggatggagtaggatctggaccttcagtctgttgaggagccctggcccggggtagccattttcaagggcgagggaccttggtgggagtacgatgaatccatccatacaataaacatccattaagcacctagtacatggcagcggggggcagagggctggaaatattaataatactagtaaaact

SEQ ID NO: 254100 - DNA, 494 bp, Homo sapiens
ccagaaagtatgtgggagattatagacagagaggcatttaggaagaggaccctttaaagtggcttatgaactcctgggctacacccccatgaactgtgcatgagtgaacttggctaaaatattatatatagactttgagaactgaactatgggctataccacatacctaagtactaaactggctactgggtggtatacatgtgagacaggcccaaacatcactgcagaggttttgaaaattgagctgataatagaaccacaaccctcataaagctagtttaaacatgtggactgaaaccaactgggctacttacttattaaaataaaaacatagaataagcaatgaggacttaaatacaaccagagtgttttaaaataatactgaaaatgtccagggtacagtccaaaattacatagcatacatagaatgaacaaaatctcaagccatccagaaaaagacaattaatggaattcaatatctagctaacatgaca

SEQ ID NO: 254101 - DNA, 340 bp, Homo sapiens
taaattataaatatttttaaaaattccaaattatgaagttcgaaggggatattttatatctctcagccactgtcattttcttcctcccttccttgggtgttggccatgtatctatgagtccagttggtaaaacaatcagtagcattgacaggatgatgtactctggtccgaaactacatttctcagctttttcagttctcaggagacagcggaaaatgtacttagcaaactctattataaaggtccatgttgttccaaatatttagttgtacttaaagtaaaatcatgacttcagatgccaagtgaaataaagcataattttcacactgtatgatggaaa

SEQ ID NO: 254102 - DNA, 224 bp, Homo sapiens
tccctccatcccaggaaccccaaagccagttaaacatttaccagctggagctcaagattgaaccagctcatcccatctgacctgtcccctagctgcccacccgggtttatttcagcccaaagctgaaatttccactcttcaacaaaggaactcttaggttataacttaaatagattaagccagtcaccatcaggaaaattaaattcaaaactgcttattcctca

SEQ ID NO: 254103 - DNA, 353 bp, Homo sapiens
gcacttcttcccctctcctgccgcctccttcacaggccccatttcaggcataatacaaaggaacagggcttcctgcttgaaggtgctgatccagggatcaacaggactgatgacgttgctctcctcaaggagctgacactgcagcgtgaggggacaaattcagaggacaaattccgatcagtgttccctcttccagcacacattcactgaggtcctattgcatgctccagacatggaagcacggcagggagtgaagcaggcagaggtctccattcttatgggatgatagtctagcgggggagacagagaaaacaaaagtaaaacataaacaaagctaattaacctgaacccag

SEQ ID NO: 254104 - DNA, 548 bp, Homo sapiens
accatattcagagtgttcctcagcatccactctgtgctaaacgcttttcgttcaccacctcattcgaccttcaccctctgtggctgaggctaaggtcacccacatttcacaaatgacaaaacagcctttgaggcttcccctgacttgccccaagcaggggatcctcagggacaagggggttcattcatccataggcatttggagataaacacattcaagacctcagagatgctaaatgtacagttgagatttttcttccatcagaatttctagaatgtgttctcaatcaaattcttattttctgtgagcatataagaagtcaaacctcccaaaattagagcagagacatgggctatccagtagacatgggctacaacatgtttggagtataattggtttattcatagacttaaccagagaaatatggaagtttcgcacacttctccctgttcaagccaatggtgacacatacttagaatataatttcaaatcacagttttacgtatgtgcatggttgtatttgtatttaacaaataacataataatta

SEQ ID NO: 254105 - DNA, 360 bp, Homo sapiens
aaaaaattactactttatgaagaatgccctttcagcttagcgtaaaattagtaatctcgtaatgatgctacagctgatgttttgagtgcttactgtgtgcctggcactgagctaagacctttatgtgaagaatttaacttcatagtaactcctcctagaacctatttgcagatgaggaaatttaggtgttgagggcttaagtaatttacttagatcacacagctagttgcaaggttgaggtaggatttgaatccaggtttgtcccaactatagtgcctgtgtgggatgccacagaggagtttctttaatctgtgtttctctccttaaaagcttaaattgtaaatgaccaaagaagtgtca

SEQ ID NO: 254106 - DNA, 204 bp, Homo sapiens
ggcagctgtgagcccagcacatcggatccctggggctagagccgcggagccaatgaactcaggtgctatgggccgggctggggcagagggtgcatgctggggtcccaccggccaggggcccctgacagtgaattgctgactgtgatattccacgatgcttttgcttgtgccgtgcttgtctgctgggctctcgagtcaggggcc

SEQ ID NO: 254107 - DNA, 250 bp, Homo sapiens
gggaaggagagggcaagacacacagtcacaggtgaaacccccaacagcaatgaagtgtgtcctgcaaggaggggacccgacattgaacccctgaccccgagtgggctcctgccctgcctcagggcagctgtgatgatgctactgcaaaagcttctggaaggcctgcatctaaccagtatcccttgacgtaaaggctctcgttcccactgtgtcaaaagagatatgctacaatgtacaggcccacacttgt

SEQ ID NO: 254108 - DNA, 437 bp, Homo sapiens
gccttgtctacattaaagagcaagaaggcctcttttggtaaggagctaaccatgtgataatctgaggaaagaccattccaggcagatcaatcagcaaatgcagagactctgaggtgagggagggtcagggaagagaggatagaacatgctttcaagagagaggcagggccaggtcacagacagtgataacatttatctggacttgtaaaagttacttagctgtgcagaatgtagtggcaaggcaagcataaaagcaacaagccactaaagaagctgctgtggcagcccagttgagagatgacagtggcttgggtgagccttgtgacagtggaggctgtctacagaagctgggtctgcaatatattctgcaagtagaactaatagagttgttgatggaagggacatgagaggcatgggaaacagagacttcaaagttt

SEQ ID NO: 254109 - DNA, 231 bp, Homo sapiens
agaaagtcattaagggtaactccttcagttctgcctcttactagacaagtgcctttgggcaaactacttaacctcgtagaaacttaagtttaaataatgcttcacaagtctgtggaatactttcatatatatcgcttacatcattttatttgatcctttcaacatgcaaggttgtatacaagttttacagttatacctggttttttttttaatggacctcagaaaattgag

SEQ ID NO: 254110 - DNA, 622 bp, Homo sapiens
tgctggaaatagtaatctccaaataagtgagatatctttgtgtttataaatgtgtctacaggttcatagtgccatttccatgaagactgcccaagcatgtttttgtctagaaagtggtagatagactgtaactgtgccattaattacttactgggtaatcaaatgacctgcgctcaagttttaagtttcaaatgtgcctgggattcagtctccagtccctcgccattgttgttcaatttcccctcacttctctgttctcttctatgcctcaactttactgattttttaatgctgaaaacaaaaatcatttaatttcctgactctaaccatgccctaagtgtctcatcttccaccaaaagcagctaatcaaggtactttgatagacaaaagatttcccactctgggaggaattttcatgctagctgttgggttagtctatgtatttcttccctctatgattaaaacagaaacgtgggctgtgtgtggtggcttgcacctgtaatcccagcactttgggaggccaagaggagaagaccgtttgaggccaggagtttgaggctgcagtgagatattgtcatgccactgcactcctccctgggcaacaaagcaagaccacatctct

SEQ ID NO: 254111 - DNA, 474 bp, Homo sapiens
cattttaatttttgtgttctagtgactgtggctgctgggtagaggagaatttgtatatgtggaaaatacaagcattgtgactactagttacagtcaccatcttactggtaactgtgacaaatttcaggaaagaggatcatgatagatatgggggtgatgatagtgataatcttggagatttaatagaagaaatttcaaagtttagcagtgaatgctgataactctccggtttacttttgggaggaaagacagggattagaggaagtgaggaaaaggaaaaagtaacccctgcaggaaggatcatcctggaaaaaactgtggcgtggattcagtgtgtactcattaacttcttacctttccttgtttgtattgttcttcaggttcagaaatcaacaccctatcaccactaccaaaatctttaggcactgtattagttattgattgctgcataataaattactccaaaatttcatg

SEQ ID NO: 254112 - DNA, 495 bp, Homo sapiens
acctatgactgctcacatttttcagattgaatcatttcaattgtattttaaggttcattgactcttttccacctccaagctgctcctgaacacaactgattattattttttaattttgaaaacgttctcacttctagaatttccacttgagcctttgttattattgtagtttcttcttctctgctgtgatttcctatccatttattttaagggtttttggggttttgattttagtaagaattacaataactactttaaaaatccacactaattccaacatctgggtcatctcgaggtcagtctattgattgcctttttctttgaatatgtttctttatacatttgttataatgggattgaattctgaagattgtaaaactagattttgttttgttcctctgaaaattttgataattttttgttgtatttgttgtattttgtttttttttctattgtatactttacaatatattttcctccaatggttttaacata

SEQ ID NO: 254113 - DNA, 923 bp, Homo sapiens
  misc_feature (59)..(60): n is a, c, g, or t
atacagaggatatgaagaaggaagattggctaaccgctaaaacagtgagttcgatagannacgttttcattcatgcactccagcctgggcagtgaagcgacattccgtctcaaaaagaaaaaaaagaaaaaaaatgtttcaaatctcccatatactacatcagtggtcttcaaactcttctgttcctagacccaaataattgttttttaaattatgtaactccctgcacatctttaaatagacatctataatttttcatcataaatttgttccttatttcttgttaacagcagatagaaacagtattttataagatgaaatattgtgaggattgactgcaattggagtatttcatggtatggcttgataaaataagttttaactaccttatccataatacactctgatcctcaaataagtaaaattttaatccatgtgttttgaaaacccatggattaaacacacagattaggaaggagtacctatggaatgtgaagacctggaaacggattgcctaagagttatccaagcaaaaaagaaaaaaaaaaaaaaaagaattatccaagcatatgcactccttagagattcctcgtgccccaaagtgaagacttccatactataccatgccaaagagctcctggataagttttcctgactcataacacaactgttcttcctattcttctgtttcaaagaggaaacagagcattttagtatatttgaaagaatacacatcactaacgcctggtgcttcagtgtttccaaatcaccatgctttccaacatgggctaaaatacagtagcccccattacgtgtgggggatatgttctaagacccccagaggatgcctgaaaccacagatagtatcaaaccctatacagcccatcttttcctatatgtatgtgcatagatacctatgagga

SEQ ID NO: 254114 - DNA, 1617 bp, Homo sapiens
caattcagctcctattgctaaagaagcagtgtggggtagaagagagaaagacctggatttgaattaatccttacctgatcttgggcaagaaacccagcctatccaagtctcagcatcctactctgcagatatttttactgaagtatgaaaattataaagtttaggcaggagcttaacagatggtagtatattaataataatgatgatcataataataaccatatgcctagaattgtacaagaccattgaaagataccaaaaaataaaaatgtagaagaaatggctgggcgcagtggctcacgcctgtaatctcggcctcctaaagtgctaggtttataagtataagccaccatgaacagccacaaccttgatcttaactataggttttgattcaaacctctaccatcctcaaaaatatatgactaaaatttatgaataaattatgaataattataaataattatgaataaaatttagctgaaatcagaatgacatgggttttaaaaaatgttttcaagtcgccaggtgcggtggctcatgcctgtaatcccaagcacttttggaggccgaggcaggtggatcacctgaggtcaggagttcgagactagcctggccaacatggtgaaacactgtctctattaaaaatacagggaattggccaggcgtggtgcacacgcctgtaacaatctgagctactagggagactgagacaggagaattgcttgaaccctggaggcagaggttgcagtgagccgagatcacatcactgcactccagcctgggcagtgaagcgacattccgtctcaaaaagaaaaaaaagaaaaaaaatgtttcaaatctcccatatactacatcagtggtcttcaaactcttctgttcctagacccaaataattgttttttaaattatgtaactccctgcacatctttaaatagacatctataatttttcatcataaatttgttccttatttcttgttaacagcagatagaaacagtattttataagatgaaatattgtgaggattgactgcaattggagtatttcatggtatggcttgataaaataagttttaactaccttatccataatacactctgatcctcaaataagtaaaattttaatccatgtgttttgaaaacccatggattaaacacacagattaggaaggagtacctatggaatgtgaagacctggaaacggattgcctaagagttatccaagcaaaaaagaaaaaaaaaaaaaaaagaattatccaagcatatgcactccttagagattcctcgtgccccaaagtgaagacttccatactataccatgccaaagagctcctggataagttttcctgactcataacacaactgttcttcctattcttctgtttcaaagaggaaacagagcattttagtatatttgaaagaatacacatcactaacgcctggtgcttcagtgtttccaaatcaccatgctttccaacatgggctaaaatacagtagcccccattacgtgtgggggatatgttctaagacccccagaggatgcctgaaaccacagatagtatcaaaccctatacagcccatcttttcctatatgtatgtgcatagatacctatgagga

SEQ ID NO: 254115 - DNA, 252 bp, Homo sapiens
gtcatttgtatctgaatgtagaaagtttgagtactaagaagaattattctagatgacatcataaaagtgaattatattaaaagtaaattatataagcttgctaattttatttatattatatttataaatataagtatgtttataaaatatgtattttatttatattatattaaaggtaaaggcaaattatattatgtaagcttgctaataattatgtttatatttataaatataataaatatatttataaaa

SEQ ID NO: 254116 - DNA, 481 bp, Homo sapiens
cttcttccatagattttagcctgaaggattttgaacatctacacacacttcaaggattctactgatgtcatcagtttcttgattaatattgtctcactatgtgggcttgctaggtttttctacagaggctatatttcgaaattcctttaattttggttattggtagtttcttgcttgaactgggattcatatttctccccgctgagaataaaatttgttctcagaataaagcatatttgactctttctagctgccaaaatgtgaagtcttgtggttaggtattttggaaaaccggcaggttttgtttacatactgtggtctttctccaaatttatcccacatcccacaccccacaagtctaggaccccttccagcgtaattgctgtgggacaagtgcaaggcaaaggcttccgcagtcaccaaatcctttccatctttgaatcagacacagcaagtaccagaagagcttcccctgcttaaa

SEQ ID NO: 254117 - DNA, 503 bp, Homo sapiens
gaggccacgcggagggatccatcctcagtacccctccaggtgctgtctgctctgctggaactcttactccagtcactccacgtgtacattctggctctggtccccaggggtgtaacaccctgtactggctgcaggggggtgggcagcacggtgtggaggaaggtgaggcggacctagatcactgtcctcaagaatctagcaaaaagtaaacagaccagatccccaaccttgggaactcttgctggggaagagacagaaaacataaaaaccataaataagagccaggtgcagtggctcacgcctgtaatcccagcactttgggaggctgaggcgggtggatcacctgaggtcgggagttcgataccagctgacgacatggagaaaccccatctctactaaaagtacaaaaattagccgggagtggtggcacatgcctgtaatcccggctactcaggaaggctggggcagggcattctagcctgggcaacaagagcaaatctccg

SEQ ID NO: 254118 - DNA, 650 bp, Homo sapiens
tgccctaaataagtataggctgacgatcatgagtgagctccaggtctcagggattatttaagagccatcacagaaatgatgcctgagtagagtagacggttggattaaagcgtctgtaagtttccttctattctaaaaccaactggttccatgaacctctgagttgtagcctgaaacactggccacgggaccaatatttttgacttgcattcatctcttgctcctcacccaccacattaacaacataaaaccctcattcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattggggccgaatttggggttaattggcccatttccccttataggggggggttaccattcaatggcccgctgtttaaaaccgtcggacctggaaaaccctgggggttccccacttaaatcgctttggaagaaaatcccctttttcccaattgggtgtattaccacaaaaggccccgcccgaatcggcctttccaaaaagtttggccacccttgaagggcaaatgggaatttggaagccggaaattttttggttaaaatctcggggaaaaattttggttatccgcctcattttttcc

SEQ ID NO: 254119 - DNA, 876 bp, Homo sapiens
tcacacaaactggcattgaatctcagctttggcactttccaattttgtaattttaggcaagttactagaactctttaaggctcaattttcttattggtaaattaaggataataactgcttcacagggttgtcatgatgattcagcaaaatcatcaataaatatcaataaacattgtcaatgttgatgttattgttatcattattttggtgttgtctaattaacatgacatatttattagagtttcctacaaccttataaagcaatttttaagaatgtcaactacttaagtaagagctgtccttttacaatataaaagattcattaaatgctgaaaaagacgcagcatacctatttagataaaatatcaaatgttacctttttgacatattaaaagtgatcataaaatcaaaaaattataaaaccgtgccttctagtaaataatcacaggtttagctgtattttcaaaagtgcgcaaatctgtactcattaggagaacatattgatttgtgtgcgtatttcaagcaaccattttacgcatgcggagcccatggccgacagcattctcccctgggaaggtggcttctctaattgcagtgaatggtgattctatttgtagacatattttcctatagcaagcattcctttctgtgattattatttaaaaatacttgtccttaaattatttagtcttcttggctataaaggagaaaaatctacagcactgcaaagacctcacagataatataagtctgagtagaaaatgcatattaagtcttaccaacaaagtaatctatgtttcctgcaatacagggaccacaagaagcattttaataataaagatcctcaaacaaccacttaggccacataagaatttg

SEQ ID NO: 254120 - DNA, 349 bp, Homo sapiens
aatttagatgtgatgtttgtttcgagctctcgccttgcgcacggttaaagtcgcggcggcagaattatcggaagattcctgcaggggaaagaagagagagacgagtcagctccggcgccggcggagccccggctctcggcacctggggaaggaaaacacgccccaacacacgcgcctctgcgggcgccaaaaataacccgcgcgggccgggcgcccaccccggggcaacccgcgcccacctcaggggccccaggcacccaccccgaggtaacggggcgcccacgtcaggggctcggggcgcgcttccccggggctcagagcaactggggtcggagcacccgccacgcag

SEQ ID NO: 254121 - DNA, 449 bp, Homo sapiens
ctctgcttgcagaggagaaacagtctgccctcctctgacctctcctagggagagagccttgccaggtgggttccagagtcaattgtgtatgattgtggctgttgaagagactcggagaagttgtgagagaccacccagttttacatggaaaatatcagagagctatggacaagagaaaagtaacagatatagacacggggaagagaggcagagaaaaaaatcttgtttgagagatctgtggagcataggagggagaggagaggctttggcggcaggtgcagtgacaattgaatgcacacacacatgcacaaataagatattaatgtagagagaaagtggcaggaggaatggtttcaataagttttgctgtgtgttatgagtgggatctctttgggtaaatttcaatagatttcaataaagatataatttgcttattggctatttttgac

SEQ ID NO: 254122 - DNA, 730 bp, Homo sapiens
cgtctttagaattatgtggcaaatcccttaatatgtgatttattccacttaaatatgtttttagagtaggaccataagagaaagtaaaaatagaagatttaaggcaaacttattaggctaggaccagaggtattgcatttaaaatttttatttaaaaaatttatggattcataatagttttacatattcgtggatattatattttatagttcaaaccaggatgtattccagattactgaactaaagaagcattgataaaaagaactattaagaggtgttgatagggttcagtaaaatatgtcttataaggtacaaatattttagtataatgatttttgaggtcttgaaggtcaccagaaaaaataaaaatataatgaaaaccttaaattttggcaaatttaaacttaatgctctaaataataaatatttaagttgttgaacaggggaatggaaggatagtctgaagaatattcatttgataccattttgtgggcagaaagagtagaaactgaaactaggtaaataaactaggaggctgctaagttggtaagacactgtgtagtgaagaggactctgaactagaagttagaaggcttttacttgtcttctcagagtttcagtttcatcaacgtttaagtgaagataggaaggtctatgtagaatgatccaaggtggttgtagccattaaatagaatgcagtgtgaaaatgttttgaacattgtaaaacact

SEQ ID NO: 254123 - DNA, 367 bp, Homo sapiens
gttctcttctttctcttcacacaccctgtcctttgcatcttcttatccctttgccaatactctaataaccatttgttattttgaagacaaagtgttccttgtttttctattcccttctgtctactattgtttcactcttttgcttatggagagatggtttgcaagttttccaaaagaaataaattattccacaacgggtggaaaacctttagtttggacataagtttctagctgaaccctaagtcattatttgcaggaggtgaaaaggtatattttggagaatttttatctccattataaagacagtctggaggctccacctcatctcatatgttcttgacataataaaaattagaactgtacttaa

SEQ ID NO: 254124 - DNA, 797 bp, Homo sapiens
gagcaagcggccccttccttcggccccgcccagccccgccggccgcccgctccctggggaaccgagggaggaatgggcggggtcctcaggtgcccggcgacgtcatccagcccccaaggctccaggacgcaaagggtcccctgatctggcagtccctggacctaccctggagagcgtggggggacaaaggccggacgcgccgcccgctgccgcctccaggaagccctcccttgccaggacagtggagttggccgggtccttccaaagtgcctacggaaagctttgtcccatccttgaaaaattgctaatgggtttggagatacgaggtggagatgactagcaatcaaactcaaaggtggaagtcacatcgaggcagatgagcagatgaggggacctagagaagaagagaggtgcaaggagagcccagccagcaggaacatctgccccagtaggcagcactgccccacatcagagtcgaggaaagcaaagctcggattggataaaagaaacttgcaaacacggtcagtgcttactgcatgtgggctcagagcacgttaccctccttccctgcatgttcctgtgaaacgggtttactgctctaactctcagggacactgtgaagaccaaacgagaaaatagaaacaaacataatttataaaccataaagtactgacaccaaaagaggggcgagcacagcattgtgaatgtgctggtactaaatggtttgttttaagatgattttatggtgtgtgaatttcacttgaataaatttttttaatggagttcatggggacgct

SEQ ID NO: 254125 - DNA, 1842 bp, Homo sapiens
gagcaagcggccccttccttcggccccgcccagccccgccggccgcccgctccctggggaaccgagggaggaatgggcggggtcctcaggtgcccggcgacgtcatccagcccccaaggctccaggacgcaaagggtcccctgatctggcagtccctggacctaccctggagagcgtggggggacaaaggccggacgcgccgcccgctgccgcctccaggaagccctcccttgccaggacagtggagttggccgggtgtggacagcaggaagggccggcgggaagggggggtggaaagagccactcctggttaataactctgcggggttaacctagggccggccatactcaagtacggacttgagtaaaattcagcaggaaaaggagcagggtgggcgccgctagagggaggcttcaggactgagggtcagaggcccaaggcctggcagggcccttccctggtcagctccaggcttggcctgatgcccggtgggccacgggcctcttccagcctcaggctgaccccagagaaagaggacagcccacaagcccgggaggccggcttgctgcctggtcattgctgcagagcctggagggggcctgcgctcagtccccgctgaccgtcccctcccttgaccctgccatagccatctgtgtaacccaggggaaattattccaaagggacttccacttctgataatctatgattctattttctaaaaaacaaaactctaaaatgcttaatgtcaaacatctgtcatcagctgaacaggaaaaggaacagtaagtacaaagcaaggcaacatcagaaaagggagccgccctgaggaactttctccctccttcctggccgggtgaggccggactgcaggcctgactcacagggtttatttcacttattaacctaaagatgggaggatctgctggttctcccccaggcctggaggctgcctaccatcggtggctctcatcggtgagctgaggccacagttgttatagtctctgacttcaaaagaaagaccgatttcatgaacaattgcctgtctctctcgacggtggcctcggttttttgttgttgtttttctgtttgtttttgagacagagttttgactccagcctgggcgacaaagtgagactccatctcaaaaaaacaaaacaaaacaaaacaaaacaaagagttactattcagaatatattaagaattcctacaactcaacaacaaaaaaaaatccaacccaattaaaaaatgggcaacagacccaaatagacatttcttagaagacacacaaatggccaataagctcatgaaaacatgtttaacatcactaatcattagggaaatgcaaatcaaagctaaaatgagataccacgtcacactcattaggtgttattttttaaaaataacacaacaacaaaaaataagaaatgtgggcgaggatgtgaagaaattgaaacccttgtggactgttgttggggatgtaaaatggcgcagctgctggggaaaacagtatgggagttcctcacaaaactaaacagaattgccaaacgacccagcgatcctgcctctgacatatactggaaagaactgaaataaggcgctggaacagacacttgtaacccatgttcacagctgagccaaaaggtgggagtaacccaaatgtccatcagtggatgaatactggcaataaaagctgtgtctggaggccactccgtttcacacagctctccacacgggtgagggcacagccttctcgtctctttcctatgctgcatcttcagagctagctatgatatgatatgatgtgatatgtacatatcgaatatacatgttttacatgcaaa

SEQ ID NO: 254126 - DNA, 780 bp, Homo sapiens
ggagcttgggagtggaagcttttctcatgcttgtgatttggtgactcttctaaatgctgattcattagggattattacagcggatgtcaactggttgtggtgatggggtgggggcagaacatgagtagcaaagaaaagggagagacgaaaagggtacaggctcacgtaaagtaatgaagcctttcccaaccaggatggttcacaaaaaagctgtgagatccacagttacaagtgacacgcatgcacacatggagttccacatggggtactgttgaatggagcacactgatgggaagcttccctctcccaggccccctcaggagaaggtggaagagaaagggtgggcgtgggtggggaaggcagagatctctgttattctggtccatctaatgatgtaacttctttcagttattattttagctttaaaaggaaataaggggttcagatttgaaagggggtggtatgggtgggggaggggaattgccaacaaaagaacactgattgtaatgtgagaaaagtgtatttttgtattttaataaatattgttgaatttttaattcaatgtccccaaagggttaaattgagtaagaccctgaacctatagattcttatgagccaatcatttctatttaataaaaaagcggggaggggagggtacaggtatgatgggggaaagacaaatgttaaattattttcaagtatgggaaaatgctaaagctgtcaacctttccttagcttaaataaaagcaccccgattctagtgcaccttctacaagctaa

SEQ ID NO: 254127 - DNA, 421 bp, Homo sapiens
cactctgtcacccaggctggagtgcagtggcacaatcttggctcattgcaacctcgcctcccgggtttagcaattctcctgtctcagcctcccaattagctgggactataggtgcatgccaccacacccagctaatttttctattattagtagaaacgaggtttcatcatattggccaggctggtctccatctcctgacctcttgatccacctgcctcagcctcccaaagtgctgggattacaggtgtgagccaccatgcccagcctaaattagctcttctaagtctgacatatttatccattcctgatgtggagcacaaagattattattatgttagtctcttcctcttccatttccaccccaactgggtgtactgcataaaattttgacactaattatctggagttagcacagaccccg

SEQ ID NO: 254128 - DNA, 544 bp, Homo sapiens
catgggcaggaccccctggacctggcctccatagccccatgccagccggggtgccaggtgcagacccctggcctggtgacagctcagacagtgccagaaagcccaggagggtcggaccctaggggacggcagggtgcatctcaggaaaggtttaaacactgtagcacacccaaagaatggtgtgagcccagaggtttcattcctgaagacatcatggccaataactgagatccctgagagctggactctgggcgccctcagtttcgatgtcttggatgcgaatcaggccacagaagtgcccttatctccaccactgtgttctccatttatccccattgaacttgccaagctcagcaacagcctgcaggacaccaacctcacgggctgggtctacgaccccgggcagcttctgtgcgggttcctggttcctccctttgtgcctctgggctgcaccagtttgaccctgatgtgaaatctgatgcctctgtcagtttgtacaatgcggtttacaataaagcatttgacagcaatgcttaatttacca

SEQ ID NO: 254129 - DNA, 528 bp, Homo sapiens
ttccacctagaactccagctcttgctctgcaggattttcaagagacaaagaatacgtctaagattttttttttctttcatgtttttatctttgtcaaataagcatttctgttggaaattatagacagggttgttaattataccatgtatggtactatacaaacaaattttccttcctactttctaagcatatggcctggaccaacttttatcttcagttaattagatttgctgaattttaaagcatagggtgcacaagctttttacttttaataattaaattttagaaatgtgaggattttgaaggaagacaggatatggcagatataatacatgtttattgggctctggtgtatgtacatataacatttcctatactctgttagtggtattagaggccaaattgttaaaattaatcatataactagaatgaaactgagaaggtttgggatacagaaaagcattccctctattttctcacctaatttttaaatttaactgttaaaataaaactgtgcttttctccatc

SEQ ID NO: 254130 - DNA, 1923 bp, Homo sapiens
agcctgccgcttccggctctggcggggggggcacgtgccccgtcccgttgccccggcgaccgcggcggttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 254131 - DNA, 1725 bp, Homo sapiens
agcctgccgcttccggctctggcggggggggcacgtgccccgtcccgttgccccggcgaccgcggcggttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 254132 - DNA, 1949 bp, Homo sapiens
agcctgccgcttccggctctggcggggggggcacgtgccccgtcccgttgccccggcgaccgcggcggttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 254133 - DNA, 1673 bp, Homo sapiens
agcctgccgcttccggctctggcggggggggcacgtgccccgtcccgttgccccggcgaccgcggcggttgttctcaggccccggcctttctcaccgtgcgacgccccaacccgccgctccgccgcggtggtacgctccaggccgcgaggcccaccgagcggacgccagtggatgacccgcggcgggggaggaggagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 254134 - DNA, 1785 bp, Homo sapiens
agcctgccgcttccggctctggcggggggggcacgtgccccgtcccgttgccccggcgaccgcggcggttgttctcaggccccggcctttctcaccgtgcgacgccccaacccgccgctccgccgcggtggtacgctccaggccgcgaggcccaccgagcggacgccagtggatgacccgcggcgggggaggaggagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 254135 - DNA, 1811 bp, Homo sapiens
agcctgccgcttccggctctggcggggggggcacgtgccccgtcccgttgccccggcgaccgcggcggttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctcccttctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 254136 - DNA, 1552 bp, Homo sapiens
agcctgccgcttccggctctggcggggggggcacgtgccccgtcccgttgccccggcgaccgcggcggttgttctcaggccccggcctttctcaccgtgcgacgccccaacccgccgctccgccgcggtggtacgctccaggccgcgaggcccaccgagcggacgccagtggatgacccgcggcgggggaggaggagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 254137 - DNA, 853 bp, Homo sapiens
agcctgccgcttccggctctggcggggggggcacgtgccccgtcccgttgccccggcgaccgcggcggttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggcccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 254138 - DNA, 2017 bp, Homo sapiens
agcctgccgcttccggctctggcggggggggcacgtgccccgtcccgttgccccggcgaccgcggcggttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcaggtcctgtaagcccgaaacctcaggacccccccaggaagacaagagcggctccgaggacccccctccctagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagtctggaaggcaaggtcaaggagacagtgcacaatgccttttgggaccatcttaaagagcaactatcagcaactccccctgacttcagctgtgctcttgaacttctgaaagaaattaaagagatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 254139 - DNA, 2198 bp, Homo sapiens
agcctgccgcttccggctctggcggggggggcacgtgccccgtcccgttgccccggcgaccgcggcggttgttctcaggccccggcctttctcaccgtgcgacgccccaacccgccgctccgccgcggtggtacgctccaggccgcgaggcccaccgagcggacgccagtggatgacccgcggcgggggaggaggagataccatcagcaaaatgccagacgtcaaggagagtgtgcccccgaaatatcctggcgactcagagggcagagaacgtaactagtcatcaaactgaggagctgtccgtgtgcaacaactcaagataaaattcttgactattgaaatgcgaaaaattagattgaggctttgcggctgaattagattggtttttcttgtggccacatgaggtcgctgctggttaactgaatggcaccaaaaggcatattggggtcatttccaacagctatgaacctgagttctttctgtcacaggtctgacagaaaccgttaatgaagtttccaagctgagcaacaagattgggatgaattgtgattactacatggaagagaaggttttacctccaagcagtctggaaggcaaggtcaaggagacagtgcacaatgccttttgggaccatcttaaagagcaactatcagcaactccccctgacttcagctgtgctcttgaacttctgaaagaaattaaagaggagactggagggagagattctcctgctggccctgaagaagcaaacagctgtgttgtgaactgcctatcgagagggccacatagcaaggagctgcaggtggcttctaggacccggggttagcatccagacaatagccaatcttgctatcactgctattaccacgccagaaccgcctgagaattgagattgaagaagctctggacatggacttgctcaagcaggaggcagaacatggggccctgaaagtcctctatctctctaagtacgttctcaacatgatggctttgctgtgtgcaccagttcgagatgaagcagtgcagaaactagaaaacattacggatcctgtttggctactgagagggatcttccaggttctgggccggatgaaaatggacatggtgaactacactatccagagccttcaaccccacctgcaggaacattccattcagtatgaacgggctaaattccaggaactcctcaataagcagcctagtctccttaatcacaccaccaaatggctgacccaagcagcaggagacctcaccatgtcacctccgacttgcccagacacttctgactcctccagtgtggctggcccctctcccaatgaggcagccaacaacccagagcccctcagccccacaatggtgctgtgtcagggcttcttgaacctccttctctgggaccttgaaaatgaagagttccctgagaccctgctgatggacagaacccggctgcaggagctgaagtcccagttgcaccagttaaccgtcatggcctcagtcttgctggtggccagtagtttctccggcagtgttttgtttggctcaccccaatttgtagataaactgaaacgcataaccaaatccttgttggaagactttcactccaggcctgaggaagctatactgactgtgagtgaacaggtatctcaggaaatccatcaaagcctcaagaatatgggccttgttgctctaagcagtgataatacagcatctctaatgggacagctccagaacattgccaagaaggagaactgtgtctgcagtgttattgatcagcggatccatttgtttctcaaatgctgtttggttcttggtgtgcagcggtctctattagaccttcctggaggccttactctcattgaagcagaactggcagaactgggccaaaagtttgtcaacttgacacatcacaatcagcaggtgtttggtccctactacactgagatcctaaaaaccctcatttccccagcccaggcactggaaacaaaagtggagtctgtttgatagcgtcggctcagagccctggtaccttggacccaagaggaggcccatcatcttcctggagtaacatcaccagtgaccagcagacagtgagcttctatcccaggccctgcagccagtacaccaaggctgtagggatcaagcatgtaaacaccaactggtccatacccattcattaataaacttcttaagtgcaagaaaac

SEQ ID NO: 254140 - DNA, 348 bp, Homo sapiens
caagtttctgttagcacaggcaacctttctgtagttgtagattggttcatctttctgtcttccttcataaaaacttttaaagaaatgtcaagagaaaataatttctgatatatgactgaactttgcatttagtttcaaatttctgaaactacaaatgacacatgtgagacaaggaataaacactttttatagataaatcaaatgatggatttatggatctgggagtggaaacttaatagaataaatggggattgggagattactaatataaatgctacccatataagcaaatgcaatagtgaaatcatagagggaaatgagaaaatagaggtcagatattatgattgt

SEQ ID NO: 254141 - DNA, 414 bp, Homo sapiens
ctttacttacagtgaaactctctctttaatgctgtttggtcaaataaacatcaacaaccacgttcaagtttcttggtcactcctgaatcctttcttttaagtgggagtgggaagttatacagagacaagtgtcggccgggcacggtgactcacacctgtaatcccagcactttgggaggccaaggtgggtggattacctgaggtcaggagtttgagaccagcctggccaacatggtgtaaccctgtctactaaaaatacaataattagctgggtgtggtggcatgcgcctgtagtcccagctactcgggaggctgaggcaggagaatcacttgaacccgggaggcggaggttgcagtgagctgagatcgtgccactgcactccagcttaggcaacagagtgagacttcgtctca

SEQ ID NO: 254142 - DNA, 447 bp, Homo sapiens
gcttcacaggtgaattcttccaaacatctcaagaagaattaatgccagttcttcttaaactatttttaaaaattgaagaagagggcacacttccaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaactggaaata

SEQ ID NO: 254143 - DNA, 195 bp, Homo sapiens
caaactaaaatgttaagaagctatcgattttaggactcatcctgatttcagaggtgttaagatgtgaacaaaatgcatttaggaatcaatgaaacagagagcgggtgtctgcacttcgcaaaggaactaatgaggctgccgcaaccattccgtgagcctgtcttcttagtaaataacagtggcttactcaatgtg

SEQ ID NO: 254144 - DNA, 476 bp, Homo sapiens
aatccatgaacatggactaggtctttatttccttaggtcttctttaatttatctcactgtttcatggttttcagcatagctattttgcacacgttttgctagctatcttggatatttgatgttttttgatgttactgtaaatgatattgttaggtacactggatatttgatatttttgctgttactataatttgcatggcttcaaattttattctcctagtctctgttgctaacatatagaaatatagtagtccctctatccctggttttgctttccacagtttcagtcacccatggtcaactgtagtctgaaaacaggtgagtataatacaataagacattttgagagaaagagaccacattcacataacttttattacagtatattgttataattgttttgtttcattattagttactattgttaatcacctactgtgcttaatttttaaattaaactttatcataagtatgta

SEQ ID NO: 254145 - DNA, 631 bp, Homo sapiens
ccctcattttttccccctctaaaatgcatggtattcaggattagaatctgaatcttttgctataaagttgacatacattggttttaatcccttgaaagttcagtaaaaacctaaaaggaaaagcatcctaccacaccacactcatgtggtatgtgcaactattatagtggcttagagacactagttcgtgttcttcgtttctatattagtaaagatgttagaggaaattaatctgtttgttgcatcagggtttaatgtgaccatgttgtataactattctgaaaggtaagaagtttttcactggagtacagtcactggctgagaacatttaagttttcttttgaagcatacacagttaacaactattgcaggaagaactctgaattaaatttcaggcccagagttttgatttaaactccaaacccttggaaaaaaagactgctggaaaatatgaaagaacccttcgtttcttaacccccacaagtccttttattgcacttactttcatgtatttgaggatgagaggagctttaaatcaacaataattcactaaggaataatgcaaggtggtctattgtaacattttatgatattattgccctggaaataaaagatactgaacaatgtataa

SEQ ID NO: 254146 - DNA, 195 bp, Homo sapiens
aacaaattttaaacttctttcatcatcgctgtaactagtaagttcatctagtccttttcaaatagaaaaacaacaaaacccatgaaatggaaaagagagttccaaaaaagaagacctgttgatactgaatatgagaacattacactgcactcagtaatttagctgtgtctagatcttggaaagaaactccttcat

SEQ ID NO: 254147 - DNA, 613 bp, Homo sapiens
tcagttggcaagtaattttatttagtactcaatatatgtaagcactagggattcaggggaaaacaagatagagaaagtctgccccgttggaacttaaatctcctgactgctggtgaattcataaataagtgaatcctgtagtataatgtatagttgagtatagtccgcttgagcactactttgtggaaaatcttctgactttaacatagtcttaaaatcctaaactgtcaggaactttccaggttccttcagctaagtaaggtgaggcacaccaggcaaaggaacagcagagctttggcaagggggagcagaaataacacagcattgagcaggcttccattataatcaataccacatatctactttagaaaatgatggtttcatccttatataagtgtacttggtaagtggatggacagtgccagatatggaccctcatcgtcaggaaaatagaagcattgacttcttataagatatagaagaacaacacctcggctgggtgcagtgggtcacgcctgtaatcctagtactttaggaggctgaggcaggaggatcacttgagtccaggagtttgagactagcttgggcaacatggtgagacctcatctctgca

SEQ ID NO: 254148 - DNA, 379 bp, Homo sapiens
ttttgtgcctcttggcgcttgtcgtgtttctttttgagtcagctccgactgtggctggcccagggggaaggcagcatccagttatgaatctgatatttatgaggccgtggctgctgcaacatcagaatccactaccgtagagcctggcaagctggatgtgggagccacggagggccaagacctgcagcacatcagcaaccaaaagatgcccacagcttctgttctggacctggaagatattgcgcttgatattgcggaggaggtgttatctgaaatggtgagatgcattccttcatctggaagagaattttttttttttctggggcttcttcccttattaatgaaatgaagacataaaagtctgaccatatacataaca

SEQ ID NO: 254149 - DNA, 368 bp, Homo sapiens
gacaagctctattctaccttccatttccatcaatttgcctaacctaggtacctcatataagtggaatcatatttgtccttttgtatctggtttatttcacatagcatgttttcaagatttctctctgttatagcatgaatcagacttttatttctttttatggctgaatatttaattgtatgtatataccacatattgtttacccatttgtctgttgatggacatttgggctgtttccaccttttgtctattgtgaataatgctgctgtgaacattggtgtaccagtatctgtttgagtccctgctttccacagaaggacactcttttgctttacaaatgtatcaacttcatccagaaataatgtcta

SEQ ID NO: 254150 - DNA, 680 bp, Homo sapiens
acattaacagatgaaagaaaaaaaacacatgatcatctcaatgcagaaaagtatttgacagaatttagcacccttttatagaaaataactagaaatagaaggaaaccactctataataaggccatatgcaaaaatctcacagctaacatactccatggtgaaagactgaaagctccaacatcagcaataaggcagcaatgcccacttttgccacttatagccaacagagtattggaagtgttagccagagaaaataagcaagaaaaagaaacaaatgccatctgaatgggaaaaagcgaagttatctgagtttgcaggtggcgtgatcttaaatgtggaagaccctaaagactaaacacacacaaacctattagaactagtatatgaagtcaacacacagaaatcagttgcatatctatacacttaacagtgaacaatcctaatagaaaatgaggaaaacaatttcatttaaaatagcatcaaaaagaaaaaaatgcttaggaattaaccaaggagatgaaagacatacactgaaaactacaaaatactgctgaaagaaagatgtaaataaatggaaagacatcacatgtttgtagactggaaaactatttttttttttttttgaaacagagttttgctcttttgcccaggctggagtgcagtggcatgatcttggctca

SEQ ID NO: 254151 - DNA, 173 bp, Homo sapiens
cagtggtgcaatctcgactcactgcagccttgaactcctgggctcaagcaatcttcccaccccagcctcccaagtagctgggaccacaggcacgcactaccatgcccagctaaagggccccctttagaaacagccatctaactgaattttctgtttttttttgttgttgttgc

SEQ ID NO: 254152 - DNA, 380 bp, Homo sapiens
ataaatatttttaaatcacctatcacaagtctagtggtagtaaatgttcatagaataagaagctgttgaagtcaaatgtattaacttatgaaagagattttgtcaagcagaagggcagcctagaaatcctaaacaggaaagagagggagagaaagacagacagaactctttaaaaagacttctgtgtgtccacaggtttgttctctggggaaaaaattattagaaatgaaatcgaaggagaaatctatcttagtaaggataaagaggagctatatatattatatacatatttataaatttttattaaaatatattttttataaatattcaaatatacttttataaatatttaatatatatatattttttaccacgaacat

SEQ ID NO: 254153 - DNA, 333 bp, Homo sapiens
gactcccccaacagttggttggagtgtttttccagattgcaccagacttcacagagtaatggagaccagctgtccaggcatctgagagggtgacatccaaggagaaaaggcaaacgtcttgattgcccatgatgtgggcaaccaatttggatagaaaagaaggtgtcagggtttaacactgaatgtagactttatttacccaaagcctttctttaattctaacactctcaaaaatggggctcagtcaccatttgggtttcccatgttaatatgcagagagctaattcattgtctttcattgctgtaatgcagcagttctcaaaatgtactcca

SEQ ID NO: 254154 - DNA, 616 bp, Homo sapiens
agttctttatatattcttatataagtccattatcagatatgtgctttgcaaagatttttctccctatctgtagtttgtctttttatgctcttaatgatttttgaagagaagaaactggcgttcagtttaccaattggttgttttatggattgtgctttttgatgttatatttaagaaattttgcctagcccttggtcacaatgattttctcctatgttttgttttagaagttttttttggttttatgcttatgtctgcaatccattttgagttaatttttttatatgatccaaggtgtatgaagtttttttttacatatggataatgaattgttctagcaccatttattgaaaagattattttttctccattgaattgtctttccacttgtatcaaaaatcagttctgtaatataaatctaatacaataaaaatggataaaatttttatttgttgaattttgtggaatcagctttgcagataaattttaaaaaggtaatgttttgaaattttcacttttttatcatagcgtttctggttaaactatcaactgtttaggaatgaataagtgacgtattctcttccgtttattttataggcttttacgttttatttta

SEQ ID NO: 254155 - DNA, 316 bp, Homo sapiens
tgatacttcgatgtggactttccagcctccagaaccatgagaaatcaatttctgttgtttataagctactcaatggaaaatgtggacacatttaggcacacagtggggaggccgtgtgcagctaacaccatgtgagatcggttgatacagcagaagccaaggaacaccaaatattgccaacaagccaccagacactaagagagtgacatggaacagatttctcatcctcaaaaggaaccaagcctgccaactccttcatatcagacttctggtctccagaattgtaagacaatacatttttattgtataagccaaa

SEQ ID NO: 254156 - DNA, 394 bp, Homo sapiens
agacactgtatttagtggtaacatcttaattttagtgttaaattgtattgccaaagtgctaggattacagatgtgagccaccgcttctggccctgcttttcctatgtacctgagaatttttaaatatttatttatttatttttgagacagggtactccagactggagtgcaatggcccaatcaaggctcactacagcctcaaactcctgggctcaaactatcctcccgagtagctgggattataggtgtgagccagtactcctggctaattttttttttttttttgagatggagtctcgctctgttgcccaggctggaatgcagtgagccgagattcgtgccactgcactccagcttgggcgacagaggaagactctgtctcaaaaataaaaat

SEQ ID NO: 254157 - DNA, 609 bp, Homo sapiens
atttggtaccttaattccatctttaaaatcctttctagcaacacctacattcatgattgatagactaactgagagaaggtatatacaccacggactgcgaattttggaggtcactttagaattctgtctaccacggatacatttgaatatatctgcacatttacatatagttgtcaccacattaaggaaaattaacatatagattaccccgaaaaatttcctcaaactattttataattccttaatcccaccccttcttgccctctttaccaccttcaattctaggaaactgcacctatgctttttgtcactatgattggtttgttgtgtctgagattttatataaatgtcaccgtacactatgcactttttgtctgacttctttcaactagcatagtttgagattcctatatgttttatctatcaatagtatatttttatggctgagtcttattttattatatgactatattcaccttcatgacaatagacattaggttgtttccagtttggggcctgagaaataaagttgttttgaacattcatgtacaagtatttgtaaggacatatgcttttatttcttttgcataaatactaaaaaaaagagtg

SEQ ID NO: 254158 - DNA, 1373 bp, Homo sapiens
gctcagatactgatactttctttccaaacagcataagaagtgattgagccacaagtatactgaaggaagggctccctcgagttgtggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaatgtcactcttgtcgcccaagttggagtgcaatggcacaatctaggctcactgcaaccctgcaacctctgcctaccgggttcaagagattcccctgcctcagcctcccaagtagctggaattacaggcacctgccaccacatccagctaactttttttgtatttttactagagacagggtttcaccatgttggccacactggtctcaaactcctgacctcaggtgatccgcctgcctcggcccccaaagtgctgggattacaggcatgagccaccacatctggcctaggaccttaaatattggaaagcatcctcaaaactgtgggtcagtgagtagaactacaaaacaatagcagtagggcagaaacttgaaagaaggcaggagatcatggtgacagtggatgggaaaaagtgagggttggggataagggttgcgggttgtcgaagggtggattttctccttcagcaactacaggagatatgatgcctcataattcggagccagaagtggggctttgggtgagatatctttgcacagataacatgtatacatcatagttcaaaacccagtagtcattgtttacagcaaataaagaaatatttagtaaatt

SEQ ID NO: 254159 - DNA, 1335 bp, Homo sapiens
cattagaacacaccatacaaatgttagttctatatggccaagacatctgatttaaatttgatgaaacacagcatgtcattgttttctagaacttaaccattttcgcttctagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattac

SEQ ID NO: 254160 - DNA, 2301 bp, Homo sapiens
gctcagatactgatactttctttccaaacagcataagaagtgattgagccacaagtatactgaaggaagggctccctcgagttgtggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgaaatggaagcatcgttgctgggtatgaagttgttggctccagcagtgcatctgaactgctgtcagccattgaacatgttgccgagaaggctaagacagcccttcacaagctgtttccattagaagacggctctttcagagtgttcggaaaagcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattac

SEQ ID NO: 254161 - DNA, 2149 bp, Homo sapiens
gctcagatactgatactttctttccaaacagcataagaagtgattgagccacaagtatactgaaggaagggctccctcgagttgtggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcccagtcgaagaatatcagctgctgcttcaggtgacctatagagattccaaggagaaaagagatttgagaaattttctgaagctcttgaagcctccattattatggtcacatgggctaattagaattatcagagcaaaggctaccacagactgcaacagcctgaatggagtcctgcagtgtacctgtgaagacagctacacctggtttcctccctcatgccttgatccccagaactgctaccttcacacggctggagcactcccaagctgtgaatgtcatctcaacaacctcagccagagtgtcaatttctgtgagagaacaaagatttggggcactttcaaaattaatgaaaggtttacaaatgaccttttgaattcatcttctgctatatactccaaatatgcaaatggaattgaaattcaacttaaaaaagcatatgaaagaattcaaggttttgagtcggttcaggtcacccaatttcgcccagtgtaatgacattgtctttggatttgggtccaaggatgatgaatataccctgccctgcagcagtggctacaggggaaacatcacagccaagtgtgagtcctctgggtggcaggtcatcagggagacttgtgtgctctctctgcttgaagaactgaacaagaatttcagtatgattgtaggcaatgccactgaggcagctgtgtcatccttcgtgcaaaatctttctgtcatcattcggcaaaacccatcaaccacagtggggaatctggcttcggtggtgtcgattctgagcaatatttcatctctgtcactggccagccatttcagggtgtccaattcaacaatggaggatgtcatcagtatagctgacaatatccttaattcagcctcagtaaccaactggacagtcttactgcgggaagaaaagtatgccagctcacggttactagagacattagaaaacatcagcactctggtgcctccgacagctcttcctctgaatttttctcggaaattcattgactggaaagggattccagtgaacaaaagccaactcaaaaggggttacagctatcagattaaaatgtgtccccaaaatacatctattcccatcagaggccgtgtgttaattgggtcagaccaattccagagatcccttccagaaactattatcagcatggcctcgttgactctggggaacattctacccgtttccaaaaatggaaatgctcaggtcaatggacctgtgatatccacggttattcaaaactattccataaatgaagttttcctatttttttccaagatagagtcaaacctgagccagcctcattgtgtgttttgggatttcagtcatttgcagtggaacgatgcaggctgccacctagtgaatgaaactcaagacatcgtgacgtgccaatgtactcacttgacctccttctccatattgatgtcaccttttgtcccctctacaatcttccccgttgtaaaatggatcacctatgtgggactgggtatctccattggaagtctcattttatgcctgatcatcgaggctttgttttggaagcagattaaaaaaagccaaacctctcacacacgtcgtatttgcatggtgaacatagccctgtccctcttgattgctgatgtctggtttattgttggtgccacagtggacaccacggtgaacccttctggagtctgcacagctgctgtgttctttacacacttcttctacctctctttgttcttctggatgctcatgcttggcatcctgctggcttaccggatcatcctcgtgttccatcacatggcccagcatttgatgatggctgttggattttgcctgggttatgggtgccctctcattatatctgtcattac

SEQ ID NO: 254162 - DNA, 954 bp, Homo sapiens
gtgttttgattggcatttcacttataccttatgatgctggcatcttttcagatacttagtggacatttgtatacatcttctttgtagatatatctgttcaggttctttgtccatttttaaattgggttatgtctttttattattgatttgtaagagttctttatatattttagatataactcccttatcagatgtattatttgcaaatattttttcccattctgtgtgttgccttttcaccttcttgatgatgtccttcaaagcatgaaggtttttaatttttattaagtccagtttagccatatttttcttgttgcatgtggttttggtggcatatctaagaagccattgctaacataaggccacaaagacttatatctgtattttcttctttcctctcataagagttttatggttttacctcttaacgtttcggctttttgtgcatttagaattcatttttgtatatggtgtgatgtaggggttcaccttccttgttttacatgatatccagttgtcccagcaccattagtgaaaagactattatttccccactaaattgtcttcacccccttgtcaaaaagcaattgactatacatgtgagggtttatttctggactctgaaattctattccattgatctgtctgtctagccctatacaagtaccacactatcttgatcactgtggttttgtattgagttttgaaattagaaagtgtgagtcctccaactttgttcttctttttcaaaattgttttgtttattctgtgtcccttgcatttctttgtgaatgcagggatcatgttgagactgtagatcatttgggggggcattgccattttaatggtattaaaaatcttctcatccatgaacctggattacctatgtcttctttaatgtctttcaacagtgttttatagttttcagagaataaatttttcactgcttttgtt

SEQ ID NO: 254163 - DNA, 479 bp, Homo sapiens
ccatgatcgtgccactgcaatccagtctgggtgacagagtgagaccctgtctcagaaaaaaggacaaacatgtttcctcttcacagtcaccatttacgtcaccacccagatacatgagtacttctcacgatggtaaggctgggcaaaggatgtgggccccacaaccagccggcttggatttgactcctcaatttgaagaactatctgatgttgggcttgttacttaacctctctgggcctccgtttccacatatgtgaaatgaggatattcatggtgactgtcttatcaggttgcaaagatttgatgagtcaatctgggcaaaacaattaggacagtgcctggcacatcatccatgatggttcttatgaaatatcactgacagaaagacctaagaatatcaatcactgcagggtaggaactgtgtcttcatgagttatgtctttattcaaggaggaaacaaaacaaggagaaaaagaaa

SEQ ID NO: 254164 - DNA, 432 bp, Homo sapiens
atttgacaacgatgttcaagatttattgtattttatctagtaaagataatcaacatatagaaatcaacctctattgcttttacaaacaagcaaaacccaccaccaagagcaatcaccagcgaatagttttgggaaaatgtggatacaataaataattcatgatgacttttcacataatctttttactttctgagtggctatgtttcttgataccaaaattctcccttatgaacacacatacttcttattgtattactttaagcctaaactgctagaatatactgtttacctacatagactgaaagagggaatctagtttggaaaattgcaaagattatcaaaaactgttaaaatcccttctcctcctcctcatcattatcatcatcaccctcatcatcctcatcatcatcactatcattgttgtgtcatttt

SEQ ID NO: 254165 - DNA, 384 bp, Homo sapiens
agcagtgtgagaacggactaatacagtaaagtggtaccagtagagtgggatgctgctgaaaagatacctgaaaatgtggtttaactgtgtccccacccaaatctcatctcgaattcacatgtgttgtgggagggacttggtgggaggtaattgaatcatgggggcgggtctttcctgtgctgttctcgtgatagtgagtctcacgacatctgatggttttatgtgtctgggatttcacctgtttgtactcactccatcctgctgccctgtgaagaaggtgcctgcttctcctttgccttctgctatgattgtaagtttcatgaggcctcctcagaaatacagaactgtgagtcaattaaatctctttcctttataaattaccaa

SEQ ID NO: 254166 - DNA, 252 bp, Homo sapiens
tgctgtaacaccagtcaaaaaaattgacaaagatgaggtattaagtattgacgttaatactctacctgaaaataaaaaccatggaacctatctataggttaaaacagcatactgataaaaaacacatatactttgatgcagagatgtacgataatcatgaattagaattagcatcctgatttagtgttctaccaaaaaccctaagtgaacacagaatctatttaaaaccaaagaaaacaaaaaaatcttgtg

SEQ ID NO: 254167 - DNA, 503 bp, Homo sapiens
tagtagagacagggtttcaccgtgttggtcagtctggtctggaactcctgacctcaggtgatccacctgccctggcctcccaaagtgctaagtgctgggattacagacccttaaacaatattaagtagtaattagtaaactatattttcttttcttttcttttcttttttttctgagatggagtcttgctctgtcgtccaggctggagtgcaatggcatgatcttggctctcactgcaacctccacctcccaggttcaagtgattctcctgcctcagtctccctagtagctgggattacaggtgttcaccaccacgccaggctaatttttgtatttttagtagagaaggggtttcaccatgttggccaacctcgaactcccaacctcaggtgatccacctgcctcagcctcccaaagtgctgggattacaggcatgagccactgtgcctggccaataaactatattttctcaagccaaagtagacaagcacagtctaaaaagg

SEQ ID NO: 254168 - DNA, 405 bp, Homo sapiens
acatgtcattgcctcattaaaagagaaggtttaatcttgcaatggactgaatatccatcttctgcagcactggaaaaaagcgcagcttatctatctgctttgaaaagtaggtttatagcaaaaggctcttcccttcctgcctggatagccaccactaaattgggcctctcagaactgagctcctgaaaattcatactacagaaatgtttcacttttaagtgggatttctgtttttaatttctggggaaaagatttagatagtatcccctatgatgagttttatttaatatctttactgcctgcaaaaagcccatgcttatgtttgtttttacagaagacccttcactaccttaatcaacagacctttgttaagcacttattctgtgccaggcagattaaataata

SEQ ID NO: 254169 - DNA, 219 bp, Homo sapiens
  misc_feature (190)..(191): n is a, c, g, or t
gtcatctgaagataatataaaagacaccaagttaaatgacttgcaaatttttttactttttaaaatttttttatttttttagacttgcaaattttaattcacattgagtaaaacaacttttgtaaaattatatactttagaaacaaatgaagattcttgtgacttgtttattctataagctgtataaccnnaaagaaaaattaaagatactttaggaat

SEQ ID NO: 254170 - DNA, 361 bp, Homo sapiens
caaatccatactgagtgcttcgtataatcagctcatttaatcctcccagcagccctgtgaggcagttgatataccatggaccaggatgctcttatctttaatgaaaatactgcagttaaatcgacagatacaaggaactactgggaggcattttaactattatgtgtatctattcttagatcacaaccataaagacacatggtcttggttgtggtgtggggtacgggagtggtaaactaagcttaactagaccttgaagaggtttttcgtttgttcttttttttcctaatttgttcttttggttgcccacagataagtcatataaacatgacagattcagaaaaattcataggactttaaa

SEQ ID NO: 254171 - DNA, 689 bp, Homo sapiens
tcctctgtggataaattgcaaggcttgacctcccacccagatctccttcatgagcttcagaccttcaagtgaaattaagtcctagacatttctaccaggagcacctcacccttgccgtgcctccaaacagactcttcatcactttacccatgcactcacctattccagacctgctcttcctcctgtgtcccctaaaatcagtagcaccaccatgcccctgtgttcaagttagaaacctgcatcatccaacattctttctcccagcccccacatctccactgctttaattcacacctgcatcatatctcacccgacctattgcaacagtctcctaggataaactctccttgtctcccattcctcactcccccaaatccagtagctttagccattcatggagctctcctgtctgcagagcaaacacttcatgtaccaagtgcatttaagacttttcttgagctggctcctgctgaagccgtaactcaggtccattcatttgttcatctctgtctccccagagtctagcgcagtgccaagcacacttactgggcttaatacataccttttaattaaagaaatgaatgaaggagtgaaatctgcgaaagtcactccctgctgtcagatgcagctttgtgagcagtggctggagtagccaggacatggaggagacccgagtgacatgtgatggc

SEQ ID NO: 254172 - DNA, 469 bp, Homo sapiens
aattgagtacttactgtgtgccagctctatctttattgctttatttgtattaacacagttaattctcacaacaaccatatgaggtagatgctattattacccctattttacacataaagaacttaagcttaaagagatttaagtaacctgtccaaggttacccaagtaacaaggttggggcagaaccacgattagaactccaacagtccagtttaaaaacccaagccctttactaggatctgctagaagtacatttgaattgtctgtagaagagggagtggtgtttaaaagatggagaggagctttccaaatagaagaaattataagctgaccagatgcatcaaaatcacttaaaaacacagattttaggcaccccaaacccttgcctcagagaagctctgttgtagaattgtggcttccaaattgggattctcagattcctagagtctaggtggaattattggggaat

SEQ ID NO: 254173 - DNA, 250 bp, Homo sapiens
aggcccaggagaagccagcagctggtgcttcctggaataggccagggctgacaaactccaagaggagcctaaagatcagcatttgttttaatgcagaggctcggcttagaaggcccagcttgtgggccaggcgcagtggctcgcacctgtaatcccaggactttgggaggccaaggcaggtgggtcacgaggtcaggagatcgagaccatcctggctaacacagtgaaaccccgtctctactaaaaatac

SEQ ID NO: 254174 - DNA, 239 bp, Homo sapiens
atgggtctgtaaaggaactgataaaagtttgggactgaaaagattttaaaaagacagagatcttggaagagctatatgttatatcaaaagctattgtgtgcctgtgcatatgcatgtgtacgtgtgtgtgcaccttgcacacataacctgctgcttactactcagcccccttgtgtcttctccccttccagagtaggccatatacctatgaacgttttaacgctcatgtataaaatcta

SEQ ID NO: 254175 - DNA, 428 bp, Homo sapiens
acagtttttaaaaatttaaagttgataaggtaaaaatgttagagcaaactaaggttaatgtattattgaagaaaatttttaaaatacatttagtgtagcctaagtatacagtattcgtaaagtctacggtggtgtacaatgatgtcctaggccttcacattcactcaccactcactcactgactcacccagagcaacttctagtcctgcaagctccactcatgatgagtgctctatacaggtgcaccgtttaaaatcctttatattaatagcatatttttaccataccttttctatgtttagatacacaaatacttaccattgtgttatagttgtctaccgtattcagtacagtaacatgatgaaatcgcctaacaacacgtttctcagaatgtatgcctgtcattaaataatatgtgactgtgtatt

SEQ ID NO: 254176 - DNA, 471 bp, Homo sapiens
tcatttgcatctcacgagtcaaatatttttattttatagatgagaaagttgaagcccacagaagttaaatgacttgcccaaggccctatagctagttaggctcagagctgaatctagcgctgtagtacacaccaagatgccacagttatctgtgtgtcatctgcctctcccatcctctttggagcagtctaggtcccaaattaacttttctgtgacttaaattgtttctgagttgagatcattttgatgtatattgaacggggaagaatttttgtttttctttttgagacagcatctcactccattaccaggctggagtgcagtggcgcgatcttagctcgctgcaacctccacctcccgggttcaagcaattctctgcctcagcttcccaagtacctgggattacaggcacccgccaccacacccagccaatttttgtatttttagtagagacggggtttcaccatcttg

SEQ ID NO: 254177 - DNA, 220 bp, Homo sapiens
cttttttacgtggatttggggaagacagactggtagattactctcagtactcctttaagttaatttaaatatgaagtagtagttgctgtctgcaagaaagccttgttggttcattttgaatttttgttttttacttttttgcaaatggagaaaggattgtggtccacggaatgctgtcatgttgccatgttgtcatgcaatacagtatttttgtcgcaga

SEQ ID NO: 254178 - DNA, 376 bp, Homo sapiens
aatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgat

SEQ ID NO: 254179 - DNA, 454 bp, Homo sapiens
ataggggaggatcccttgaggccaggagtttgagaccaacctgggcaacatagtgacaccccattgctacaaaaaaaaaaaatgaaaattagctgggtgtggtggcaagtatccacgggcgggggacaaggttattttggtaagcctagcaaactctggggcagagaagtggaggggtagaagcttgcctatcttgagctgaggagggaggaggaagtgagaaatggaggcagccagatgctctcctttgagaaggacctaattcctattctcattggtgtaacttaaaaacaaaacaaaagtgattaaatatttcaaacataaaagtaaaatgaagctgggcatggtgatatgtgcctgtaatccaagttacaggaagccaaggtgcaagggtcgtttgagcccaggaattcaagaccagcctgggcaacccagtgagaccctgtgtctttaa

SEQ ID NO: 254180 - DNA, 340 bp, Homo sapiens
ttacattatctgtaaaatgaggacttgaataatgttgagctctcctgtaggagaaagaggaaagaggttgccaggaaaattctgcctggagactttaggacagctgctcctgagggtcactagtgagtctaccttgatggttctgtgactgcagatattggtagggtgctgcttctgtgttaggctctatttctcgagtaatagtaagccagttggtgagaaaacaagactgaaaaaatgctcccttgacataaacctgttgtagaactctcactgcacattctttgaggaccttccactgtggaattctgtaactgaagtccaggagtaaaggaaggtc

SEQ ID NO: 254181 - DNA, 389 bp, Homo sapiens
aaaatacttttttttttctgtaaacagtaaacatttataatgtttgcatctaaatttcaagggctactggctggcattgggtcatcctatagggaaggggaccatagtatacctagatagggaagaagcccacaaggaaatacatcaaaatgttactgctaggtatctctgggtgataagattaaatataatttttatattcatctttatagttttttcccatttagaatttatagaaagaccctaaattacttaaccaccataggttaactaaaaatgagcattggaacttttaaaaatcagaaaaataatgaacattataatatgcatattatatatgaatataatactaaataatatatataactttaataatcagaaaaaaatta

SEQ ID NO: 254182 - DNA, 512 bp, Homo sapiens
attgagaatgtattgttttaacgtggccaaattagtgtactctaggatactacccatgtggcagatatttgagaatgcattttgtgtgacttacagattaagcatacaatttgccaaaattttatgtaattaatttcctagtttacatttagggctagatgaagactagtactgtttcatcttttagaaaaactaacacttttcctttagtaaaagtgttaatttttgcaatacttttgcaaaaggttaaacttatagcaattttgtcatagctataatcttacactgttataaaatttagaggatttttaatttttatttattatcattatttgagacagttttgctctcgttgcccaggctgcagtggcgcagtctcggctcactgcaagctccgcagtccggcctgggcgacagagcgagacggatgaacccaggaggtggagtttacagtgagccgagatcatgccactgcactccagcctgggcaacggggagactgtgtctcaaaa

SEQ ID NO: 254183 - DNA, 336 bp, Homo sapiens
aaaaccacaacagcaaagatgctgattattcagtctgaaaatgttaagtgggtacataacattttcagggaaaggtgacttgaaacgtagttttaaattagaacgatagaggaaatgatattagtctagttattggtacacgtttgagaccttgtctcagctctgccactaactagccgtagaatgttaagttgtaaaacctttctccatctaaagattttcatctataaatgacggacccgacctagatgattgctaaaatcctttccactactaatattccgtgatgcattttctccaagtttgggtaaaagccctccatctaaagaaggaaaa

SEQ ID NO: 254184 - DNA, 1155 bp, Homo sapiens
tcgccccagcccgggatgctgctcaggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccagacgccaccccgctgcccaccgcccgcgaccgcgacgcggaaccccacctggagctccgcttcagcccgtccccaccgaagtctgcggacgcctcccgcgcccgcggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacatcctgggcccgctgcgcgaccagctgctgaccttgaaccagcacgtggagcagctgcgcggcgccttcgaccagacagtgtccctggccgtgggcttcattctgggcagcgcggccgccgagcgaggggtcctcagggacccgtgccagtgagtcccggcttgcgggcagtctcccctctccaggccgaggccctccgccctgaccctcctgctgccttcccaccctcgttcttgggtacgttcaataaaaggattgttttcctag

SEQ ID NO: 254185 - DNA, 201 bp, Homo sapiens
  misc_feature (91)..(91): n is a, c, g, or t
gcaggagggaaagtgcagagaacgatagaccagaagccccagggacagcgccagtcctcccacgaaagcctgcccatagcccagggcggtngtagacacccgtgatcccctcctgtagtgtccagagtccaggtcccacaatgatgattagtcctaggatgctgcccaacagtccacaccagtcgtagccactgagaccct

SEQ ID NO: 254186 - DNA, 419 bp, Homo sapiens
gtcttgctctgtcactgaggctggactgcagcggcgtgatctcagctcactgcaacctctgcctcccggattccagctattctcctgcctctgcctcccaagtagctgagattacaggcgcccaccaccacacccaactaatttttatatttttagtagagacatggtttcgccatattggccagactggtctcgaactcctgacctcaggtaatccacctgccttggcctcccaaagtgctgggattacaggcgtgagccaccatgcccagccaggttaaatattaatagtagccttttttcattttcaaaggggttctgttttagatgatatgttatgtgttcagctattatactgtacatttatgttttatgcacttttatgtatttattatatgtcaaaaatgtttttaagttaa

SEQ ID NO: 254187 - DNA, 221 bp, Homo sapiens
  misc_feature (162)..(162): n is a, c, g, or t
  misc_feature (172)..(172): n is a, c, g, or t
ggatgtggctcatcgccaataatagagccagtgtcttcatgtattctcacgtggtcttaatgatcagaacgtgctctttcattctctgccctaattgaaataattctgtccctttcctcatttactttttctctgatattcttacactaccagctgggtttncactgccccnccctggcacactgctgcaccatggttaccatggttatcacacattctga

SEQ ID NO: 254188 - DNA, 471 bp, Homo sapiens
gaccggctgctggggtttgggaggggcagagattgaggagccagttgctgtgccctgttctggcaaaagaacaagatgcgttgcaagccagaatgatgaattccacttttcacgtcgcctccgtggcattctgcctaaatgatgggcatggaaatggtgctgagggatgtgggctgaatcgagaacacagggacttttgtcttcagggtgagaaatgttccggtccttaaggaaacatcgtgcagcagttgcatgggtcttccaggcgttcctcccaaaacattattttttttctttcactattgagttttaaaacttagcgttctgtcgctagcattgcatcttagttacacatcctctcccacccataacgtcaaatttaggagacgatacatccccaagctttcctgcattattttttgcagtaactggttattcagtttactttctttaaactatgtccttctcaaa

SEQ ID NO: 254189 - DNA, 300 bp, Homo sapiens
gggctgctccttgcctgttagactcaccccttccacaggaatcagtgggggccagaatgagtcctggtgtgcagtatccctgttcagggttcccagcttcctccccttcagcccagcctctgtgccttccctctgtccactctcaatgccttccctctgaagatctgctaggagtgcaccagtcttcctgatgtcttggtccctcactgggagatgtttctactggctgcatctagtaggccatcttggagcagcaatttgcatgttaaggctcagactgtttgtttgaatgcacacaga

SEQ ID NO: 254190 - DNA, 1866 bp, Homo sapiens
  misc_feature (1)..(1): n is a, c, g, or t
  misc_feature (3)..(4): n is a, c, g, or t
  misc_feature (6)..(7): n is a, c, g, or t
  misc_feature (10)..(12): n is a, c, g, or t
  misc_feature (14)..(14): n is a, c, g, or t
  misc_feature (18)..(19): n is a, c, g, or t
ntnntnnctnnnanctcnnaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcctcacatggtgtgggccgacatgaagagctgccagatccaacagttctcagaattcttcatatattttggacagcagtttttccatcagattattttgtaagtattttctcccagtctgtgacttgctttttccattctcttaacagtgtctttcacagaacagaagtttttaattttaatgaggctcaacttaattttttttcattagtagattgtgcttttggttttgtatttaagaagccatcattgaacccaggatccccgagattttctcctatgttatctcctaggattcttatggttttgcacttacatttacgtgtaagatttattttataaaggatataacatgcatacctggatttatttagttttttgcatgtggttgtccagctgttctagcaccactagttggaaaggctatctttgctgttttaaattgtctctaaagctccatggaagatcagtggactgtatgtaggcctgcttctgggctccgtattcttttccatgcatctatttgtgtgtgttttctcttttcaccaacttcacactatttgggttactgtagcttaatgtaagtcctgaagttggtagtgccaaacctcagggagtttttctgaacttcatcatgagaacctggttgagatcattgtagtaaaacttggaaatgtgtaagattcccccttagtctggtcttcaaggagtttttaatgttctagccaggctaccctcagcttctagtaatctgtcaatatcatttaagtgctcctcccacttgctgtccccagtagcttctcttccctgtgacctgtgactccttatgtgttagcctgtgtttctcatttttaaggtggcagttttccctgtgacctcaattctctgatccaccctagaagggttgactttcagtttgttcagcttttttctagctgtgaggacaagtgatgagctgcctagctctttcccatgttgataatagaaacccaaaagtttgtttaaagaattacttgttataaaagtcccccattgttaatgtacaactcaatgatgtaagttgatttatcgaattgtgcagccatcagcagagttctacttcagcatattttgtcacttcccaaattcccttgaacctgtttgtagtcatttcctaatccctggtccccatgactgggtctgaatagaataaacatttggaaagcagatttcattatatttacattttcctgtgtttgggactttatatagtggactattgtgttcgttttgtgacaagtagagaagagattgcattctagggatggtttttgggggaacataatagtagtcctgtttatggctctccttgaattggttcttctgtgctggtgactggtatttgttaccaaaccttgtctggtgagcacaagaaaaggaattttttaaaatctgctattaaaattgagatgatacattttcacataataatatttggagttaagtagtgaaccgtctttattttattttatctctttttttggagatggagttatttctcttttccttgggctcgaatgcaacggcgccatctcagctcactgcaacctccacctcctgagttcaagtgattctcctgc

SEQ ID NO: 254191 - DNA, 6896 bp, Homo sapiens
  misc_feature (1)..(1): n is a, c, g, or t
  misc_feature (3)..(4): n is a, c, g, or t
  misc_feature (6)..(7): n is a, c, g, or t
  misc_feature (10)..(12): n is a, c, g, or t
  misc_feature (14)..(14): n is a, c, g, or t
  misc_feature (18)..(19): n is a, c, g, or t
ntnntnnctnnnanctcnnaggcattctgaaggcaaatcctgtttagacccaggcaaaggttcctggtgacccaggctctcatgagcagattgtcccttatcattctcctgaggatgtctggagcttcagtgctgtgtgctcttggcctccacactgggggtgccaccaactcccactgtccagggcttctggtggactctccgaggcaccgatgtagaaacttacccattcagtgcaccaagagcagcctcacatggtgtgggccgacatgaagagctgccagatccaacagttctcagaattcttcatatattttggacagcagtttttccatcagattattttaaatgtgattgataacagtaaagccacactcctcaagtgcctgaaatacccctcattgtcttcttcaggtggcaagggctctggaacagccacataaagcccttgaagataaggatggtcaaacaaaataatatcatacctggagaaactcagatcttgctaagatttactggttgggaatccaaagttaatgccaagaagcagctgccagttgggatcaaatgtgagcctatggatcaagacggttacctggcacgctggccacaatctacctcactcttatcagagtctgagcagtgctttcagctctgagttgaggcacctcgaaccttgtttttgtggtgaaggatcctaaagtgctgtggggagtgatcacatttttcacaacatccctgactccacctcttctgccacaaacgtcagcatggtggtatcagccggcccttggtccagcgagaaggcagagatgaacattctagaaatcaacgagaaattgcgcccccagttggcagagaacaaacagcagttcagaaacctcaaagagagatgttttctaactcaactggccggcttcctggccaaccgacagaagaaatacaagtatgaagagtgtaaagacctcataaaatttatgctgaggaatgagcgacagttcaaggaggagaagcttgcagagcagctgaaacaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaacttgtccaaaagctcagcccagaaaatgatgaagatgaggatgaagatgttcaagttgaggaggatgagaaagtactggaatcatctgcccccagggaggtgcagaaggctgaagagagcaaagtccctgaggactcactggaggaatgtgccatcacttgttcaaatagccacggcccttgtgactccaaccagcctcacaagaacatcaaaatcacatttgaggaagacaaagtcaactcaactgtggttgtagacagaaaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaactggccggcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacagcaccttgtccaaaagctcagcccagaaaatgatgaagatgaggatgaagatgttcaagttgaggaggatgagaaagtgctggaatcatcttcccccagggagatgcagaaggctgaagaaagcaaagtccctgaggactcactggaggaatgtgccatcacttgttcaaatagccacggcccttgtgactccaaccagcctcacaagaacatcaaaatcacatttgaggaagacaaagtcaactcatctctggttgtagacagagaatcctctcatgatgaatgtcaggatgctctaaacattctcccagtccctggccccacctcttctgccacaaacgtcagcatggtggtatcagccggccctttgtccagcgagaaggcagagatgaacattctagaaatcaatgagaagttgcgcccccagctggcagagaagaaacagcagttcagaagcctcaaagagaaatgttttgtaactcaagtggcctgcttcctggccaagcagcagaacaaatacaaatatgaagagtgcaaagacctcataaaatctatgctgaggaatgagctacagttcaaggaggagaagcttgcagagcagctgaagcaagctgaggagctcaggcaatataaagtcctggttcactctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactggcacaacaccttgtccaaaagctcagcccagaaaatgataacgatgacgatgaagatgttcaagttgaggtggctgagaaagtgcagaaatcgtcttcccccagggagatgcagaaggctgaagaaaaggaagtccctgaggactcactggaggagtgtgccatcacttgttcaaatagccatggcccttatgactccaaccagccacataggaaaaccaaaatcacatttgaggaagacaaagtcgactcaactctcattggctcatcctctcatgttgaatgggaggatgctgtacacattatcccagaaaatgaaagtgatgatgaggaagaggaagaaaaagggccagtgtctcccaggaatctgcaggagtctgaagaggaggaagtcccccaggagtcctgggatgaaggttattcgactctctcaattcctcctgaaaggacatcggtgggatcaagtgaaaaaggaggaccaagaggcaacaggtcccaggctcagcagggagctgctggctgagaaagagcctgaagtcttgcaggactcactggatagatgttattcaactccttcagtttatcttggactgactgactcatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgcttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatcaaagaagaaaagaagaaggggaagaaaagaaggggaagaagatcaaaacccaccatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatgaaattgaaaagtaccaagaagtggaagaagaccaagacccatcatgccccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagaattaaaaaggaccaagaagaggaagaagaccaaggcccaccatgccccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggagaaattgaaaagaaggggaaggggaagaaaagaaggggaagaagatc

SEQ ID NO: 254192 - DNA, 429 bp, Homo sapiens
ttaccccacctgccacgaaggctcagtcctccccagtgcaatgacccagccctgctggcttccctgtgtgcccttggagtgccctgtctcccagggttcatgctcagggtttgtttcagactcctgggtccagtcagcagcctctgcctgctaatggaacaagcacactgctctcctacctgtgaggtacttggggtgagaagtctcgtcacctcttttaagttagcagacgtgctggctttcccgggctcagacagcagagagacgtgcattgtgttttgttgtaatgcactgtgaacacctgggtgtgagggtgcacacccacagtcccactgactctggaagccgaggctggtggatcacctggtcctgggagtttgagtccagccttggtaacacagcaagaccgttgtctcttaaaaaaaaaaa

SEQ ID NO: 254193 - DNA, 534 bp, Homo sapiens
cttacctgttaaatggggaacacgatagcatatcacttacaatattcagttaacatctataaaccgcttaaaataactgtcatgtattaatgacgagaattcgttctaaaagaaaaaagccatacatttctgaaatttaaggtgcccccagtattcagtacagtatgatgctgtacaggtgtgtaacccagaagcaacgggctgtaccatagagtccagatgtgtagtgggctgttctgtccagtctactctctgaaggttgttctaagggtctgtgaaagcaacaagaggaagttcttgtaggccgaaaaaggaaaaaaagaaaaagaaacagaggatgagaggagtcctcttctccttaaaacttcctcaaacctgaccatcataatgacctcctgtatatacaaatattcatattgcacatcatatttccaaagaggctaattttcaggtctgctattgtggttcaaatttaatcattccaaatatgatttgatagctgttaataaaggtgtgataccacctagaaaaaaa

SEQ ID NO: 254194 - DNA, 228 bp, Homo sapiens
ccattccttccttggcccctcccacctccctcccagggtgatgtctgcttggctggtcatggtaggcagcctgtgggatggcccccagtgctctctgcccatatgtaattcatctccttgaatatgggctgcatttagcaactcacttctaatgaatgacagcagtgatgggagcactctgagactaggtcattaaaagattgtggctcgtattgtgaaaactctctg

SEQ ID NO: 254195 - DNA, 275 bp, Homo sapiens
cctcagactctgccttcagacagtgtcctgtgccctgcaaagcctctagatccatagactcatgttagcattgcagccacccttggccattggggtaaatgctcctatgtccattttactgagaggaaagccaaggctcagagctcacgagggacggagacaaccccaagcctagccagaggccaacaagccttcctccttggtggttttccacacctgtcatttctgtccccttccctggggcctacaggagcccttgggtggccactagggcc

SEQ ID NO: 254196 - DNA, 470 bp, Homo sapiens
aaggatggctagtcaggttcttctcatgggactgagcaaacaaaatgctgataatgtggcaggtggtgtagtagttgaagataataggatgtaaatagataccatgaggtagtgttcaagtaacagagtgccctgtgtaagaggaagttatgagtttgcagaaagtgtgagaaaggtagcatatatgggtaacagtggtgggaagagaagaaggaagacacagaaacagataggaagagaaactgagtagcattgatgttggagcacacctgtggccaaggtggcacattttccttggatacacactaaccctggtgtttctgtccttataaggctgactgcaccctagatgacgggttgatgggtgcagcaaaccaccatggcacatgtatacctatgtaacaaacctgcatgctgcactttctttcatgtatcccagaacttaaagtaaaataaaaaaataaataaat

SEQ ID NO: 254197 - DNA, 473 bp, Homo sapiens
cagatttgtctggctttatctctaaccactttgtgactctttttgtaacttgcatttttctaaaaatgtgaccttgtttggtcttcctactgttggccatgctgtttttccttctctccacatctttttatcaatggtgcaaattataaattgtattcaaatttactgtaaagatcatgtcctctagacagcccctatcccacttgtataacccttgctcttcagcccctttcacacctgcataggtattcttctgctgtgatgatcctttgaataattctcttggagttctctttaccaggctctcttgcagcaactggtgagctcatgtaggctatcactgggtctctgcttatttgccagtgcctgcaggtcctcagtacctgtttgctgaacaaacgaatggtctgtcagcttaacccaactctgtatgtagaaggcacttaataattcttaaaaacaattttgattct

SEQ ID NO: 254198 - DNA, 691 bp, Homo sapiens
tcggcttcccaaagtgctgagattacaggcatgagccaccatgcctgacctgaggacttaattttggaagtgaggatgtacatgcgcgtgggctgattcaatcctcatcaccgctctatgacatagggataaactatggttcccactctgcagatgaggaaccccaggctccaggaggggatgcattgtgtgctgtgttacagcggcagggcaggactgagagctacttggggttggaggggtgggcaggagagctgctgcccaactcattcaggcacccccctccctacttcactccccagtcttcctttggttcctggtctctccctacccctccagaggactagcactttccccagcagtgtttggggtagatccaaggtcccgaagttcctgccacaggcactgtctgcgtgataggaaaggaaatctctgtccttcccctcggtgcccaacctcccgttggctaagccggcacctgggcgggcaagagggtagaatgaggctattcagagagttttcctgatgcaataactgattgcaaaacccttgcatccctgagcgttttatggaggttggtaattctaagtggcaccaggaaatcccaaacttacccagctgccagaacacagcccttcaggtcaaaccacagggaagaacagttaccccaaggctaggcgtcagagaaaca

SEQ ID NO: 254199 - DNA, 658 bp, Homo sapiens
tcatcaaaaacttcatactggagagaaactttacgaatgtgaagaatgtgacaaagtttacattcgcaaatcacaccttgaaagacataggaggattcatacaggagagaaacctcacaagtgtggtgattgtggtaaagcctttaattcaccttcacaccttattaggcatcagagaatccatactggacagaaatcttacaaatgtcatcagtgtggcaaggtctttagtctgaggtcactccttgcagaacatcagaaaattccttttggagacaattgtttcaagtgcaatgagtatagcaaaccatcaagcattaattgacatcagagtcaaatcagcattgacctgagtttgagttgacttaacattgatttcaagcattaatcgacattaaactgtttatgttaagaggattgggccaggcgtggtgtctcacacctgtaatcccagcactttgagaggccaagacaggtaggtcacttgaggtcatgaatttgagaccagcctggccaacagacgggagccacttttcccagcctgtatgttcttttatttatttatttatttttaagatggaatcttgctctgtcgcccacgttggagtgcagtgatgtgatctcggttcactgcaacattcacctcccaggttcatgc

SEQ ID NO: 254200 - DNA, 484 bp, Homo sapiens
tttttgtagtaaacgtccttgtgtaaataggctggcctgtttctgttagtatatccacaggttaaattcccaggattgaaaccattgagtatgggtatgtacagtttttattttgagagatgctatgaaattgttcccaaggaaggctacatcaaattatgccaacataagaaatgtttaagaggaactttctttcccctctgccctttgccatcactgggttttaccaaaacttcaccaaaatgtttccagtctcgttgaaaaaaatacttatcttattgttttcacttgctttagaaaattcagtaggtctacgcattctgttacatgtttattgttcattaaaaatctaaacatcctattcatcgtattcagccatttttttctgttgtttcttttattaatttatacgagctctttgtaaattaagaaaaccttttgtctgtttatgtattataaatatttttcctatttgaaaccaaaa

SEQ ID NO: 254201 - DNA, 569 bp, Homo sapiens
aatcctgctgggtaaggacagaagtgcaaagtcctattgccttaaggacatgccccacggcacccagtgctgggaaaactgtgagccatggaaggaaaacaaggtttgaaatgcgtggagccagaacctcgtctgtggaaaattcttccaaatttcatagttcctatatgaaagaaggctgatgacagtttctcaaattttacaacaatccagaacatttgtatggcaccgtcaacaacagattaggaagtttaactttcctaaactaccaataattaaaacacaaatttcaaccatgttaggaggaagactgaagtatcttttctctgtatggaaaatatctcccccaaaaatcacaaaatccttgtcctctgtagaggccttcagagtaagaagccagaccatgtaggggaccaaggtattagaaatatgtcaggaagttgccacaagttatgttatttttctggatttagtattgtagtatttgtcaatttaaaaaaaaagttttcaaaaaaaagtatcatcatttcttttctcattattttaattcacttccatttttgaattca

SEQ ID NO: 254202 - DNA, 331 bp, Homo sapiens
ggattacaggtgtgatacactgcacctggccaactcagaacttttaatttcctacctcagtactttgatggccatgaaagaaatggtcagttttcttcatcattctagatactttcattcagaaaaccaagaagctctacattgacagttgtgcttgaagaaacctaggctccatcaacactgaattgcaagatgtgcagaggctcatggtggccaatatcgaagaagtgttacaacgaggagaagcactctcaggtatctaaaagcaatgagtcttatgaagaaatggttctcattccattgaaccggatagcttattttgcagtgcctt

SEQ ID NO: 254203 - DNA, 543 bp, Homo sapiens
ttttccaataaggaaaaataggtataatttagtactatccaaagacatgggacacaaagttttatgtatatttatgataattctgaaaagcatagaaatgaaaaaggaccaaagaaatgcagcagagccttgatccctgcacttcacagagacgttctgcctgtctgtgagcagggacagtgatacatgattacaactgcctgagtcacttggcctaggtgtgctccccagccaggggaccagcccctcacacagctctgctgtgcagtcacttccaggaatgaagcaacagatcatatttcttcttggaaaatggccaaaagtgagagggaacctctgctgaaatctgaaaagccatgctgtggttttcatgtgcacatcgaatgtcattctactctcaacaggatccatgtaagaagggcaatcccaaatacaaacatttctaaattcttaaatataggcctggggaaggtctctagacatattcctccacgaacatcacaggtctacaataatacttaaataaaaataacaatggcgata

SEQ ID NO: 254204 - DNA, 642 bp, Homo sapiens
agctctggtacccaagccggagatgagtcagcttctctcgttagtgagcagtggatagtggagctcagactgagggactgggggcaaggagcaggggtggttgtccaagccacggagggaggagaagtgtcaccactggggacagcacagacaaatgaatgatcttgattggggttggtgaaaccccgttaacagttaatccaacgaggtggcacttgagctggggcttgaagaagtgaatatgatttcctccagcagaagggtaagtccaagggaagcatcgagggacacaagaataatgaagagtcagcaccataaggcagggcgagagcaaaataaataaataaaaaagaataatgaaaaatagttaagaatggtgcatgcagaacactgtcagcagtagtctggtgtccttcttttgtgggtaactgtctaaaaagaaaatcttttattttgttacataaagccaattcttctattttttaaatcgtttgttactattaaaatagagacaggtcttgctgtgttgcccaggctggtctcaaactcctgggctcaagcaatcctcccgcttcggcctcttaaagtgctgggattacaggcatgagccactgcccagccccttcttactctttaaattgt

SEQ ID NO: 254205 - DNA, 554 bp, Homo sapiens
ggtttcgctcttagttgcccaggctggagtgcaatggcgtgatctcggctcactgcaactcctgcttcctgggtttaagtgattctactgcctcagcctcccaagtagttgggattacaggcatgcaccaccacacccagctaattttgtgtttttaatagagacagggtttctccatgttggtcaggctagtcgtgaactcccgacctcaggtgatctgcccgccttggcctcccaaagtgctgggattataggcgtgagccaccgcgccctgccagttttcagtttccagtgtagagaccttgtataccttttgtcagatttattcctattattttatatttaggggtgttactgtaaatgctaattttaaaatttcaatttctcattgttgctggtatgtagaaatgcagttgacttttgtatattgacctgtattttgaaatagtactaaactcactaattagttctagtagctctttaaagtgactccctcagattttttacatagacagtattgctgtctctaaataaagagaattttactttttact

SEQ ID NO: 254206 - DNA, 440 bp, Homo sapiens
aactcctgattataggatgcaaaaatttcacttttgaggattaactatggtggatttttttcaacccaaatgggtgtacccttctctccagcatgttatggggctactttctaccactgccaaaatagaatgtagtagaagaattagaagaattccaagtagttttaataataactcctgggttattaaaaattaaatatctggggtaaaaaaaatcccattaaatatacatgtttgtgaagtacctcaaacatatatgtgttttacaaaattttacgtgtcattatttgctcctattagaacaagaaattgagaatgggtttcacagtgttctgttaatttgattactgtgtcctaagtggtaagtataaacctccttatgtattttgtgaagctcacttaatcaagcaaatattataaaacacactatcatatcacta

SEQ ID NO: 254207 - DNA, 949 bp, Homo sapiens
aatctactactttaaaaaattagtaatattgataaacctatatagcaagactgacaaaaaaacagccacaatcacaatatcagaaatgaaatagaggctatccatgctgatattaaaaggtaatggagaactattaggaacaagtttacctcataaattcaacaacttaaacttgaaaaccacaagctactaaacctcaaccaagatgaaacaatctgaatagccttacacacaataaataaattgaattcattattaaaaagctccaacaagctaaagaaaaatatatgatcatatcaatctatggagaaaaagcacttgaaaagatccaatactaaggtatttttttttcgttttttaaagaaagaaaaaaaaaacctcttagcaagttaggaaaggaaactatctcaacttgataaataacatcttttttaaaaaactgcaactaacatcttagttaatggtgaaagactgaatgctttctctttaagattgggaatgggtgaaggatgtctgctatcatcactcgtatttaacatagtaccggaagttctagctactgaagttctttctagcaggaaaaaaaaacgcatacatcgtgataaaaagaaataaaacaatccctatttccaggtgacatgcctttgcagaaaatcccaaagaatctaaaaaacaaaacagaaactcttagaactaacagcaaggtctgaagacacaagataaacacataaagatcagtcaatttttatatatgaacaatgaatatatggaaactgaaattagaaatgtaataccattacattcactccaaaaaaaataaaatacttagttataaacttaacaaaatgggtacagaatcctgaaaattaccaaatactgacaaaataaatcaaaaagccttcaaatcgaagaagttttcaataaataatgagacataccatgtgcaaaa

SEQ ID NO: 254208 - DNA, 301 bp, Homo sapiens
ccaagatcatgccattgcactgcagcttggacgacagagggagactctgtctcaaaaacaaaacaaacaaacaaaaaagaaacgaacaagctcagagtctccttgtccactaagggagatggagggcagtgtatgtggcttgccccacaccgacagcagcataaaaacgatgatgagcaaggcataggtatacctttttttttttttttttttttttttgagacagagtcttgctctgtcgcccaggctgaagtgcagtggtacgatctcggctcactgcaagctccgcctcccgggttca

SEQ ID NO: 254209 - DNA, 479 bp, Homo sapiens
gaacgatggtcctcagcttttgaaacatttgtgcctctattactatgtatcaggcactgaactgaatgcctagggatagaaagatgagactgtagaccctgccctcatgagctcatggtctagtatggaaaacagccatatgaacaaataaccacactataggtcttcagagctcaaatcctatcctaaatactgctaaattaatgttctgtggggttttgaaagtactagggccagagacaatatggctgcttggatgactttccatcaaagttaacattcagccttcaccaccaaaggtggtgtgtgtatgcctcttccttgcaacccaccagggcctaacacatcatatcaccacttctgaaattaggaaacaggctcagaagtccaagagcttgaccaaagtaactcagctggtatgtagcagaaccaggtcagtatgattcttcttcagtatcttgccagtaaatgggcaagtg

SEQ ID NO: 254210 - DNA, 370 bp, Homo sapiens
ttgaggcttcaggaggggagggtagagtctgcagcagggagccccaggagtcaccagcccaaagtcacccagggacaactggtgaaggaaacaggctcagaagtccaagagcttgaccaaagtaactcagctggtatgtagcagaaccagctctcatacaaagatgacctgaggacagagacagtagaggacagtgcagggtagtgcaagaagctgtggctctggggtctggtcaagatgcccctttcttctgttaggaagctttcccactcctctgcctgctttcgcatctcttccaaaatacaagtgattgcatgtgactcccttgttagagcaggctctcaataaataggctttgcttgatttcaat

SEQ ID NO: 254211 - DNA, 932 bp, Homo sapiens
attttgttaaataatgtagagctgattttttgtttagtttctcctactaattcagacagatgtgcttgcctgctgtttatttaaagcctagtaagaattgaacagggcactgtcagaaactcacgtatggcactcctcctcccttaacacacacagccttcacagaacgaccccaccccctatacattaaatttttgaccatcagatggcagctgacagcctcatctttgctgctgtggagttcccaactccaatccacaaagaaagccctgccccaagactgtctgctccatctttgggggaggcagtccaagttagaagcaggcagcagcacctctatccactgctggaaggatgccaatattgccagtatccatgggtaagaaggcattcttctgccctgtgtctctgaggtaagcacatcattgacctctaggagtcaagagggtgttagttgcctcaggaagggcactgttgattgtttttttctatttagatccattggcattataataaactgaaattactcctggttttgttattatgttcattatctgctgctaaatatatttacccatttaaatgttagggttgttattttaattaaaaattgggaatgtgagtcctggttccctaggcttatattacaatcttccttgggaatcacctacattttttttaataccgttctttaggcattcacaatgttttattcacagatggaaaagaaactggtgaaacattcacatttaaaaggcattctcaagatgctagtcaagatgtaaagttgtattcagatacaggtaaattaatatttgtataatttgattcttttagattgtggttctaaaaaacacaagtagttccctcagaatttagaagaagaaatgtgtgatttttcaaaaaaaataaaagcatgattaatacccaag

SEQ ID NO: 254212 - DNA, 1507 bp, Homo sapiens
attttgttaaataatgtagagctgattttttgtttagtttctcctactaattcagacagatgtgcttgcctgctgtttatttaaagcctagtaagaattgaacagggcactgtcagaaactcacgtatggcactcctcctcccttaacacacacagccttcacagaacgaccccaccccctatacattaaatttttgaccatcagatggcagctgacagcctcatctttgctgctgtggagttcccaactccaatccacaaagaaagccctgccccaagactgtctgctccatctttgggggaggcagtccaagttagaagcaggcagcagcacctctatccactgctggaaggatgccaatattgccagtatccatgggtaagaaggcattcttctgccctgtgtctctgaggtaagcacatcattgacctctaggagtcaagagggtgttagttgcctcaggaagggcactgttgattgtttttttctatttagatccattggcattataataaactgaaattactcctggttttgttattatgttcattatctgctgctaaatatatttacccatttaaatgttagggttgttattttaattaaaaattgggaatgtgagtcctggttccctaggcttatattacaatcttccttgggaatcacctacattttttttaataccgttctttaggcattcacaatgttttattcacagatggaaaagaaactggtgaaacattcacatttaaaaggcattctcaagatgctagtcaagatgtaaagttgtattcagatacagccccaacagaagacttgatagaagaggtaactgcagatcatccagaggttgtgaccatgattgaagagactataaaaatgtcacaggatataaactttgaacagccatatgaaaaacatgctgaaatcttacaggaagtccttggagaggtaatggaagaaaacaaggataggtttcctggtgccccaaaatatggaggctggattgtggacaactgccctattgtaaaagaattgtggatggccttaatcaagaaaggaattatacctgatttggtcatctatttatcagatacagaaaacaatggaaaatgtttatttaatagaatatatttacagaagaaatctgaaattgactctaagattttagaaagattattagaagaactacaaaagaaaaaaaaagaagaagaagaagcaagaaaagccacagaagaggaattgagactcgaagaagaaaatcgaaggctactggaacttatgaaagtgaaggcaaaaggcaagcacagattgctatgactgatgatgtgtcatggtattgttactgcaagcaattgcagtatttcaagtgaattatagactgggtgatcacatttcccaatttgtccatgagagcccaggtttatgcctatattcttgaagtctttatagtaccttttattcttaaagtgttccagtttgtatactaaataatattgttactga

SEQ ID NO: 254213 - DNA, 516 bp, Homo sapiens
actttcttgggtcagatattatcaatcatgttttattgcaagtagtattgtccactaaaattattaatggcattaatttatcagcttattttactttagccccaacagaagacttgatagaagaggtaactgcagatcatccagaggttgtgaccatgattgaagagactataaaaatgtcacaggatataaactttgaacagccatatgaaaaacatgctgaaatcttacaggaagtccttggagaggtaaaaaatctagctgggcaattcttatcagtgacttaactattactgagaaaatgttaatctaatatgtgtgtaattattttagagtcttatgatgttgaaatttgtagccttcaaattcatgtacattttgtagtcagcattgttaagtgcgaagtaccccagtgaacaactactgatgctctttggtaaattttcaattacaaacaaaattatgtaatataactttatgctttgaaattaattcttcattaaattttattgtctt

SEQ ID NO: 254214 - DNA, 525 bp, Homo sapiens
gccagggttattttctctgtctttttccacagccttgtgtggcttctactgcttgtgattctgaatatcttctatctcttattctcataaaaaggaaagcagtgtttctgtttttcacctttattgtgttttttgaaatgatttccaagtagacgagagttcaagatggactttattacaccatttctaaccagaaatatttctcttaaataagcattttagtaacaaggtcttgagtcagctaggaatagtgggtgaagatgtaaaaatacttacactgtttccatttagcaatggggctgacttggtgacataagaggatttcttgataaagaaggagaaaatcagaaaggttatatttgtgaatttcatatgttaaccagctctttgtaacttttagtaatgtatgttaacgtttaagcataaaatgtagctattttaagtatcaggaattttagaactagctttcttcctgaattgtagtaaaaatcaactatttatggaatgggaacctttgtctaaatc

SEQ ID NO: 254215 - DNA, 421 bp, Homo sapiens
aatcacagaattaacattacgttaattaattcatttgtatttttccatgaaaatgttaaaaacataagtgcaatctttgtagttgtgtattctgctgtgtcattaaatggtttttagaaagctcaaaagctgccaggcacagtggctcatgcctgtaatcccagcactttgagaggctgaggcgggaggatcacctgaggtcgggaatttgagaccagcctgaccaacatggagaaatcccgtctctactaaaaatacaaaattaaccaggcatggtggtgcatgcctgtaatctcagctactcgggaggctgaggcaggagaatcacttgaaccctggaggcagaggttgtagtgagttgatcgtgccattgcactccagcctgggcaacaagagcaaatctccatctcactaaaaaaaa

SEQ ID NO: 254216 - DNA, 418 bp, Homo sapiens
tgtgcatggaagggcactgccaatcttccacctctatttcttgccattcttccccttgcctaccacattctagcaacatcaacttgtttcccatgtatagaatatccctagaactttcctgtctctggcctttgcattttatattgtctggaacttgctttaaccagctcttgccacagttgacttctcagtttcctccttctcagaggccttctctgaccttcctaagtgccacccaccaccaggtagtctcttacacatcactctgttgattttcttcttaatgtctactccctcttccaccagaatgtaagccccatgaggggtggattcaagtctgctttggtaaccactacattgctagtgtcaggcacatcctatgccatattggttgaatcaaaggaaagatggatgtatg

SEQ ID NO: 254217 - DNA, 501 bp, Homo sapiens
tgaatacttgataataactaactgtcttactggcttttgtatttactatcagagcatatcctgtcattaagtgatgcatgactgtattttcgcagaattctgtgaatcctaaacccggcaggcatggtcacgtgggaagagaaaaatgtcatggaaacaaatttgcctttggaactaagtcacctttctgtttcctcgttcccaaattttattccaggaggcatttttccctaaggcagcccagctgccccggactgctttagattggccttgttattcccatctgtgctctacacgccacattcctgagtgtagtttattattgctttgtttcccatgtctgcctcttcatccattgaagtttatttcttctacatcttgtacactcaagatcaggcattttgccttccagaataataatcatagaaaatatcaattcgtgctagaaacaatatttttatttttataatataaccaaaataaagtgttttaagttccaaa

SEQ ID NO: 254218 - DNA, 471 bp, Homo sapiens
tctcggctcgctacaacctccacctcccagccgcctgccttggcctcccaaagtgccgagattgcagcctctgcccggccgccaccccgtctgggaagtgaggagcgtctctgcccggccgcgaccccgtctgggatctgaggagtgtctctgcccaactgccaccccgtctgggagctcttcaaggggagcatctgctgaacaggacgggtgaagtgatgggaagcaggagcaggcctgcggtcgcagtgagtacatcacattgcgtgatagggaatggggagtgtctgtgggagactggccagaggtcgtgtctttcacagatataagtgcgagagggattctggatgtgctctcagtttcgcaaggctcttaatgaacttctttgtcacctgtttgggctctgattttccattgttcagaattccatataaattacaatggaaaaataaaaaaaattaactcttgttg

SEQ ID NO: 254219 - DNA, 1862 bp, Homo sapiens
aaaagctaccagcctcacggagaaggcgcagtccctgtccacagagacacagccttgccccagttactgcccacctgcaagagatccacatttctgccctccagagctcccaaactgatgggggagagagacatcatcccccagctctgggagtttccagtctgatggaggagacagagcctgcttcggtaactctcactctgcgggggaagactcagccctatccagggagctcccacactttcaatggggaggcccacccagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaaggcctgcctgacgaggccttcgagtccctcacccagctgcagcacctctgcgtggctcacaacaagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccaggtcaggcacaggctggttagccacactgtccccagggcccctccatccccctgcctgccctgccacgtcccaaacattctagttagctggtaaagcaatcagaacaagaaaatgataagagtgggttagaaggtgatgaggaggctgggtgaggtggctcatgcctgtaatcccagcactttggggagccaaggcaggagaatcgctttaggctatgggtttgagaccagcctggcaacacagcaagaccctatctctaccaaaaaaacatagccaagcgtggtggcacatgcctgtagtcccagctattcaggaggctgaggcaggaggatcgcttgagcccagaagtttgaggctgcaatgagccgtgatcgggccactgccctttagactgggcaacagagcaagaccctgtctcttgaaaaaaaaagtgatgaaagagg

SEQ ID NO: 254220 - DNA, 448 bp, Homo sapiens
cgagacacagaggcacacagctggcatactccaggctcacagaccacgccggcctggcgggacacaccctaccccaaactcccaacacagatggaggcagcaacaataaagccaaacccttccagcactcagcacggaccaggcaccctttgggggctctgtccacggactcctccccacaaccagtccagctggggaaactgaggctctgggatgctaagtgggtcaggactgaattttgaggtcttgaggcacacactggggtcaccaaacagcaccctgtgcgacctagccacgtgtgattgcagggacgcccaaggccacccactgaaaaaacactgggtgacagatatagggaccctcacatgtatccccccccacagcaagcatgggaatgaaatgcatccttcaagctgggtgtgtggtggtgcccttctgtaatccgtta

SEQ ID NO: 254221 - DNA, 1239 bp, Homo sapiens
caagtgatggagatcttccccctcacctttggggagaagccggcactcaggtccgtgtacctccacaacaaccagctgagcaacgctggcctgccccccgacgccttccgcggctccgaggccatcgccaccctcagcctctccaacaaccagctcagctacctgccgcccagcctgccgccctcactcgagcggctccacctgcagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccagatgctggacctcagccacaatgagctgtcctttgtgcccccggacctgcctgaggccctagaggagctgcacctcgagggcaaccgcatcggccacgtgggccccgaggccttcctcagcacaccccgcctgcgtgccctcttcctcagggccaacaggcttcacatgacgagcatcgcggctgaggcttcctggggctcccaaacctgcgtgtggtggacacggcagggaatccggagcaggtcctgatccggctgc

SEQ ID NO: 254222 - DNA, 1612 bp, Homo sapiens
aaaagctaccagcctcacggagaaggcgcagtccctgtccacagagacacagccttgccccagttactgcccacctgcaagagatccacatttctgccctccagagctcccaaactgatgggggagagagacatcatcccccagctctgggagtttccagtctgatggaggagacagagcctgcttcggtaactctcactctgcgggggaagactcagccctatccagggagctcccacactttcaatggggaggcccacccagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaacaaccagctccaggaactcccctacaatgagctgtcccgcctcagtggcctgcgaaccctcaacctccacaacaacctcatctcctccgaagaacaatctcatctccaaggtgccccgaggagccctgagccgccagactcaactccgtgagctctacctccagcacaaccagctgacagacagtggcctggatgccaccaccttcagcaagctgcatagccttgaatacctggatctctcccacaaccagctgaccacagtgcccgccggcctgccccggaccctggctatcctgcacctgggccgcaaccgcatccggcaggtggaggcggctcggctgcacggggcgcgtggtctgcgctatttgttgctgcagcacaaccagctggggagctcagggctgcccgccggggctctgcggccgctgcggggcctgcacacgctgcacctctatggcaatgggctggaccgcgtgcctccagccctgccccgccgcctgcgtgccctggtgctgccccacaaccacgtggccgcgctgggtgcccgtgacctggtcgccacaccgggcctgacggagcttaacctggcctataaccgcctggccagcgcccgtgtgcaccaccgggccttccgccggttgcgtgccctgcgcagcctcgacctggcagggaatcagctaacccggctgcccatgggcctgcccactggcctgcgcaccctgcagctgcaacgcaaccagctgcggatgctcgagcccgagcctctggccggcctggaccaactgcgggagctcagcctggcgcacaaccggctccgggtcggcgacatcgggccaggcacctggcatgagctccaagccctccagatgctggacctcagccacaatgagctgtcctttgtgcccccggacctgcctgaggccctagaggagctgcacctcgagggcaaccgcatcggccacgtgggccccgaggccttcctcagcacaccccgcctgcgtgccctcttcctcagggccaacaggcttcacatgacgagcatcgcggctgaggcttcctggggctcccaaacctgcgtgtggtggacacggcagggaatccggagcaggtcctgatccggctgc

SEQ ID NO: 254223 - DNA, 892 bp, Homo sapiens
aaaagctaccagcctcacggagaaggcgcagtccctgtccacagagacacagccttgccccagttactgcccacctgcaagagatccacatttctgccctccagagctcccaaactgatgggggagagagacatcatcccccagctctgggagtttccagtctgatggaggagacagagcctgcttcggtaactctcactctgcgggggaagactcagccctatccagggagctcccacactttcaatggggaggcccacccagtggccgagcctgctgctgctcctgctgttgccggggcccccgcccgtcgccggcttggaagacgctgccttcccccacctgggggagagcttgcagcccctgccccgggcctgtcccctgcgctgctcctgcccccgagtcgacactgtggactgtgatggcttggaccttcgagtgttcccggacaacatcaccagagccgctcagcacctctccctgcagaccacgccggcctggcgggacacaccctaccccaaactcccaacacagatggaggcagcaacaataaagccaaacccttccagcactcagcacggaccaggcaccctttgggggctctgtccacggactcctccccacaaccagtccagctggggaaactgaggctctgggatgctaagtgggtcaggactgaattttgaggtcttgaggcacacactggggtcaccaaacagcaccctgtgcgacctagccacgtgtgattgcagggacgcccaaggccacccactgaaaaaacactgggtgacagatatagggaccctcacatgtatccccccccacagcaagcatgggaatgaaatgcatccttcaagctgggtgtgtggtggtgcccttctgtaatccgtta

SEQ ID NO: 254224 - DNA, 228 bp, Homo sapiens
gggccccgaggccttcctcagcacaccccgcctgcgtgccctcttcctcaggtgccccgagggtgaccggaggggtggaggtgggcaggggagggcctgggagggtcatgaccgcctctctgtgcagggccaacaggcttcacatgacgagcatcgcggctgaggcttcctggggctcccaaacctgcgtgtggtggacacggcagggaatccggagcaggtcctgat

SEQ ID NO: 254225 - DNA, 487 bp, Homo sapiens
acaagccagtgattctccaaagtctcccattgtgatccatacagcagttggtggcttcagatgggcctctgttagaacagttaaatgcctagggctggggaccattggtgggtttaggatgaagattattcacaggaggatgacagcaagccagagcgacgctcagcctttcaccatcctctgagtagctgagtcatagctaacaaggtgtactcatgaatcctgccaaagctgctataatctcatcatggctttcaatatcccagaatattcactaggaaggccaaatgattgattaagctttatggtaaattaccaagctgaaattcttctccacataatgtccttaatggaagcccacatgccccacccacccatcttaaaggtgaaacgatcaaagctcatttcagacacccatgcagtttcaagacatgctgtttttatgcctctgctggccatctggctcaatttgccctgcctcatagga

SEQ ID NO: 254226 - DNA, 369 bp, Homo sapiens
tggctcgaactcggctcactgcaagctctgcctcctgggttcatgccattctcctgcctcagcctccggagtagctgagactacaggtgcctgccaccacgcccggctaatattttgtatttttagtagagacggggtttcgtcattttagccaggatggtctcgatctcctgacctcgtgatccacccgcctcggcctcccaaagtgctgggattacaggcatgagcaaccgcacgcgcccggccatgctttattatcttagccaaagacgtttccacctgaatgtatggattatacttaccttcctggtttgaaagacttacataattcaaaaacattattaatgatttaatagcctctagttaaag

SEQ ID NO: 254227 - DNA, 304 bp, Homo sapiens
tcctggtacgtcatctgactgaaaagtgctgtgaacctagtgtcaaggatctagaagagcgccctaggcatcctctcaagacaagtaccttccttttcacagggtcgtgctacccggaagcattccagaggctgacagagaaaggagactcaacacttcccttcgaaaagtgaaaactcagaaaaatctttatatccacccttcatccttactactgcactttaagatcttatgagttaggattttgttttgttttattaaagtttatacttattaaagtttaggccaggcacagtggctcaca

SEQ ID NO: 254228 - DNA, 318 bp, Homo sapiens
tgccaccctatccattgttcgattgtaaaatgatgcagccactttggaaaacaatttatcagttgcttaaaatgtaaaaaatagaatcgccatgtaacctagcaattctactcctagtgtctacccaagagagttgaaaacatgtccatacagaaacttgtacactcaagtttgtagcagcatggtttaatagctaaatagccaaaaagtggagataacccacacatctatgatctaatggatggctaagtagaatctggtctattcatacaatggaatattattcagcaacaaaaaggaatgaagtcctggtacatg

SEQ ID NO: 254229 - DNA, 379 bp, Homo sapiens
gtctcttatttcttcctactgtcctgcctctatataatgtcacttaattgtatatttttaaaactgttggatttgtgttataacctttgtggcttctaggcttgctgtctctgagctaggtaatttaaaagaaacagctatttacatagtgtttatttcatccttagtaaaacaaaacctgtaactgaggacattctcatggctccttccattagagttgtgctcccatcactttctctttgcccaaaaggaaatctctggctcatatttcagtctctacagtacctcttctcaccttgattttactctttcaactattgtttttattatgcactttctactccatgtcctataaaaactatggtttaaatcatttttg

SEQ ID NO: 254230 - DNA, 448 bp, Homo sapiens
gcatggctcctgaccatatgccccgctgtgtctgcagggccacacgcatgctgcgtatggtcagtcctgttccacaccttttgcagcatggctccgtagccactgtcgcagttttcagactctttttctcctacctgccagtaacgagcacagccctggacccagctctaatcaggtgaaatcacaagggacacatcttcataaagcagacctgctagagacctgagacgtgtttgtgccccttttcccctgattcgaggagtgcaggggaccgctcgggagctcctctgagactgcctctttcccttgttcctttgggtgtttgaagcctgttgcctcctgctttcccttttcttttcccttttaaaaaattctccattttttgacttagaaaaaaattatttatacgattgagatccactaattaaagccattttctggtatttgg

SEQ ID NO: 254231 - DNA, 350 bp, Homo sapiens
aacaataaaaaaaagttttatgaatggactaccagtttttgcttttttgaaaagaaatattacaataaggttatttgctcaaataaaacctacctgacactcttgcaaatgtttagggagggaaagtgtgtctccctttatatttactgtttctctctgaagccaatttcatttttttcaacatcctggccatctgcattcatataaagtggttattttcatggataattcaccttatatatgaaatataaaaggtatctggaataaattcattgcaaaattgatgttacctgttaaatcttcctagtagtttgttttcaccaaaataaaatgagtgagatttactgctt

SEQ ID NO: 254232 - DNA, 448 bp, Homo sapiens
ggattgtgattaggatgggacacatacgggagtttctaatttcctgctgtggtcctggatggtggctaaaggggattcactttacaataatccgctaagctacttcattcgactctgagggctaccataacaaaataccgcagactgggtgacttcaacaacagaaattgattttcccacagttctggaggctggaagtgcaagatctaggtctcaaatgggttgttttctcctgaagtctctttccttggctcacaaacagccaccttctccctttgtcctcacagggcctttcctctgtgcatgtgtgtccctggggtctctccctcttcttttaagaagttgccagccagactggattaagaccccccgtcaatgacctcgtttaaccctagttacctctttcaaggtccaaacatagtcatactgggggtcagggcttcacata

SEQ ID NO: 254233 - DNA, 484 bp, Homo sapiens
agcctgggcaacacagaaagaccctcatctcaccaaaaaaaaaaaaaaaagtaaaaagatacatactaaaagataatctgtaacctacgtataatcaacaagattagtatgtagatgatgcaaagaactcttataaataaaaaatactagcagacttatttttttctttattttttgagagagtcacgctctgtaactgaggctggagtgcagtggcataatcttggctcactgcaacctccgcctcccaggttcagcgcccctgaggagctgggactacaggcatgcgccactatgcctggttaatttttgtacttctagtagagacagggttctgccatgctggccaggctggtcttgaattactggcctcaactgatccatccgcctcagcctcccaaagtgctgggattacaggtgtacaccctgcccagccacaagccgatttttaaaaggtcaaatgctatgacagccattttacagg

SEQ ID NO: 254234 - DNA, 383 bp, Homo sapiens
ccaggaagctctgaaaactcaggcttggtagacagttccttttgcaatgcatgtaaaatgcttaacatgtgtagcccatccttcataaaggttagccatcaagagaagaatatcttttattcttataattacagatgacaaatgctctcttaatgctgtggggatagtggtggttatcattattggtatgtggttttattttaaaggtctatgaatcacaggtacctgaccattggttaaatgagctgtaactggatggtcattatgacccaagtgtgagggactagggctagtagatacttactatgaatgacagggaatcctcactgtgggtaactactcagagtttgtgagtgaagtgactatagtaacctgaaaagaag

SEQ ID NO: 254235 - DNA, 460 bp, Homo sapiens
gtatatacccaaaggattataaaacatgctgctataaagacacatgcacaggtatgtttattgtggcactattcacaatagcaaagacttggaaccaacccaaatgtccaccaatgatagactggattaagaaaatgtggcacatatacaccatggaatactatgcagccataaaaaatgatgagttcatgtcctttgtagggacatggatgaagtgctgcatttctaacaagctcctaaacgatgctaaatctgctggtcctcagactactctttaagtaacaaggatatagttggttttagcaatagtgacttaaagattttttgctatttttgtttttatctacccatttttgtattcactaaaatgtgttctggatgcaaacttctttaatacaaagggaaaataaattaaaagccaactttgcaagaattgaattacacacattttaaacttaaa

SEQ ID NO: 254236 - DNA, 372 bp, Homo sapiens
ccccttcaatacgaaaaaaatctacatgggcctggactttttttctttaggaaaaaaaatcaccattatctggccaggcgcgatggctagtgcctgcagtcccaacactttgggaggccgaagcgggcagatcgcttgagctcagaagttcaagaccagtctggacaatatggcaaaacccggtatctacaaaaataaaaataaataaaaataaaaattagccaagcatagtggcactgtgcctgtagttccaactacttggggggctgaggtgggaggatcacctgagcttgggaggttgaggtggtggtgaacagtgattgtgccactgtactccatccaggcgacagagtaagaccctgtctgaaatta

SEQ ID NO: 254237 - DNA, 461 bp, Homo sapiens
aagtcttttcctgattaaggaattgtcagctgaaatcatcagggatttccccttaactattttggaagaaatctgaagaatgtaatgtgttgcttggaaattaagaaatttggaataattcatgtgaacctaaatggtgaaatagaatcaagaaatgatagttttcttaaaaataagatggccaggcacggtggctcacgcctgtaatcccagcactttgggaggccaaggcgggtagattacctgaggttgagagttcgagaccagcctgaccaacatggtctctactaaaaatacaaaattagccaggcatggtggcgcatgcctgtaatcccagctactcaggaggctgaggcaggagaatcacttgaacctgggaggtggtggttgcagtgagcagagatcaggtcattattgcactccagcctgggcaacaagagcaaaactccatctcaattaaa

SEQ ID NO: 254238 - DNA, 6199 bp, Homo sapiens
  misc_feature (1106)..(1106): n is a, c, g, or t
  misc_feature (1601)..(1601): n is a, c, g, or t
  misc_feature (2918)..(2918): n is a, c, g, or t
  misc_feature (3896)..(3896): n is a, c, g, or t
  misc_feature (4695)..(4695): n is a, c, g, or t
  misc_feature (4925)..(4925): n is a, c, g, or t
  misc_feature (5392)..(5392): n is a, c, g, or t
  misc_feature (6175)..(6176): n is a, c, g, or t
  misc_feature (6178)..(6178): n is a, c, g, or t
  misc_feature (6182)..(6182): n is a, c, g, or t
  misc_feature (6184)..(6184): n is a, c, g, or t
  misc_feature (6186)..(6186): n is a, c, g, or t
  misc_feature (6188)..(6188): n is a, c, g, or t
  misc_feature (6191)..(6191): n is a, c, g, or t
  misc_feature (6193)..(6195): n is a, c, g, or t
gagggacttctgtaaggcggcacgaccacaccaaataacagcagcagagggaggtgggggagagggaaataaaggggagtcatgcttaaaatgctacagcggtgtgaaacagcagagcaaagaagcgcccccagcttctgagagccctggcccgagtcccctcccccgttagaaacagggctttgggatggtcatggagcactgccagtaactccaaccgcagcacgccggcctgctcgcccatcctccggaagcggtctcgctcgccaaccccgcagaaccaggacggagacaccatggtggagaagggctcagatcactcctcggacaagtccccgtccacaccggagcagggcgtgcagcgcagctgctcctcccagtccggccggagcggcggcaagaattccaagaaaagccagagttggtataatgtgttaagccccacctacaagcagagaaatgaagacttcagaaagctctttaagcagcttccagacacggagcgcctcattgttgattactcatgtgcactccaaagagacattctccttcagggccgactctacctctctgaaaattggatctgcttctacagcaacatcttccgctgggaaactctgctgacagtccgtttgaaagacatctgttccatgactaaagaaaaaacagctcgcctcattcccaatgccatccaagtttgcactgattcagaaaagcacttcttcacttcgtttggggcccgggataggacatatatgatgatgttccggctctggcagaatgctctccttgaaaagcctctgtgtcccaaggagctctggcactttgttcaccagtgctatgggaacgaattgggcctgaccagtgatgacgaggactacgtgccccctgacgacgacttcaacacaatgggatactgtgaagagatccctgtggaagagaatgaagtgaatgacagctcatccaagagcagcatagagaccaagccagatgccagtccacagctgcccaagaaatccatcaccaacagcacactaacatccacagggagcagtgaggcccccgtctcgtttgatgggctgcccctggaggaagaggcgctgganggagacgggtccctggaaaaggagctcgccattgacaacatcatgggggagaagattgagatgatcgctcctgtgaactccccttcactggacttcaatgacaatgaggacatccccactgagctcagtgactcttccgacacacacgatgaaggagaggtccaggccttctatgaggacctgagtggccggcagtacgtgaatgaagtcttcaacttcagcgtggacaagctctatgacctcctcttcaccaactcgcccttccagcgggatttcatggagcagcggcgcttctctgatatcatcttccatccatggaaaaaggaggagaatggaaaccagagccgagtgattctttacaccatcacccttaccaaccctctggctcccaaaactgccactgtcagggagacacagaccatgtacaaggcgagccaggagagtgaatgttacgtgatagatgccgaagtcctcacccacgacgtgccctaccangactacttctacacaatcaatcgctacacgctcacccgtgtggctcggaacaagagccgactcagggtctccacagagctgcgctatcgaaaacagccctgggggttagtgaaaacgttcatcgagaagaacttctggagtgggctggaggactacttccgccatttagagagcgagctggccaaaacggagagcacttatttggctgagatgcacagacaatctcccaaagagaaggccagcaagactacaacggtgcggaggaggaagcgtccccatgcccacctgcgagtccctcacctggaagaggtgatgagcccggtcaccacgcccacagatgaggatgtgggccacaggatcaaacatgtggcaggttccacacagacgcggcatatcccggaggacacccccaacggtttccacctgcagagcgtgtccaagctgctgctggttatcagctgtgttctggtgctgctggtcatccttaacatgatgctcttctacaaactctggatgttggaatacaccacgcagaccctcactgcctggcagggtctaaggctccaagaaaggttaccccagtctcagacagaatgggcccagctcttagagtcccaacaaaagtaccacgatactgagctccaaaaatggagggaaatcatcaaatcctcagtgatgctccttgaccagatgaaggactcgctcatcaaccttcagaacggcatcaggtcccgcgactacacgtcggaaagtgaagaaaagaggaatcgctatcattgacaaggcaggaacagggtggctgcaagaggcctgtgcaatacatgtacatagaccatataaatatatatatataaatatatatatatacagaatataaatatatatattatatacagattttaaaaaagagataatgcctatgtaccagggagaaggagcgggccctcccgcgccctgtgctggccggagcagcgttttcttatggtggagcagctgaggagggcaggaaccgcctctcagcaccgacctcccctgatctccctcctcccaccctctgttccccaccccttcccttgctggccattcttggcttttagaagggaaatgttgagccaaagttatgcctgcgaagaccctaaggtctcaaaaagaagtcttaagacggcattgcttaaggtgcttcattccctaatccccttttgatttgtttccaaaataaaagagaatcttttcttccctaccccaggcttccccaggcattctcttgggaacacagaagcatcaagggagcccagtctaaactcctagggttggccncccacttgatccggaccgtactgagtgtcagatggagaggatgcttggaaagctaggaaggctgcattgtgtggtggcaggctcccgagactcgtgttctgaaggatactctcctccatcacccctgcaccttcctccgacctgtgtagggtgtggacccagtaagggctgggaatttcttactttcccacccgctttctctctggtcttctcccaggctggatctgggcgaagtgtcactttttagtgcctaaagtcctattgtttctctgtgccctaagagcacattgtttattagccagggtggagcgttttcgaccttattaaacctcttttagtgcttctaagcaagtcaggtctgtggctctgaggccttcacttagagctgtcagtgtgatttccaggatgagtcagggtgtgctgggccctccaggatttgagagagggagagaaggcccttgccacgtccggggtgcagggtctacccacagaacactgtgagtggtgagcaccaagatgggttgccagcctcatttgctctttgaacgaaccaacattagccagtggagacgactgtctgagacagtttgcacatagaaaaagcatctgagccactggagggaaggatttggcaaaggtgcatgtgtttgggcaggaaaaggccaagtgaaatctatgccctacgggagccattcccaatcctgagtttctcagacttggcaatgggggttctggcgggggttggagtacaaatcctgctctggtctctggccccacagaggtgtaagatcattaagaagtagaaggcactagcttcaaagagtgagacattcagggccttttcagcattggcccactagcaccatgcatttatctgaattcacggggccctctgggcacattcatcatccctcatacactaactactgtttcttcatgtaatgaccaaaagagtcccaccagctccaggcagagctngtggagattcatgaaagagtcacagccagtttggcatgcagaggtcttcagtcttgcttattcttctcctgggcttcttgacacaggggcagaagaaaccccagatgtcccagatgtcccagaacatcagcccaaaagacagaagattttatcactcatctaccccaaagataaagttgtatttttttcttagaatggcctttaattccctgtggcaattacagtttttgacttttccatgtgagaataaggccttggtatttccctaagggcaggatcagaaaacaggaaggtccatgcccaggtgatcctccaagggaggagggtgaggaggctccagggcatgagctagagtggatattcctcccctagaagaggagatgggaggaaatgcagtttcatgtaatccctgtgaagagtgcctatgcccacagcccagtgggtccttgttcagttcttgtccaggcctttgggtgagggacactggtagggatcaaggctcatgggctctgagccaaagaaggaggcatggtgcagactgctggaaatctcccccttggcacagccagaagccaaaactattcccagaaagttttgaatgcaaaacttgtagattcctgaatttattccatacataattatttccttaagttatttaattattaaaggtgccacggtgggacctttgggatgacttaaaaagggttctttgttgggagtcaagtgacagagcagacctggccgcagggagttgttctgcttctgctttacctctcaggaccattcccaggaggaaaangtggcagagagggcagtactgagtatgtcagaagagccctcctggttttttagcgatttgaacccactagacaatgtgtgcacatagggaatgtcctttaagaatcatggatctcttgtaggctctctgtgttccaataattttttgactatcataccaggaaaaaaccaacaactctattcattcccaaacaaaatctcttcccccttagtcaatagcttgcgaaaganatcttaactcacccttgcagataagtcttggagtgaaacaaataaatagcattgtattcctggccatttgcctggctagttgctgtctacaagggagcatcaaaacatcactacttcttatgtaacttcttccagccagtgcttttattgttcgttttagtttactggggacacacaggagtctttctgtaatgacttatgtggtaaaatgtttgagagtttgcactcaattttaaagaatttgcagtttctaacaaggtgaagaacagctataggatctaaagttccattacagcttactgtgaaagaattgacaagactggcctcagacaagctaatcatggtgcgactctctcccttcctcatccacctctttggggacaagaggattacatctcaggccagcaagatcagctgcttgaagctctgtgtaagagcactgcactgacggtttggagacctgagcntgggtcctgacttttccattgactaagctctgtggccttgggcaagtcactccccctctctgagcttcagtatcctcctgtcacaggagggagttgggctagatcatctttaaggtaggttctagctttgacatcatcttgggggttaggccagaggctgggaagactgggtggactttctcaattgctctgccaggagggaacaagcccagaggctgaagcttcccagtatttagaggtgtggtagggcagtgtctgcattcccaggagacccagggtgattaaaatttattctttaggtggctaggagggctggggaggcccagtggaagagagagagagagagagagagagagagagagagagagatcgagcttgatgtattgctcagtattcacttagaagggtttctttctctttggcctagtttgtgaagggatcttcctttggactttctctaagttgggagaagaacattcttttcaatggagctcatcttctatctctagggtctgttcagcctttcatctatccatccttcctctttattggtagaagaaacagtggagagtagccacttctggttctagcacttctcttttgttaagatagggtttggatttagtatgaagctttggctaaaacccttgggtttgccttagaacactgacactaagaacctggaatgacatggggaggacaaagagagctcaagaggaatgctttgtgagaagtggattctctccgtgtccctgccccccacccaaacttgaactatacctnntncatnangnantancnnnaaat

SEQ ID NO: 254239 - DNA, 3051 bp, Homo sapiens
  misc_feature (668)..(668): n is a, c, g, or t
  misc_feature (680)..(680): n is a, c, g, or t
  misc_feature (683)..(683): n is a, c, g, or t
  misc_feature (2064)..(2064): n is a, c, g, or t
  misc_feature (2773)..(2773): n is a, c, g, or t
  misc_feature (2784)..(2784): n is a, c, g, or t
gcagcttcagcgaagccggagatgggcagagagcgcgcgcggcgcagcagctccagattcactgctctcccctgcagctccccgcgcccccgccgctgtcgctgcctcggtgtcccccagccccagtcgcgctcttaggacagcgccgccaccgccgcctggccctgcctgcctcctgcgccgcgcagccctcgcgagcgccccggatggcgctttacccctaggaccgatttagaatgtaataactcaaggatttgataatacagtgaagtagtataacaactgtctacgtgcttcccatgatatgttctctatattgaaaaattatgacatcaacatccaaaggaattcttcgcccatttttaattgtctgcattatcctgggctgtttcatggcatgtcttctcatttacatcaaacctaccaacagctggatcttcagtccaatggaatcagccagctctgtgctgaaaatgaaaaacttcttttccaccaaaactgattattttaatgaaactactattctggtgtgggtgtggccatttgggcagacctttgaccttacatcctgccaagcaatgttcaacatccaaggatgccatctcacaacggaccgttcactgtacaacaaatcccatgcagttctgatccatcaccgagacatcagntgggatctgacnaanttacctcagcaagctaggccacccttccagaaatggatttggatgaatttggaatcaccaactcacactccccaaaagagtggcattgagcacttgtttaacctgactctgacttaccgccgtgattcagatatccaagtgccttatggcttcttgacggtaagcacaaatcccttcgtgtttgaagtgccaagcaaagagaaattggtgtgctgggttgtgagtaactggaaccctgagcatgccagagtcaagtattacaatgagctaagcaaaagcattgaaatccatacctacgggcaagcatttggagaatatgtcaatgataaaaatttgattcctaccatatctgcttgtaaattttatctttcctttgaaaattcaatccacaaggattacatcacggaaaagctatacaatgcttttctggctggctctgtacctgttgttctgggaccatctagggaaaactatgagaattatattccagcagattcattcattcatgtggaagattataactctcccagtgagctagcaaagtatctgaaggaagtcgacaaaaacaataagttataccttagttactttaactggaggaaggatttcactgtaaatcttccacgattttgggaatcacatgcatgtttggcttgcgatcatgtgaaaaggcatcaagaatataagtctgttggtaatttagagaaatggttttggaattaaaatttttcatcacttgcacacttgataaatattttgatgagatatcatccaagtattgaggataagaagagatgcaacatactacttttgtgtcacaatttatttttatcaccctctctagggtaacgtgtatattttggtggagatttttaaaagctcagcatgagcaatcattccattcggttttaaattatcctgtatatacctaattatgtgcactggagagtaatttattcttcattatcatttgtaaacattgctttttcacatttttgtagttgtccataatgtaagcttgtggtttgattattgtttccacactgatcagctgtttaatctatttgggaaatgaagatgcacatcttaaagtatgaaaaattttcactaagtattacaatgtctagttccaactttgcatactataacagaggaagaacatgttgcgattgaattctaacctctttgactcctaagatgaatgaagtgtataactgtctctatttgatctattttttttacctgtttatcacatttgtgaaggtgaaattattcatggagtgaataagaaagatatgaagcagaactgttctattcaggaagctattagacttctcatttattttcattaagctgatttgcagctacttattctcatggncttaaattaaattattcaagtatttttaaatatccaatttgttgtgattttcagcacctgggaagtaatcccaataatactttagaaaatctaagacagttctttctgctactgatgacactcattgtcataataaaacaaataatttcctcaaataacaaagaaaaatgatacctataaatatatttataaatggtgtcatttatgaacaatgtttaattatgtatcaatttaagatttttttctgaagccctaatatttaaaatggccttattttaccatatggatataagatttggctcataatgatgagccctatcatttgatttgagttctatcatttaagagagcctaaataaaattatcatcaaggtattaaatataagacgttaaatataataaagtggggatatatagaaaacacacagtgttagcacagagtaagatctcaatgcacatttgttggatgaataaataaatgcaattgaattcccagaaaaatgattgtttcaaggaagtgacagttctactttagaagtactaattggagatgacttttatatcccattttggtaattattcatacatagcacatatgaccatgatgttcagggctttatagaaccaaataaacctaccattacatgaaaattttgaagagtatattcctgaacttgcagctgcctatagcattctcctccataaggcnagaggagagcnggatataagcagagatcgtaggtgaaaaaagatgggccattaaggattcttcaaggaaaacattcctcaaaatgatctttagtgcctttattcctttcaggccaataatccacccaaaaattagaatgttctgagacatccatttgggtctatttgtgacttattcgtattacaaattgacatcagcaaaattcaaaaagaattcagtaaaaagggcatagatccagctatccagactatcttgtgagagaataagctcaccccagc

SEQ ID NO: 254240 - DNA, 1162 bp, Homo sapiens
  misc_feature (740)..(740): n is a, c, g, or t
  misc_feature (1069)..(1069): n is a, c, g, or t
gcagcttcagcgaagccggagatgggcagagagcgcgcgcggcgcagcagctccagattcactgctctcccctgcagctccccgcgcccccgccgctgtcgctgcctcggtgtcccccagccccagtcgcgctcttaggacagcgccgccaccgccgcctggccctgcctgcctcctgcgccgcgcagccctcgcgagcgccccggatggcgctttacccctaggaccgcacatcaagatgcaaatttggatgagaggaaaactacacttctaaggctcccctgacatagtttctttggagtgcaattcagcctctctttattgagggcctatggggcaagaactgaagtgatgatggcaggcacaagaaaccttaagtttctttcactggagagctcttcagttcatccatgaagctgagtcccagattaaaaaccattgctgtggtttgtctgtattttggtgtatcaaagcagacaaaagaaaaggaaagcacctccaatccatcctaataatcatcccaccttcctttctgctttcatatgacatttatttaaaccaagctatagctgtgcttctcaaaccttacagtccatgtgaatcacctgaagatattattaaaatgcagattcttattcaatagatctgggttgggatgggagatttctaacaaactcttaagtaaactcctactctggaaaccacactttgacaagcaagggtctgtaaaactagaaagntagaggccttttagttcatggctcttaaccaagagcctgcgaatctctgggacatttatccacaggttttaggattctatgagtcccaagaaataaatgcaaaattttatatgtatgtgggtatgggcatttttttattttctggagagttaacagttattagcctttgtaagaggcttatgaagacctaattaaaataagtgggtagtgattgaatcagtcccatttttagatgagtaaactaaggtctaaggaagctaaattatctgcgaggttcacagagtttgttacaaacctaggaattgcatccaggtttctggtgcctaatncaggggctttgattgtactagactgtctttcaaactttgatttgagagaaataagtgtaataattcagtaaataaatttaataatgaaagaac

SEQ ID NO: 254241 - DNA, 2711 bp, Homo sapiens
  misc_feature (668)..(668): n is a, c, g, or t
  misc_feature (680)..(680): n is a, c, g, or t
  misc_feature (683)..(683): n is a, c, g, or t
  misc_feature (2064)..(2064): n is a, c, g, or t
gcagcttcagcgaagccggagatgggcagagagcgcgcgcggcgcagcagctccagattcactgctctcccctgcagctccccgcgcccccgccgctgtcgctgcctcggtgtcccccagccccagtcgcgctcttaggacagcgccgccaccgccgcctggccctgcctgcctcctgcgccgcgcagccctcgcgagcgccccggatggcgctttacccctaggaccgatttagaatgtaataactcaaggatttgataatacagtgaagtagtataacaactgtctacgtgcttcccatgatatgttctctatattgaaaaattatgacatcaacatccaaaggaattcttcgcccatttttaattgtctgcattatcctgggctgtttcatggcatgtcttctcatttacatcaaacctaccaacagctggatcttcagtccaatggaatcagccagctctgtgctgaaaatgaaaaacttcttttccaccaaaactgattattttaatgaaactactattctggtgtgggtgtggccatttgggcagacctttgaccttacatcctgccaagcaatgttcaacatccaaggatgccatctcacaacggaccgttcactgtacaacaaatcccatgcagttctgatccatcaccgagacatcagntgggatctgacnaanttacctcagcaagctaggccacccttccagaaatggatttggatgaatttggaatcaccaactcacactccccaaaagagtggcattgagcacttgtttaacctgactctgacttaccgccgtgattcagatatccaagtgccttatggcttcttgacggtaagcacaaatcccttcgtgtttgaagtgccaagcaaagagaaattggtgtgctgggttgtgagtaactggaaccctgagcatgccagagtcaagtattacaatgagctaagcaaaagcattgaaatccatacctacgggcaagcatttggagaatatgtcaatgataaaaatttgattcctaccatatctgcttgtaaattttatctttcctttgaaaattcaatccacaaggattacatcacggaaaagctatacaatgcttttctggctggctctgtacctgttgttctgggaccatctagggaaaactatgagaattatattccagcagattcattcattcatgtggaagattataactctcccagtgagctagcaaagtatctgaaggaagtcgacaaaaacaataagttataccttagttactttaactggaggaaggatttcactgtaaatcttccacgattttgggaatcacatgcatgtttggcttgcgatcatgtgaaaaggcatcaagaatataagtctgttggtaatttagagaaatggttttggaattaaaatttttcatcacttgcacacttgataaatattttgatgagatatcatccaagtattgaggataagaagagatgcaacatactacttttgtgtcacaatttatttttatcaccctctctagggtaacgtgtatattttggtggagatttttaaaagctcagcatgagcaatcattccattcggttttaaattatcctgtatatacctaattatgtgcactggagagtaatttattcttcattatcatttgtaaacattgctttttcacatttttgtagttgtccataatgtaagcttgtggtttgattattgtttccacactgatcagctgtttaatctatttgggaaatgaagatgcacatcttaaagtatgaaaaattttcactaagtattacaatgtctagttccaactttgcatactataacagaggaagaacatgttgcgattgaattctaacctctttgactcctaagatgaatgaagtgtataactgtctctatttgatctattttttttacctgtttatcacatttgtgaaggtgaaattattcatggagtgaataagaaagatatgaagcagaactgttctattcaggaagctattagacttctcatttattttcattaagctgatttgcagctacttattctcatggncttaaattaaattattcaagtatttttaaatatccaatttgttgtgattttcagcacctgggaagtaatcccaataatactttagaaaatctaagacagttctttctgctactgatgacactcattgtcataataaaacaaataatttcctcaaataacaaagaaaaatgatacctataaatatatttataaatggtgtcatttatgaacaatgtttaattatgtatcaatttaagatttttttctgaagccctaatatttaaaatggccttattttaccatatggatataagatttggctcataatgatgagccctatcatttgatttgagttctatcatttaagagagcctaaataaaattatcatcaaggtattaaatataagacgttaaatataataaagtggggatatatagaaaacacacagtgttagcacagagtaagatctcaatgcacatttgttggatgaataaataaatgcaattgaattcccagaaaaatgattgtttcaaggaagtgacagttctactttagaagtactaattggagatgacttttatatcccattttggtaattattcatacatagcacatatgaccatgatgttcagggctttatagaaccaaataaacctaccattacatg

SEQ ID NO: 254242 - DNA, 2995 bp, Homo sapiens
  misc_feature (668)..(668): n is a, c, g, or t
  misc_feature (680)..(680): n is a, c, g, or t
  misc_feature (683)..(683): n is a, c, g, or t
  misc_feature (2008)..(2008): n is a, c, g, or t
  misc_feature (2717)..(2717): n is a, c, g, or t
  misc_feature (2728)..(2728): n is a, c, g, or t
gcagcttcagcgaagccggagatgggcagagagcgcgcgcggcgcagcagctccagattcactgctctcccctgcagctccccgcgcccccgccgctgtcgctgcctcggtgtcccccagccccagtcgcgctcttaggacagcgccgccaccgccgcctggccctgcctgcctcctgcgccgcgcagccctcgcgagcgccccggatggcgctttacccctaggaccgatttagaatgtaataactcaaggatttgataatacagtgaagtagtataacaactgtctacgtgcttcccatgatatgttctctatattgaaaaattatgacatcaacatccaaaggaattcttcgcccatttttaattgtctgcattatcctgggctgtttcatggcatgtcttctcatttacatcaaacctaccaacagctggatcttcagtccaatggaatcagccagctctgtgctgaaaatgaaaaacttcttttccaccaaaactgattattttaatgaaactactattctggtgtgggtgtggccatttgggcagacctttgaccttacatcctgccaagcaatgttcaacatccaaggatgccatctcacaacggaccgttcactgtacaacaaatcccatgcagttctgatccatcaccgagacatcagntgggatctgacnaanttacctcagcaagctaggccacccttccagaaatggatttggatgaatttggaatcaccaactcacactccccaaaagagtggcattgagcacttgtttaacctgactctgacttaccgccgtgattcagatatccaagtgccttatggcttcttgacggtaagcacaaatcccttcgtgtttgaagtgccaagcaaagagaaattggtgtgctgggttgtgagtaactggaaccctgagcatgccagagtcaagtattacaatgagctaagcaaaagcattgaaatccatacctacgggcaagcatttggagaatatgtcaatgataaaaatttgattcctaccatatctgcttgtaaattttatctttcctttgaaaattcaatccacaaggattacatcacggaaaagctatacaatgcttttctggctggctctgtacctgttgttctgggaccatctagggaaaactatgagaattatattccagcagattcattcattcatgtggaagattataactctcccagtgagctagcaaagtatctgaaggaagtcgacaaaaacaataagttataccttagttactttaactggaggaaggatttcactgtaaatcttccacgattttgggaatcacatgcatgtttggcttgcgatcatgtgaaaaggcatcaagaatataagtctgttggtaatttagagaaatggttttggaattaaaatttttcatcacttgcacacttgataaatattttgatgagatatcatccaagtattgaggataagaagagatgcaacatactacttttgtgtcacaatttatttttatcaccctctctagggtaacgtgtatattttggtggagatttttaaaagctcagcatgagcaatcattccattcgcattatcatttgtaaacattgctttttcacatttttgtagttgtccataatgtaagcttgtggtttgattattgtttccacactgatcagctgtttaatctatttgggaaatgaagatgcacatcttaaagtatgaaaaattttcactaagtattacaatgtctagttccaactttgcatactataacagaggaagaacatgttgcgattgaattctaacctctttgactcctaagatgaatgaagtgtataactgtctctatttgatctattttttttacctgtttatcacatttgtgaaggtgaaattattcatggagtgaataagaaagatatgaagcagaactgttctattcaggaagctattagacttctcatttattttcattaagctgatttgcagctacttattctcatggncttaaattaaattattcaagtatttttaaatatccaatttgttgtgattttcagcacctgggaagtaatcccaataatactttagaaaatctaagacagttctttctgctactgatgacactcattgtcataataaaacaaataatttcctcaaataacaaagaaaaatgatacctataaatatatttataaatggtgtcatttatgaacaatgtttaattatgtatcaatttaagatttttttctgaagccctaatatttaaaatggccttattttaccatatggatataagatttggctcataatgatgagccctatcatttgatttgagttctatcatttaagagagcctaaataaaattatcatcaaggtattaaatataagacgttaaatataataaagtggggatatatagaaaacacacagtgttagcacagagtaagatctcaatgcacatttgttggatgaataaataaatgcaattgaattcccagaaaaatgattgtttcaaggaagtgacagttctactttagaagtactaattggagatgacttttatatcccattttggtaattattcatacatagcacatatgaccatgatgttcagggctttatagaaccaaataaacctaccattacatgaaaattttgaagagtatattcctgaacttgcagctgcctatagcattctcctccataaggcnagaggagagcnggatataagcagagatcgtaggtgaaaaaagatgggccattaaggattcttcaaggaaaacattcctcaaaatgatctttagtgcctttattcctttcaggccaataatccacccaaaaattagaatgttctgagacatccatttgggtctatttgtgacttattcgtattacaaattgacatcagcaaaattcaaaaagaattcagtaaaaagggcatagatccagctatccagactatcttgtgagagaataagctcaccccagc

SEQ ID NO: 254243 - DNA, 433 bp, Homo sapiens
cagaagtgaaggttgttccctctgttttaattcactggggtattacatatattaaaaaatcatagaatattagaccttcatatgaactacaagatacaagtccagttccctctatttacagaaaaatctgtaacttgcctaagatcacaaaacagattagagaagaaagagggccaagaagccaggattcagctctactgttgttttgtctctctacattgcatgctgcttgtccaaaacaagcaccccaggatttatgagaatcacccttgtgtatactttggagtactattcaagttttccattctttttggatatttgtttttaagcagagtttgcaaatactactagtataaatataggtatgcttcactttatgtaatttattttcctaatgacaggatctaaatcttttcctcaaataattatcatc

SEQ ID NO: 254244 - DNA, 429 bp, Homo sapiens
actcttgatgcttgctgtctacttaccttgggcaaactgcttcatctgtataagcctcctctgtgtcctcatctgcaaaatgggtttgagagttccaacctccccaagttgctgtgatgaccgatagacataatgcatgttaaggatcatacatagagcatagcatgatgtggtgaatagtcaccaaattgtacttacttgtttttaaataaggaaactcacattcatatggtttaaaaaaaagatcaagagttcagtgatagggccacgatgagtggattataaaaatgggctttcataccccagtagatttgaatcttgccagactgttctaccaacctaacttaaacacatacacacacacacacacacccctacatcaaggaggaaaggaggcattttcaaatccacgactctccccacttgcca

SEQ ID NO: 254245 - DNA, 370 bp, Homo sapiens
gccaagaaagtgttttctaatgctaactctggagatttgctcaaatcaaggtgacttccctatctgtcagaattttaagattcatttaatgactgtgttactttctccagagagggataaggaattgggccatgtggtcatgaagtttgagaagtctcaagatttacaagttggagaccgtggagagctgatgatgtgttgcggcatgagtccgaaggaccgagcattaggagagccgatggtctaatttccagtttgagtccaagtctaaaggcaggaaaagaccaacgtcccaatgaccatcaggcagagccagtgaattctctcttaccctgtcttttgttctagtcaggccttcaatggcttggat

SEQ ID NO: 254246 - DNA, 261 bp, Homo sapiens
aggttgcagggcctggttctctgcgtcttcctcagttctctgcctcatctgacccactgaatagctctcatgtttacatagtgtactatgtgccatttcattcctaacttctcccctctcgaatcagtgataatccattgtttttatcatcactatatctatgggttttgttgacgagacctgattaaccctaaaaagtcattacactgcacaagtaaagcagtgttggggtggactgttatctagatgtgtattttcctt

SEQ ID NO: 254247 - DNA, 10141 bp, Homo sapiens
  misc_feature (2130)..(2130): n is a, c, g, or t
  misc_feature (3450)..(3450): n is a, c, g, or t
  misc_feature (4715)..(4715): n is a, c, g, or t
  misc_feature (10133)..(10133): n is a, c, g, or t
aggaagaagctggagacttggtccagccgggcatcagctttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagcngcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaantaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcaccttgatttgcactttacaatgtccccagcccctctgcagcccgtggctggcagggcgttcgatgtgcggttggcccccagcgcgccctccagagntgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaaatcctggaatatcttctataatgaatcctaattccccccagagtgttcaaggcattttttttaactaatgaatacctaaatcttgagtagtgtacggtaatgacgcttcttccctatatccactcttattatgttaaaacaaatgtatttgcgagtattggcattttaggactttaaaaatgctgtatgatttccaggtgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccaatacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctcccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtcctggctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacattttcaccattacttaagctcaatcgcctcttagatgaaatgaggagataaactaaacattaaaatgatgaaggaaaaaaaattatttggaagcagaaaaccacatgggtggggaaacatcaggaacgaaatcagacacactgactcaaaccacgcaagggtttgagaagcccacccctctaattccaggtgtttgtaatttctgcacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttnaaaaaaaa

SEQ ID NO: 254248 - DNA, 10126 bp, Homo sapiens
  misc_feature (2115)..(2115): n is a, c, g, or t
  misc_feature (3435)..(3435): n is a, c, g, or t
  misc_feature (4700)..(4700): n is a, c, g, or t
  misc_feature (10118)..(10118): n is a, c, g, or t
ttcagcggcctgaattctagaactttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagcngcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaantaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcaccttgatttgcactttacaatgtccccagcccctctgcagcccgtggctggcagggcgttcgatgtgcggttggcccccagcgcgccctccagagntgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaaatcctggaatatcttctataatgaatcctaattccccccagagtgttcaaggcattttttttaactaatgaatacctaaatcttgagtagtgtacggtaatgacgcttcttccctatatccactcttattatgttaaaacaaatgtatttgcgagtattggcattttaggactttaaaaatgctgtatgatttccaggtgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccaatacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctcccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtcctggctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacattttcaccattacttaagctcaatcgcctcttagatgaaatgaggagataaactaaacattaaaatgatgaaggaaaaaaaattatttggaagcagaaaaccacatgggtggggaaacatcaggaacgaaatcagacacactgactcaaaccacgcaagggtttgagaagcccacccctctaattccaggtgtttgtaatttctgcacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttnaaaaaaaa

SEQ ID NO: 254249 - DNA, 10084 bp, Homo sapiens
  misc_feature (2073)..(2073): n is a, c, g, or t
  misc_feature (3393)..(3393): n is a, c, g, or t
  misc_feature (4658)..(4658): n is a, c, g, or t
  misc_feature (10076)..(10076): n is a, c, g, or t
ttcagcggcctgaattctagaactttccggggccggcagaggaggatctagacccgcagtactcatggtcgcccacgcagcacttcaatgaggagcgctactcgcccgcgcccaggagcatgaagggcctttccggaagtcggacccagccgccgctgtgttccgggcacacgtgtggtctggcgcccccggaggactgcgagcacctgcaccacgggcccgacgcgcggccgccctacctgctgagccccgccgacagctgccccggggggcgccaccgctgctcgccgcgcagctcggtgcactcggagtgcgtgatgatgccggtggtgctgggcgaccacgtgtccagcagcaccttcccgcggatgcactacagctcgcactacgacacgcgcgacgactgcgctgtggcccacgcgggcgccaagatcaaccgcatcccggccaacctgctggaccagttcgagaagcagctgccgctgcaccgggacggcttccacacgctgcagtaccagaggacgtccgcggccgccgagcagcgcagcgagagccccgggcggatccgccacctggtacactccgtgcagaagctcttcaccaagtcgcactcgctggagggctcctccaaaagcaacgccaacggcaccaaggcggacggccgggcggacgaccaccaccacgcccaccacgccaagcacagcaagaggagcaagagcaaggagcgcaagccggagggcaagccccggcccggcatgagcagctggtggagctcggacgacaacctggacagcgacagcacctatcggacgcccagcgtgctcaaccggcaccacctgggccccgtggcccactgctaccccgacgcgctgcagagccccttcggggacctgtccctcaagacctccaagagcaacaacgacgtcaagtgctcggcctgtgaggggttggcgctgacgcccgacgccaagtacctgaagcgcagctcctggtctacgctgacggtcagccaggccaaggaggcctaccgcaagagctcgctgaacctggacaagccgctgctgcaccaggacgccaagcccgccctgaggccgtgccactacctccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtgcggaccagcgacaaggccatcctggtgtccaaggcggaggagctcctcaagagccgctgctcctccatcgggattcaggtggaaacggccacagattctgacacggagagcngcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaantaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcaccttgatttgcactttacaatgtccccagcccctctgcagcccgtggctggcagggcgttcgatgtgcggttggcccccagcgcgccctccagagntgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaaatcctggaatatcttctataatgaatcctaattccccccagagtgttcaaggcattttttttaactaatgaatacctaaatcttgagtagtgtacggtaatgacgcttcttccctatatccactcttattatgttaaaacaaatgtatttgcgagtattggcattttaggactttaaaaatgctgtatgatttccaggtgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccaatacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctcccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtcctggctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacattttcaccattacttaagctcaatcgcctcttagatgaaatgaggagataaactaaacattaaaatgatgaaggaaaaaaaattatttggaagcagaaaaccacatgggtggggaaacatcaggaacgaaatcagacacactgactcaaaccacgcaagggtttgagaagcccacccctctaattccaggtgtttgtaatttctgcacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttnaaaaaaaa

SEQ ID NO: 254250 - DNA, 9476 bp, Homo sapiens
  misc_feature (1465)..(1465): n is a, c, g, or t
  misc_feature (2785)..(2785): n is a, c, g, or t
  misc_feature (4050)..(4050): n is a, c, g, or t
  misc_feature (9468)..(9468): n is a, c, g, or t
tagatttaaaaccgtcctcttttatttgcttgcaattaagatataagtatacaataagataggcattttctcccttgttttctttttttttttccttttcttctctgttcagtttctcaactttcaatttcctcttataccagagggaaataaaactaaattttagccagtgctttgtcccagctgctgagattgcaagtgtcccttcttctcttacttttctcacatgttctcactttatccatagtgtttacctatcacttataatgaagaaaaaccaacatttttatattcatttccttttagggtatgcatttttatacatctgactttaactgataaatgactgtaaagaggtgtatctttatggaattgtagaggatttgtttccaaaaaggagctgatgctgccgttctcagtgacaaagttgatgcgtgtttcatgtctgtctgctcccaggtacctcaggatgagtggggagggtaccccaccggtggcaaagatgaggagattccctgcaggagaatgagaagtgggagttacattaaagccatgggggacgaggagagcggagagtcagactccagccccaagacatcaccaaagtcggcaatcctaccagagccgctgctgaagtccatcggacagagaccgcttggagagcaccagacccagacctacctgcaagctgcaagcgatgtgcctgtgggacacagcctggaccccgctgcgaactacaactccccgaaattccgctcccggaaccagagctacatgagggccgtcagcaccctgagccaggccagctgcgtgagccaggtgagcgaggcggagatcaatgggcaattcgagtccgtgtgcgagtccgtcttcagtgaagttgaatctcaggccatggatgccctcgacctcccgggatgtttccgaacaaggagtcacagctaccttcgagccattcaagccggctactcccaagatgacgaatgtattcccatgatgacaccctctgacatcacctccaccatcaggtcaacagcagctgtctcatatacaaattacaagaaaacgcccccaccggtgccccctcggaccacctccaagcctctgatctcggtgacggcgcagagcagcaccgaatccacccaggacgcctaccaggacagccgcgcacagaggatgtccccgtggccccaggacagccgcggcctctacaactccacggacagcctggacagcaacaaggccatgaacctcgcgctggagacggccgctgcccagcgccacctgccagagagccagagcagctctgtgcggaccagcgacaaggccatcctggtgtccaaggcggaggagctcctcaagagccgctgctcctccatcgggattcaggattctgaattcccagagcatcagccatacccaaggtcagatgtggaaacggccacagattctgacacggagagcngcggtctgcgggaataccactctgtcggggtgcaagtggaagatgagaagcgacacggacgttttaaacgttctaacagcgtcacggccgccgtccaagctgacctggagctggaggggttcccaggccacatcaccacggaggacaaaggccttcagttcggctcatccttccagcggcactccgagcccagcacccccacccagtacagcgcggtgagaactgtacggacccaggggctcttcagctatagagaagactatcggacccaagtggacacctccaccctgccccctccagacccctggctggagcccgccatcgacacggtagagactgggaggatgtctccgtgccgcagggatggctcgtggtttttgaagctgctgcacgcagagacaaagaggatggaaggctggtgcaaagagatggagagagaggcggaggagaacgacctctcggaggaaattctcggtaaaatcaggagtgctgttgggagtgcccagcttctcatgtcccagaaattccagcagttttattggctttgccaacagaatatggaccccagcgccatgccgaggccgacgtcgcaggacctggccggctactgggacatgctgcagctctccattgaggacgtcagcatgaagttcgacgagctgcagcggctgcggctcaacgactggaagatgatggagtccccggaaagaaaggaagaaagaaaggtcccgcctccaataccaaagaagcctcccaaggggaagtttcccatcacaagagaaaaatccctggacctgcccgacagacaacgccaggaagcccggaggcgcctcatggccgccaagcgagcggcgtccttccggcagaattccgcctccgagcgcgcggacagcatcgagatctacatccccgaggcccagacccggctctgagggcggaggccggcgccttcccctcgtcgcttccgctttcccggacgcttgtgcagcgcggcgccgccctggtggtttctgtctcctcctcccgctgaacacgtcctcgctcccgcgctccccgcgccccggacacagcgggacgcggccggcggcctcagagtccacggagctcgcggcgaggacgacttctgcttttgttgttgttgttgttgttcacgggtggcctggctcacacttggctctgagggacaggtgtggcgagacctgatttctcctgcgtgttctcagaggacggcgagaaatgcctctggagctggaacccagcttacattttgttatttctatttttataaattgtgtgataattagaggtaagaataacaantaactataaacgggtgcatcccaccactccctggaggcattagacacccaagtggaaggtgctacaacctgaagcgcaggaaagaaaggcccattcccctcgcacagccgagcttttactccctgagcacgggccgctccgctcccctgctcctgtctgtctcggacagaaaacacgaggctccttgtgtcaagcttcctgtgatggaaagcgacctctccaaccaccacactccccgccgtacagttctccagaatcccaggcgatgacaagtctgaacccacgaaaatacccagcgcagcatctacacattcaaaagataagctgagtgttcccaccaggaagtcacgcgcagagaggagagtcttacggagggctgggagcttaaaaggaaaacaatgtccttacttgtaaacagttattgtattttttatttctttctaacttaaaatacgacacccagtattttctttaagtttcaccatttacgctacatgtgatttttttaatgtatgtatatatatatattctcaaattgctctatcagctgacttttcagggtatccttaaaaaaaaacacacacgaaaaacaaaagtttgcttgtttaaaatgacagttgtgatgtaaaaagtttaagaaatatgaatgtgagtggtaagtatatctcagtttaaatggtaaagaagaaatgtagtttacatttgtatttttccagaattcttttgtcctatgcagtattgctaaagtcgagaatatattccttgcctgtgttagacatgaagggaaaaagaggtcacatattgtgatttccagctgtagcattcaaaaaaaaaattggtgttcatgactctgtggtcggtgccagaggaaaataggaacgactctaattaataggctttctgtgtatataattaaatttagctgctgcaaccattgttctgacacgacttctgtttcacagttcagaccggtcttcaaaggaaaagcctgtccgatttttccatgggttccagtttcagagttctcattattactcaaagtaaaagcggactgcgatttaagatgtttccaccccaatacctggtcttccttcccggcttaaggagtaccatgtacttagccacaggcagaatagctttcgatgaccccatagcactttgtttcttcaccttgatttgcactttacaatgtccccagcccctctgcagcccgtggctggcagggcgttcgatgtgcggttggcccccagcgcgccctccagagntgcggtgtctccctgcctcattccccacatcccactgagcatgggaccattgggagcagagctgatattaaagcatgtttagcttcgaagttttacttttttaaagctgagtagttaagaattccctgtaaaaacaaaaccctgtaaattgagcctcatgtctggtatatattttaccaaacagccttaaaatatatttggaagcaaaaatcagtacgaatgtatctccttgaaaaatgcaaaaaaaaaaaaaatcctggaatatcttctataatgaatcctaattccccccagagtgttcaaggcattttttttaactaatgaatacctaaatcttgagtagtgtacggtaatgacgcttcttccctatatccactcttattatgttaaaacaaatgtatttgcgagtattggcattttaggactttaaaaatgctgtatgatttccaggtgaactctgctgtttagaagtaaccacagaaaagcaaagtcagtgtacactctgagtgaaaggaaatgtaatgtggataaaggcccgccacctcctcacattggtctatctactggcagctgatacgtttaactcatttccttgagcttatacaaaacatagaaaagcaaactgttaaagtagtcaataattatttgtctcagatcccagattctatgatccctgcttaaaagaaaatgttcactgcatgtaggttgatttcttatgttttgtagactcattgttatttttcaatccccaaaagtcttggcctaaaccatccctaggggagcagattaacctaccaatacattgcacagggttggtgactcgacgtggtgaatgtgcacacgccctgcctggtccgccatgttccaaagaagatgatttaatggtagaacggatacctgctgctagacctgatggaatgttacctgtccgtgttacataatcaagtgcaatatactcagttctcatgcaggtgacattctaccatgaaacgcagaagataagccatgtttctgtattgtacatgtaaagaaaaataaaactgtttatgatacttgtgttagtcactcgagctagcttatttcagccacttctagcagatcatgccatggagctcacgacgtgtgaccatttcgtcatatttaaaatataacttcaagaaaagagtaaacatccattggagaacacggctgaaaattattgtgctgttctaggaacatcatcctagagagtgtgatgttcactataaccccatacctacattccctaatgatacagccaatgacaggtgaaacccagacactctccttagagccgacaggttgatcctgctgtgttgaaggctgtggttaataaaacacaagtatgataaacaggacctagcgtttagcccgggaaaggagaatgctgcttgtcacctagagtgctttccttgtgatgcgtctctcgcatcttcacgtgttgttgtgtttgaagtaaaactagttgttatcgatgacaatttttaccatagttttctcagcaaatttatatcaccatcttagaatggtatataaaaaaattgaactgtttatgataccaaaaaaattacagttttgtttaaaaggaaatgttgatgttttcaactccaaatcaattctaaaaacttcaagcacttaatggaaaggtaaatggtcagataaaaatataattacctgtaaggttatctggttttaaaagaaaaaaaaaaagcctacaaactcagtgacctactacgcagagggaatttttccctgctgcttcttatgaaagtggccaggtttattattagaagacacagtggcagagcacacatgtgcacaggttctgattatttctcttggagcatatgtccttgtcttgatttttgccttttcgatgccatattaagcagccaccgtttccacccctttcattagaaggccctgcatccgtaaattcgcgcatctctgtttttgttagatccttgtaagcatcgctacccgagtccaggatggaatttcacaggaaagtgaagggatactgcaggcctgtgtttgcagcgcctgtggtaactgtggaatgagctctgttagggacagttgtctggtttgtgccaaaccttcgaggggcgagtagggagtgggggaggtgggtccaagtctcccctcaggaaggccttttctatcggcagcaattccatcaagccaagcctcctgtggtcctgagcatgaaggggccaggggacctcctgggagatgcagcttttgtttccgctgcgtttcatcagtcagccttgcttggaattctggcaggttccccggggtgtttcagtggacaggaggcccccgtgccgtggctgagtcagcctgggtaccccagtcaccagcagggccacccttgatgacagggccccccacgaacctgggaaaggcagcgggaaatgtgtgagagggtgtgcgctggtacggacataaaagcattgtccaaaacagcgctggttcggggagggcccctggatactgcctttggcccacactgaaaactgaaattgccccacctgtgagcacagaaacacgcttctccaacacgggccgaaataactaaactccacatggttcctgcctgctcatttcccagccctcttcttctcaagcctgaacttcatttttttttttagctgcaaatttaacaggctaatttaaaactgcagttttcagacgacagcccctgggaatgttccagggttctcttgttttgatctgcatgtctgtttacacttctctgtaggcgtgggttgaatacaagtttccaaaactttaaaatagaaaaccacgagcttaagaggtgaaaaagatgacccctttctgattaggatctgtaactctgtgggctgggtcaatgcagtgtgcttcattcagggccatgtggcagccatgacacacaccacataaggtcagctcagagcccatggcttccctgcaggagccccatcttgtcgctattagttgggagttgcaatacattgttggccataaacaaagtgctaaaggaaagggtttgcttctacacattcggctgaatgtcccccagtgcagggtggcagcagaatgttctggaaatgaaggagatattgctaggaatctctaggctgttaggcaacctggcttttattcatcctcagccggcaactcatctcaagtttatgtctcagtttttttcctctagaaaggggattacagttcctgtccctgtcttcctccaggacacactgtgaggattaatgacatattggctctaaagtcctttgagctcctgggaacaggtggtgaaagtgtgcgttactgctaaggattagtcctggctcttctagaatgccgccctcccagctctgcagggcacgctgccagaatccaggctggtcgtaaacatctcagagataatcagggaccaccagaggcagaggccatgagactgtctttggaaaggtttggaaatgcagaaataactacaagggccattctccttagcttctggctttcaactgtttctagatgcttccaagaacaagaacccagcaccaaccagaattaggccacattttcaccattacttaagctcaatcgcctcttagatgaaatgaggagataaactaaacattaaaatgatgaaggaaaaaaaattatttggaagcagaaaaccacatgggtggggaaacatcaggaacgaaatcagacacactgactcaaaccacgcaagggtttgagaagcccacccctctaattccaggtgtttgtaatttctgcacttcgcacttgagagaaggcagaggtggtccgtgggaaagctccgggaaacagccgtctttcatccttgccacattgaaaaatgtccacaattttatgaattgctgtcctaaccctggcgtttttatccagtgttaaaataaattatttcaagtttcaatgtaaacacttaacagatgacttctttgcagaagaaatgttcgttacctactatcaaactactttttaacagattttgtatatacacacacaagttgacagaggtttacctccctactttcttagattttatgtaactcttttcattggtgcttattcagaacctgaaagccttgggcatccaagctttcacctactcaatggaggagaggtgataatgaatgaaaagattgacaccaggtttcttggacaaatttaagttcaaatttatctctttcaagtagaccatggtctccctagagagtgtgttggcttgtgtctgccagtacgacaaaggacgctcccagcttgatcgtggtaccttatggaagccactcacgcattctctgatttacccccaaaacactaccatgccccagccccactcatttaaataatacaatcatatcactttcaaagggctcagcacgaatgttcccctcactccactttttaactcgtttgctgaactcgacaaggcttccccttacgagcagtgagacctaggctactttcgaacgcttccttccgaacggtaagccacttcgctctcgggcaggacaggtcctccctgcagagagagacaactcatcccccgaccttccatactacagaccaaaatacccaggtgtggcctaaggactatattaaatgcctcctatagaaattcaaggaatgttagaaccaggaaactagctgtttaaagttttaaagaagtatataaatatatatataaatataaatatgaaatcatatcgagtgtgaggatgagcagagtgccaaatattcagcatctgtacaaagtcattcactggaattcaactattttatgtcattctctttctcacgcttttatggttcttttgataaattctatttagtagcatgcaggatacctaatctgaatgtgcaatatgctattcatcaccacgacaatttcttacttcctcttaataacttaccagaatgttggtcattcctttaaggcagttaaggattgctttatttgtgttcttttttcccatgactttttttcactctcagctgactgtaagaaactgtgcaccgtttccgccataaccgtcctgtgacgatgcctccatttgacttctgtatcgctgatgttcacctcctgtaaatagtttggcaattaaattttttgagaaaagtaatgtttacttttttattggagtgaattctcgtgttattttaatctcagaaaaattatatagaccaaagagttttatccgaaaaaaaattacactcttcctccattatatatttcattgttgaaatatcctcaatttctctatattttaagaagtaatggacatttattaaggttacagatttaatatgtatgcaaaatggtatagattaaatgagtttttaattaataaatcctacagtatttagttnaaaaaaaa

SEQ ID NO: 254251 - DNA, 404 bp, Homo sapiens
tgggggcacactcttggagactccagttgctcaccagcttggacaaaccactggactcaaatgatcaggtagaaattcatcactggagagaacacagtggaatggcttcagcgaaaactcactctgaaggtcttcagggcaactttaagacttgcccctggccgggcacagtggcttatgcctataatcccagcactttgggaggccgaggcgggtggatcacctgaggtcaggagttcaagaccagcctggccaatatggcgaaaccctgtctctactaaaaatccaaaaaattagccgggcgtggtcgtgggcgcctgtaatcccagcaactcgagaggctgaggcaggagaattgcctgaacccgggaggcagagtttgaagacagccgagattgcaccac

SEQ ID NO: 254252 - DNA, 296 bp, Homo sapiens
agtgttgattctttattttatagatgaacaacaatagcaacaaaacatttgaaagctttcaatttgatgactttctctaaagaaaaaaataaactcaatatacacaaaataaactcaatatacacacttctcatctcttcaaactatacagagtaagaatttcacagatgaatgtttttctctatcaatcattaacatgtttatttcatgctgtaatgtgggacctagctattttttatatttctgataattattaacatttatcatgggaatattcacttaactgcaatgtaaca

SEQ ID NO: 254253 - DNA, 296 bp, Homo sapiens
  misc_feature (59)..(59): n is a, c, g, or t
cctcatcctcagaagaatggaacagtttggggtggagaacgttatcagtaagtttctgngttaaaagatgtggagggaccgcagggaaatcaggtctgagaaaaatgcagtcactgactaggcagataggtttcatattcctgatgaatctacctaggatgaagggcatctgtgggtctgactgggatgaagcagcagcccttctggtattggcagaagactgtgttattagtgatgttgctgtggacacacacgtaccttctatttgctattcctgaactgggaaaagcagcatc

SEQ ID NO: 254254 - DNA, 307 bp, Homo sapiens
attcagcagggccctgggtcatcacatttttcataaacatttggagatctagggccacccctctcaccatgggaaagtctttattttctgtgagtccttgtatgctaagggctcagtcctgtttgtgttatagagctttggggttgaagggtctgcttcccaaatactcatctgccctatgtgtaaagtagatactggttttacttttagcttagaatgagaaacaccagcccctttggaaaacccatcccagcctaaattctaaatatagccaattttgacggagacagacatccagtcatgaacc

SEQ ID NO: 254255 - DNA, 497 bp, Homo sapiens
accagatctcacgtgaactgagtgagaactcacttgtcaccagggggatagtgctaaagcattcatgaggcatccacccccatgatctattcacctcctaccaggccccatgtccaacattgggaaccacatttcaacatgagatttggaggggacagatgtccaaaccatgtaaaaggtggagccctcatgaatggtatttgtgtccttataaaagagacctcagagaactagctcactctttccaccagtgagacagcaataaaaaatcagcagtccgcagccaagaagagagctcttatcagaatttaaccctgctggcatgcttatcttgggcttccagcctccagaattgtgagaaataaatttctgttgtttataagccacacagtcttgggtactttgtgatacagcatgaactgactaagatgcaagtcgagcaggaatttgatgactgagtggattttattttattttttaagaattagaaggagaaa

SEQ ID NO: 254256 - DNA, 404 bp, Homo sapiens
atttcaaagcaaagaatattaccaaggaataaggaggttatttcacaattatacagggatcaattcatcctaagtgtttcttcatacaataatgggagcttgaaaataacgtgaagcgagagttgacagaactgaaaggagaaacagaaaatcctcataatggttggagatttcaataaccttctctccgtattaataaaacaagttggtagaaattcagaaaggataatgaccattagccaacttgtgctaattgatgtttttacaattcttggcacaacagcagagtatacgttctttacaagcacacatggaccacttaccaagatggaccagtatctactttataaatctcaataaacttaaaaggattcaaatcatacaaagtatattttctgaccaga

SEQ ID NO: 254257 - DNA, 629 bp, Homo sapiens
ctgaaagaggaagggatttggtttacggatttgactggatgatgatggagctagctaatattttaaccctgaaagttaagcagagaaatcatagccatggaataacatacatttttctttcattttctgcctcccatttagagcctctttcatagagttattccatttctttttcagaaaagaaactatttatcaggtcctcatggtctggaagaaacctcagatttgctagttttgggcaaaataacttaaaggtatatctttctgtgataatctacatcttttcataattacatccttatccatgccatatgggacacctaaaatttctgaaacagcaacttctccagagaatagcctaaggatttctcataatgaaatgcacgtgttaatagtacatggcttgataaaccctattgtgcaaggtaaacctcatgctctctagtaaggaacatgcccagtgtctataatttaagattcatatgctaggaaccctgccctggtttatgatgactttgaatgacctacctacagacacctgctcatatcagtacaaactgggttagctcactaatgccatatgtgtgtgtatgtgaagcccagattcactgaatttaatgaattaacgc

SEQ ID NO: 254258 - DNA, 552 bp, Homo sapiens
gctaaatccaactcaaggctcacattgagcaattagtttaaactccatctcaatttactaaagatgagtcaaatgtgctctctctcctgcagagttggaaggccaaatcaaggagtgtgtagataaaatgtttaaaccacttaaatgtcctacagatgcaaattgctattgttgtagagcatagctgacatcaatataattctgggatgatatattgtaattatctatgtctgtataataaatgttttgttttggccaaccgacttttgttgctttcttagaacagcgtgactcaagaagaataaaacatttttaacatatactatccaaaaactagtatacatacaaacatgttgttaaacacaatagtaaaagaactatcacagttatttatataattttataaatgttgattctgtgccttttatgtcatattgcatacatcaaccttgaacttcatcccagatggacagaaaaatatcgcttttagtgggtgaaatgatatactgcataattaatcacccaaaacagagtaggtttgatagcaaaagg

SEQ ID NO: 254259 - DNA, 408 bp, Homo sapiens
cagcttggtttttcatttttaaatatgaggggtgggtttattttgcccgaaatgaagaatactggcttatatttgaaatacttgaatcatccaacagccttttattttatgttctccattcatttctagttctgcagaggtagactacagaaggggtggtggattcatttactaattaacctatggcagaagctgaaagctggcagaccgtgggctggatccagcctctaaatgtgtttggcccacacaataccttaaaaatcaggaaattgcaaataaaactctagatttctggcttttcttgaaaaatgagatgctttcagcattgtgcctgcatccctgtgtgacagcagtctggttgtgagcaccaactgtagtgggctctccaattagccacagtccccactg

SEQ ID NO: 254260 - DNA, 680 bp, Homo sapiens
agcttcttaaatataaacttaatttttaatcttagttacaatattttagagtacatttaaaaattgtattgactaggattatctttatttttgcttccattatgctaattgtatttgattaaatttagagagatttaaatattaatgtgtttttttcatattataaatatgaatgtttggcctctatttcaaaatacacatgaataaaacattaggtttcctctgaatggcaatgttaaactgctctaccgaatggaattatgatctgtgaatatagagattatatattgatttaatttatttctggtgaaatcttcatactaacatcaataaatatttcctggcaatattctcatccttggcattttattgttctcagttcaaatcctcaagaagattttaaatgccttgtacctatgtgcactgaggggatagggaagacagtttggagatgtgaagaagttagaaaaatgtaaacaggttagggctggagaaagtggggaagctgcacctttaactgatgtcctcctaagactgtaacaattgctcctttgcagtcactgaaggctacaaggtacaatatgtagtgaggctcagcaatcagtatttagtaaaagaaaacagaaaaagaacaatatccctctttagtaccatcatttgctgagtggctattacacgcc

SEQ ID NO: 254261 - DNA, 7046 bp, Homo sapiens
acagaatctttgaaattgcctggggtctatgaagtcttattttataatgaaactgaagattgcccagggatgatgttatggagatatccagaacctagagtactcacccttgtacgaataactcctgtaccttttaacaccacagaggatccagatattagcacagcagaccttggtgatgtgctacaggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactctcaagtgcaacaacgaatgattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaagttatgtcagttctgcatttcctccatggtacagcaaggtatacaaattattcagattgaagacaagactacaataatcaataatacaccatatcaaatattttataaaccacagctatctgtctgcaatccccattctggaaaggagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccagggctatagtgctgacatatcaagaacacctcggagtgacttatttaaccctctcagaagaccctagtcctcgagtaattatccacaatagatgtccagtaaaaatgcttataaaggaaaacattaaagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggttgtgttcctgactggctttggctatgtgtatgtggatgttgtacatcagtgtggcacagtcttcatcactgtggccccagaaggaaaagcaggacctattttaaccaataccaacagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtattttacatggagctggactttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatt

SEQ ID NO: 254262 - DNA, 6864 bp, Homo sapiens
acagaatctttgaaattgcctggggtctatgaagtcttattttataatgaaactgaagattgcccagggatgatgttatggagatatccagaacctagagtactcacccttgtacgaataactcctgtaccttttaacaccacagaggatccagatattagcacagcagaccttggtgatgtgctacaggttccttgtagcttggaatactgggatgaactccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactctcaagtgcaacaacgaatgattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaagttatgtcagttctgcatttcctccatggtacagcaaggtatacaaattattcagattgaagacaagactacaataatcaataatacaccatatcaaatattttataaaccacagctatctgtctgcaatccccattctggaaaggagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccagggctatagtgctgacatatcaagaacacctcggagtgacttatttaaccctctcagaagaccctagtcctcgagtaattatccacaatagatgtccagtaaaaatgcttataaaggaaaacattaaagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggttgtgttcctgactggctttggctatgtgtatgtggatgttgtacatcagtgtggcacagtcttcatcactgtggccccagaaggaaaagcaggacctattttaaccaataccaacagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtattttacatggagctggactttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatt

SEQ ID NO: 254263 - DNA, 262 bp, Homo sapiens
aaagtttgtgaactgcagttgccggatatcaatctcgtgaatgaccagaagaaattagtatcttcagatctttggagaattgtcttgaacagcagtcaaaatggagctgatgaccaaaggtaattcattgaaagatgatatggtagcattacactgggaaacaatgataagtcatcttttcctatctagtgacccctcacttaactgtatctcagctgtctagcagctgcatctctctgaacaacagatgagaaccacaaag

SEQ ID NO: 254264 - DNA, 175 bp, Homo sapiens
catccatgccattgcatgcgtcagtgcttccttcctttgtattgctgagtaatattccaatgtgtagcccaacaacattgtatccgttcatcagctgctgaacatggggattgtttgcattttggattattatgaacaatgattctgtgggcatttatgtgtgcatttttgtcaa

SEQ ID NO: 254265 - DNA, 511 bp, Homo sapiens
aaagagactaaaatatgcatttgtgcttttaactctgaaaacctgaatacctattcaactgttgattctgagtatttacagaactttatttcttctttggacatgctttcgcagtttttacctaatgtatacacatttttgccttgttcttaataattaaatatctgagaaaaagatattcaaaaagtggttttttgtgcgtactcatgataaacagtaacataaaaagttacagaggtcgggcccagtggctcacgcctgtaatcccagcactttgggaggccaaggtgggtggatcacttgaagtcaggagttttagaccagcctggccaacatggtgaaactccatctctacttaaaaaataaataaataaataaacaggcatagtggctcacgtctgtaatcccagctactggggaggctgaggtgggaaaatcacttgagcccaggaggcggaagctgcactgagccaagatcacgccattgccctccagcctgggtgacaaagcg

SEQ ID NO: 254266 - DNA, 182 bp, Homo sapiens
ttagatcaccatattcatttttaggacatggaattatttccgattttttttttcaaacgcagaaattgttttcatagaaaaaatagatcctacttgtttcttatagtattgtgatattgcaaataaaactgaggagatttagatatttctgatgaatttttgaggcattcatctgatagtac

SEQ ID NO: 254267 - DNA, 270 bp, Homo sapiens
aaccatttttcctatgtgactgtgcagtgggataaaagctctcatactgctggtagaagtgtaagttgattaaactggaaaaaatagtttgacaacttatatagaaatttaagattttttttttttttgagatggagtctcgctctgtcgcccaggctggagtgcatgaaatattttgcagacattgaaaataatgtcatctttcctttaatacagaatcaaggaaaaatgttttatgtaaatcttttattttattatactttaagtttt

SEQ ID NO: 254268 - DNA, 284 bp, Homo sapiens
tgctgacctcatttcaaggtgtaatattttaaatttatgccgaagtttaataatatattgtttaggcttaagtttggctgaaaatatcagactactctaaataacagtgctttaaacaagatccaattttgtctctcattagaaagtttaagcacgcaccctaaagctattatgatctttcaagatcaggaagctttttattctactttgagtggccttcattgccaggctttcctcatggttcatgatggtggcttcagcagttaatcaagtctgcatttcag

SEQ ID NO: 254269 - DNA, 380 bp, Homo sapiens
gtgtcagcaactgaagtctatacaggaaaaggcagagctgattcacagggagaaactaagtcctgatgacatcacctgacccctgaatccagctctggctagctgtgcctggacttcgaagttagatgaggaaactgaagcacagagttaacttatccagttacactgtaaacgacagaggcaggattcaaatccaggcagcccgacaactcctacttttaccacgacactgattctgagcccacaagcaactaaggttctaatgctattccaacagagtaaaaactcaaagtccagcactcccaaaagcaccaaatgtgacagtgaaatatcaccttttaattctgaaacagggttaacatagttctgcattataaaaa

SEQ ID NO: 254270 - DNA, 582 bp, Homo sapiens
cttcacccaaaggcaatgctcttggctatgaccacctcatgttttcaaggtggcttgagatgagttatctttcacttttgagtccatgagcactcaggaatccttgttgtgttaaagaggaaacagtagattgtttctgctcatactgctctttctgtttttttttttggggggggggtaggtttttttaagcctgacacccttattatctcccgactgtgactttcacagagaatgcagattccctgggactcacctgaccaggattctatcttagagaggttctcttgagactccttctcttggaaaaaaaggtagatttgaggacagcatgtctttaattctataaaatccttatgaatctctagcactacttttatccttcagtctccagatatttattcatgtttaaattgtgtttgtgggtatatgcatgtcaatggcctgatatttttgcactgagtcctgccaaaagctatttcttacctctgattttaaagagggccttctcacccatctccctcagcttttgcatctcatctaaattgcacgccacagcaaagcactatttcaccttcgtgt

SEQ ID NO: 254271 - DNA, 438 bp, Homo sapiens
gctgggcaatcatatttctagcaaaactcttgactttcttcctgttctcaacctctgccattaaaataaggaaatagtgctatcaaagtaaaagagaagcatctgttggaggggttcaagggggttgagtctttaggcatcaaagctaggagttggctgggcgtggttgttcatgcctgtaatcccagcactttggaaggccaagtcaggcagatcacctgaggtcaggagttcaagaccagcctggccaaaatggtgaaaccctgtctctactaaaaatacaaaaattagtcaggcatggtggtacatgcctgtagtcccagctactcggtacactgaggcaggagaatcacttgaacctgggaagtggagttgcagtgagccaagattgtgccactgcactccagcctgggctactgagtgagactccatctcaaa

SEQ ID NO: 254272 - DNA, 399 bp, Homo sapiens
gggtccttctgagggagccagacctctggcccagaaagccagacattgtgtggaaggagcgttcctggcccagggtcttcctgtgtatccttgccccatcgatcaagtgctgtgggagctgttttaaggtgaaaacctagatgcacagcacttccttgtcctcatgaaaggagcagaggtcttcacaggcctctgggctgccccgagaacctctctattccaggcccctctgcagacccctccagacgccagaactccaggcagtggcctgagctgtcactccttgctctgagacccctacctctgccatgagacctcttcatattcccccagatgccccgatccctctggattccccacctcccctggaacctcccagaacatgaaatgtttctcaaa

SEQ ID NO: 254273 - DNA, 460 bp, Homo sapiens
ggagttcgagaccagcctggccaatatggtgaaaccctgtctctactaaaaatacaaaaattagccaggcgtggtggcgcatgcctgtagtcccagctactcgggaggctgaggcaggagaatcacgtgaacccaggaggtggaggttgcagtgagccgagatcacacctctgcactccagcctgggtgacagagcgagactctgtctcaaaaccaccaccaccaccaccaccaccaccaacagcaacaacaaaggtaatagagatgtttgtttattaagctatacttttaaatgtttcctaattattatagaacacagagacacaaaacttctgtgattgaaacagaaccagaggcaggatcagaagctctgtctatatcccatcaccctatcttacccccatacgacccatcagcctcatataaccaaaccctattactcctaatatgaccaaacccc

SEQ ID NO: 254274 - DNA, 497 bp, Homo sapiens
gcagatgtgcccagccctgctatatagtctctagtgggcaatgggcccaggagcactgcatacctttgtcctgataacaggacccttcgaatctgtccacctccctattcagcacttctgtggccactagtgcttggctgctttcccttacctgcccatgggtgcatgtgagcaaatgaggcttccatccacccaggtggtccactcaagtattttgcttttaccactcttgttctttgtcctccgaggcttgctgggctacagaaaccagcctatggctctgctctgggatgcactaaatgatctgggtttctctcatcctgctcttcagtgtccagcaggagacagtcagggtgctgagcactctcagagactctctgtctgatgtctctctacgtcaccaaaactatccttttattatatgatcatacactctatgttgttctcagtggcttcatctatagcctttaattgtaaagtcaagttttttagaatac

SEQ ID NO: 254275 - DNA, 442 bp, Homo sapiens
gcccccaccccacccccaggtccccacctttacttgacttttcttcttttgacaatctggtagtctcaagatggcatggctcacgctcggcatctaggaatttctgaagacctccaggcaggggccatgaggatgtgtcctcaaagaaatgcctgatccttgtggctggatgctgcctgccccctcccttcccagtttagataattaacagacctgggcggaatgctgagagttccaggggcaggaaaggagccattctcagctccccagtgccaggccccctgttgacaccaaacagcctcagagcaacatctgaaggccccaaaggagagaccagccaggaagatcccagggagggatccagccccatccaacccagccacccagagcctgaaggcagagcagaggcatcccagcactggggacacccactatatatttt

SEQ ID NO: 254276 - DNA, 566 bp, Homo sapiens
ttgtttgaatgcttcatgtatcctctcaaccacaacttgtttgcagagttttaatctgaagggcttaggtctcttgttcaatgaatgagtttgatctgatgggtgagaggaaggtgaaatggaaagcgaacgagaagccatacagattaggcgagtgagcctaatctctccctaaccataagattgagtatgcctgaattcttcgcagagtggaagaatccattttaaatatatatatctacatgtacagatcctttaaatatttgttctgacattcattgtttttgagtcactgtcattgagaaaagtttagaaaggagatattaggagcaggaaatagaaggtaaataaaatatcaaaataaaaatggggttttataaatgatataataggcaaaataaaggaaaggcatcctagacctctggttaaaatgaagatggcacttggcgagatgtgttccagggtagttcacatgatgtatgttttcagagaattgtcatattgcatatgctgctatattttttattttcatgaattaaaaggcatgttgagatttcagagtttta

SEQ ID NO: 254277 - DNA, 376 bp, Homo sapiens
ctgcctgtaaaggggaggaagactagaaaatatttgtcaacaccagagactcctaggctgggtgggggatatggacactgttttgatgtaaataaaaaatttggcacccaaatgaggtgaatggtgactggcaactgcacctagttggatgtcagtgctgagttgcatttacctaaaagagcagttagcaagttcttgatgtgtcctgctgaatgttttatcttgtgaagggaagaagaagaacctatagagggctgggcgaggtggctcacgcctgtaatcccaacactttgggagtctgaggcaggagattgcttgagcctaggagttcaagatgagccaaggcaacatagtgagaccccatctttattacatt

SEQ ID NO: 254278 - DNA, 151 bp, Homo sapiens
ttggttcttgttgagagaatagctttgacggatttctaggctgcagatgtcaagttcaaagtcttcatcatatgggtgatatttaaagtggtgagactctgagaaagtgtgcagatgagggagggaggccctgggaccctccaacatgtag

SEQ ID NO: 254279 - DNA, 706 bp, Homo sapiens
actcacagtccagtgttaacaggcaataatggtgtgattccagaggagagtactaggtggcaggaaaataaatgagattagcagtatttgacttggagccataggcatcaattctgctccagctgtcgaccaggttctaaaaacaagactcggagcagcttttgctcttgctagtgatgcagggccaggagagcccccacactctgcatttgcaggtgtccatgaggggaagccactcctgcatttatcctgtgagtggagaagctcagaggaatgaggacattccaacagggtatcagaattctcttttgtttatgctaattgacagcaggaacatcaccatcttggacaaacaccaccattttaagttctcttttatttaaaaactgcctaaatccagccccaaaacatcagcctaatggctattgtcagcataatcagaaacattccaaccctaagataaacacccctctggccagaaatatgccgaccccgagacagcctcccctccgaccagagacattccaaacccgcagtaaactttccttcgcatggaaacattccaaacctacaaaaagcttccctcttcctaaacccttaaatatccttagtctgcaagagagaatgctcctgactgaaatcagccagaagcccctctcaggtttattctccaaaataaacctgtctttgactgttgagccacttt

SEQ ID NO: 254280 - DNA, 481 bp, Homo sapiens
actcgatccgctgatccagcacacttcctaatagccctatcggtgacaatctactgcattgtcttatgaaaacctgctgcctgttcctaggcaacccgatcaacggaaatctcaggtttatacaattttcatttagggaacataaaggttaactgactgtaatgggagtgttttaaacaaacccacctactcttcctctcactgaacagggctgacagctctgtttaattctgctctgtctttgctgctggtggtttgggcagcaatgactgtctgagtgccaaccacctgctgggtcaacggtgagtgttccccaagacggagtcttgctgtgtcgctcaggctggagtgcagtggcgtgacctcagctcactgcaacctccgcctcccgggttcaagtgattctcctgcctcagtctcccgagtactgaagcaggagaatcgcctgaacctgggaggcggcctattgcactgagcccag

SEQ ID NO: 254281 - DNA, 548 bp, Homo sapiens
agcaaatgtcactgactttttgaaaaataaacaagtgcatatatcatatagggaaaaatactgaaaagacatactaaagttgtcttagaatcactctgtttttaaattttaattgggcattttgctagttattttctaagctttctgctaagcaacagggagcaggtttttgtaagataatgcaatagactgtcactgataggggaacataaaggttaactgactgtaatgggagtgttttaaacaaacccacctactcttcctctcactgaacagggctgacagctctgtttaattctgctctgtctttgctgctggtggtttgggcagcaatgactgtctgagtgccaaccacctgctgggtcaacggtgagtgttccccaagacggagtcttgctgtgtcgctcaggctggagtgcagtggcgtgacctcagctcactgcaacctccgcctcccgggttcaagtgattctcctgcctcagtctcccgagtactgaagcaggagaatcgcctgaacctgggaggcggcctattgcactgagcccag

SEQ ID NO: 254282 - DNA, 454 bp, Homo sapiens
tactcttcctctcactgaacagggctgacagctctgtttaattctgctctgtctttgctgctggtggtttgggcagcaatgactgtctgagtgccaaccacctgctgggtcaacggtgagtgttccccaaggccaggggccatggcgcatacactctccaggggaccctggcctgtcctgggcatctgaatgacaggggaaggcagcaggtaacagttaacagcagggaacctggcctgcctgccctgaaggcctcttgaaagacttctcaggaccaggaagcctgtccagtcccctccacccccgagactcagccacttaattcaatgacgcagatgcggaggaactcaacacgccaggcaagtgctaggctttggggacccaaagataaataaggaaagcctccacctctctgagagctctcattgtattgaaaaagaagaggctctgactg

SEQ ID NO: 254283 - DNA, 496 bp, Homo sapiens
caacattggtttttaaaataatatgaatcccacctcagcctcccaagtagtggggactacagcaacactacaccgagccacagttccctttcttgaatttggaattattttcccccagtttgagtcagagaacatttgaatggaatcatctaatgtcctatccaaaaggactatttttctttaaaatgcatcagtgtcttaggctgaagttcaagagcctccatttccaactcttgggactactattcctcatgatcaccatttagaagcctcttttactcacctgtctattcttgagtaaagtacacaaggttgaagaaagtcttccattgaagacatcaagacaaactgctcagcatttagaaatgctaccatttgccctccccagcctgagccccagttgagtctcatcttacaatccggcctaagctcgccattcttgcaaagtaagccttcacaaagcttgcttgctctcattttcaaacacaaactcggg

SEQ ID NO: 254284 - DNA, 484 bp, Homo sapiens
tgaatatttgtgagagggagttaagtaatataaataatataactgaaaacatttttgaataaaaacaaactctgatgcattatgtagtcaaaacaagcttctcttgaatttttatatgaaatatgagactgcaaagaaactcagctttgctacaggttacttgcagctaaatgtctatctttcctcttcccatgaaccaaccctcttctgccattgaaacatttccattgagacattggaaatgcctgagaatgagcaacattttaaaacagtttagcacttcctagatgattacataatttcagcagttatttctgatttccttactgatcttattttcttattgatcttattttctttcctttgatttcttgctctgagcccctatgctaatatgtttttccttctgaactcagagacacccatttatcagtaatatgcatacattttctttagtgttagtaatagaaattgcttccccaaa

SEQ ID NO: 254285 - DNA, 706 bp, Homo sapiens
tgcctggggttatttcgtcacgaggcaggtatgaaactaagagacatagagaacttaagagacttgtccaaggttacccagcaggtaaggggatgtctggattagaacctgggcagcctggctttagaattcgaattgtcagctgctattactgcccatcagtggcggaaggacccagaggtgaagacttggcaacagaggcagggtggcgtggacgggggacagataggcctggccggtggtcatacagccaggatcaggccttctgtgggctccacagggtgtgctcccagggccgccccgctggcctctgggctgagtttccttgaggttgtctggatcccagaccctctggccttcccagctcagcagcttcagcctgggagagcccacttttcctcagcagacagctgatgatcgttgactgggcttggtgggaggtaaggaggtaaccagcaggttttctttctgtgatggtaagaggccgccttggaagcagacagctgagaaaacacaaagacctgggctggccggccccacccttggtcgagccgcttctgcctgtgaagtgtaaatgcaggtggtgtcaagccggcagacaggcccagctccctcttccccttgagcaggcagggtgacgccccctgcagcaggcccgtgattcagttgctctggctgatgaggagcctgggcccgggaggagtgt

SEQ ID NO: 254286 - DNA, 745 bp, Homo sapiens
tgccttcgcatatatcatctcgtttaatcctcgagacagcttccatgaggtagcctcattatacaaataaggaaactaagagacatagagaacttaagagacttgtccaaggttacccagcaggtaaggggatgtctggattagaacctgggcagcctggctttagaattcgaattgtcagctgctattactgcccatcagtggcggaaggacccagaggtgaagacttggcaacagaggcagggtggcgtggacgggggacagataggcctggccggtggtcatacagccaggatcaggccttctgtgggctccacagggtgtgctcccagggccgccccgctggcctctgggctgagtttccttgaggttgtctggatcccagaccctctggccttcccagctcagcagcttcagcctgggagagcccacttttcctcagcagacagctgatgatcgttgactgggcttggtgggaggtaaggaggtaaccagcaggttttctttctgtgatggtaagaggccgccttggaagcagacagctgagaaaacacaaagacctgggctggccggccccacccttggtcgagccgcttctgcctgtgaagtgtaaatgcaggtggtgtcaagccggcagacaggcccagctccctcttccccttgagcaggcagggtgacgccccctgcagcaggcccgtgattcagttgctctggctgatgaggagcctgggcccgggaggagtgt

SEQ ID NO: 254287 - DNA, 468 bp, Homo sapiens
acattaggaaaatacagctgttagaaagaggaggggagagtacacaatgtatttatagcaagtgtatatattatatcaagtagaacagacacccagccttttatgagcagttttaactctgacatgcatgagttttaaataagaaataactatagaaatctccaaagaattttaaaaatcccaggccgagcatggtagctcacgcctgtaatcccagcactttgggaggccgaggcgggtggatcatgaggtcaggagttcgagaccagcctggccaatatggtgaaatcccgtctgtactaaaaatataaaaattagctgggcgtggtggcatgagcctgtagttccagctgctcggtaggctgaggcaggagaatcgcttgaacccgggaggtggaggtggcagagagccaagatcacaccattgcactccaagctgggcgacagagtgagactctgtctcaaaaa

SEQ ID NO: 254288 - DNA, 1215 bp, Homo sapiens
tcgcgacggggtagcggttccggaatcccccagaaccgtgagtcctcctgaggaagccgtcgggggcctggccctgttaggcactgtctcccagagtccccctttcccactagccgcctccgcgtagcccgagaccgcgtcaggagttgcgtcttcctggctgcgcctttttcgggacgtccccgcgccgtccgccgcctctcactgtccccggagcgcgcgccacccgcccgcttcccacaggcggtttcacgcgggtccccggcgccgcgcgcggctccggccctggcgactcttgggacacccgagtagttgcgtgatagcggggctgtcctgaggattcggcgtgccaggttgagagcccgtcgcgtgccggggactcgcggccactgtcgcttcccgtccgcccctcttctcctgggatttggggaggtgggcgggaaagagaagtggtcggcggccacccttgccgactcctcctcagcaggtcgcagttgaaaggtcatccttctggagcccactcccctggcccggcgggcaaggataggtctccaagtcccaccctctcacagcgctcggttctgttccactttagaacaggtcgcagttgccactacgtaaacagctccccatagagagagtattttattcattccgattgctccgtcttttatctagaacagagtctggtacaatgactctcgaaatgtggtctggtgacctcagggtcgctgagacccttctagggaattcacaaagtcaaaacaacattgataacgtttcttacgtgttatttgccgtttttaccctcattctgttggaaatgtacagagttttcaagcggctagatgacgattgactagctggtaaaatgtatcctggagtatccttgtgttttctagaattttctaaggtagtaggtttagggcataaatacgtgcgttttcagagattaatgcaatttgccctcagtactcctagtgtgtttctaggaggtaggttaggtaggtggtgatagcctcccttcaaggggaacaaacttgctaaataaatagaacaaaccagcccatagtgtacaaaccacatccgaggctcctggttagaaaattttgcagcaaagaggtacgagagcagaagggaaaatccccaaactctcacaagcgcagaaacccatgatcagtgtcgttgggctgaattatactcattataatagta

SEQ ID NO: 254289 - DNA, 410 bp, Homo sapiens
aagctataactagtaaggagattgaatcaggaatcaaaaaccttccaacaacgataagcccaagaccagatggcttcactagtgaattatactaaacatttaaagaagaattaaaaccaacccttttcaaactctcccccaaaaagaagagaagagaatacttcttaactcattttataaagccagcattaccatgataaaaaaccagaaaaagtcactacaggaaaaaaaaactacaagtcaatatccctaatgcatatcaatataaaaattctcaggaaaaaaaaaaacctagcaattcaatttcaatggcacattagaaggatcacgtaccacgcccaagaggcaattatccctaggatacgaggatggcacaacatacaaaaatcaatgtgatatataccacattc

SEQ ID NO: 254290 - DNA, 694 bp, Homo sapiens
caaagagctatttttgaggaaaggattcctcacatttttgcaggtgtaagtcattcctgcctcagtggagtacaaagagtgatgtgagggaagcagagctgctggcaggaattttaaaagtatactatatttgtcccacattaactgtgcttctggggtataaaggtcagggatagaactggtcctgtgggatgtttctcatcgaaaccacctctattccaaagccttggtgtcactagccaagatgtatctattctaataaaatataggtctcatatgacaccacattacaaaatacaaattttcatttgtttttgtttatctagtctattggaaatgtgtggttcttttgtagtttcagttaagagtctaatttggtcatttgcctcttaaaatactcttcaagtcctgtgagtactcaacaaacactcactgttgaccaatttctatttccagccacatactgttcataatgaaacctacttagaggatttgaatgaaataatttaattattttcaatgtacaagaggctaaatgtttccatttttgatgttcaatcaagaaacattcaaattcaactgtattttttgttaagaagaatatttcctttggcattcaaaatgatcccaaacattgcttggaagagagaagtggggagagagaccacatgtattaaagcacatttaaccaatt

SEQ ID NO: 254291 - DNA, 694 bp, Homo sapiens
acaacactttcatctttgttttgttgtctgttgattgtatttcctcattcaagttgagatgttcttggctttggtatgagaagtgactttccattgaaacctagatattttgggtattatgttgtgagactgtggattttacttaaacctcttgttttagtggtgccttctgagactgctttagcagcatgaagaggatggcgctgtcttattattgcaagatgagaagtctaggttctcacctgtcctccattgacacctgagtggaaaaaggagtttttcattcctgctgggcaggggcacagtctacctttcaccagtaggcttctgctgatatcactctaactggaagggataggaatgactcattactgttttatacatggcctttactgatactatggatgtagagggtggttcgcttctctcctgtccctctccctttcttctctctcttttccttctcttctcttttttttctgctatttcacttcccctcttcctctttctttatgctttctttcttcttcttatctatctttttttctcctttctcttccttccatccctcttctttcttatcttccttcgcatttttcttctctctcttcttactctctctttctttcttattacttttctttctttcttctcttcttttcttcccaccatcctctctctttctcttttttcc

SEQ ID NO: 254292 - DNA, 1148 bp, Homo sapiens
tgtcccactgtctagacttttagccccttgaaaacagaggtcatggtttaagtgcttttgtgtttcatgtacactgtaggcattcagtaaagagttgctttgatttttagcttggtggtcttaatatatgcattttatactgattttttaaactgttgttgttgctgaaaactagatttgtcagcttgtttagtgcatcatgatccgcttactatggattctgctaccttgaccagcaaggtagcagaattttaactataatttcttctttaataagagattttctgaggcaggtaaatgaagtatactgatacttcttacacggtggaatatgaaagtgtgacacgtcgcatcttgaaagtactttaaattgtgtgcctttgagttctacactgaaaaataaaactactaccaacaacttgaccccctttcctgccctcaaattgtttagaactgaagatagtgttttgttgtacatatttatattccataaagtaaaattttttaacatcagaaaacatctaaatatattatcgattccttaagaataaacactcattccctgatgtattatactattactaattactttaaaaataaaattagtattgtttttaatataaaatgtttggtaacttgatttttattatactttgcttgctcttttcacatcttatggtaagtttaaagtactttctgatgtcttgtctttgtaatgttttagtgataagaagactcattattagattgactacacagtacctctgagaatgatgagtgttattcctaagttcctaaaaggagactagtacacagggctagttcctggcagtaagaaataccctgccttagctttttggaaaatttactatccgttcggtattgaccaccagtggagcatttgttattaggcatttagcaagtaatgtgctccaaattgcatttccttctcttatttttatccttatgagagagtaaggcaggtgttatttttagttatgaattaggtgtcctgggatgtacatgcctaaattatattgacagccagttgtggagatgccttatacaacctatctacaatgttttctctatgagacctgctgacttatacacgttgaattgtactccagtgtgaagtcctgtataaa

SEQ ID NO: 254293 - DNA, 377 bp, Homo sapiens
ggaaatcacaagcagctttgttgaagaagtggtatctgaactagatttgaaagggtgagtctgagttgaaaatgcagaagaggagaggcaggttctggagcaggtggcggggtgcatttcaacaaccacagcagactgcccagtggttcgctgtgggggatggtgtggatcagaagcacagaccagcccgggcaacatggtgagatcctctctctattaaaaaaaaaaaaaaaaaaagaaacgaaaattagctgggcatggtagcgcatgcctgtaattccagcactttgggaggcctaggcaagtggatcatctgagcccaggagttggagaccagcccgggcaacatggtgagatcctctctctattaaaaaaaa

SEQ ID NO: 254294 - DNA, 516 bp, Homo sapiens
tgatttcattggaaattcagctggaggagtatatttgggttcacctctttgttttcaaaatatatactaggagtgatattttatcagaaaaaaatgtatctttaatcactttatgttactagagaaaatgtaagtcatttaaacatcttgagttcctagaatttttagttgctgggataatttggttctcctttttgcctcacatggtcatattgcctctgaaggtgactggcagtgcaatcaaaaccttcaagaacaggccaagtttaactgaatcccttgtggctgtcactgtgatgagctttggagagtaagtaggaagctgtgttggagacatctgttgtcatgtgtaatgtatatcaggctttggcagtaactgaaaccaagcaggcccatcagtctatagtttatatgcagtaatcttagagctcaaaaattacttctgtgaatggcaaatcgttggacagaaccagcattttttatacttgagagggaaaggagtttgaaagactcacc

SEQ ID NO: 254295 - DNA, 359 bp, Homo sapiens
atgcattggtaatgttgccatgtatttcaaattaccctccatgtatgtttcttaatccttaatctctctttaaaatgctaacaagagttgttttaactaatgcggaagttggtttatctcacatccttctcagccacctgatcaagcctacgtaatcaagtcattcatatgctcactctcctcgtcatcacccccgtttgtgggtccgcaactcttcaggcagggtgcacccctcctacatcggcaagccctctgcagcaaagccgagcagtatccaacagtctctagggatttccctgacattccactttccccttccctctgagctgctttttacattttattttattcaccttcta

SEQ ID NO: 254296 - DNA, 465 bp, Homo sapiens
agatgggaggaagattggaaaggaaaaatgaaaactgtctacgcagaagaccataaaagattgagacaatttttaaaagaaataggtagaagaatgtaccaggctcaatccttagaagattcactataataaagatgttaatattcatcaagttgttcttcagattccatataattccagtatagatttcagcagtgtgtgtaggaagagggaggtgaggtatgagaaaatggacaagctgtttctaaaatgtgtataggaacagaaaacgtaaagaactaaaacaatcttgaagaacaaagtgaagactttctctaccagacagcaagacgtttaggccagatgcagtggctcatacctgtaatgcctgcgctttgggaagctgaggctggaggatcacttgagaccaggagctcaggactagcctgggcaacatagcgagacaacttctctacaaaaattaaa

SEQ ID NO: 254297 - DNA, 663 bp, Homo sapiens
acctctccagcgatgggagccgcccgcctgctgcccaacctcactctgtgcttacagctgctgattctctgctgtcaaactcagggggagaatcacccgtctcctaattttaaccagtacgtgagggaccagggcgccatgaccgaccagctgagcaggcggcagatccgcgagtaccaactctacagcaggaccagtggcaagcacgtgcaggtcaccgggcgtcgcatctccgccaccgccgaggacggcaacaagtttgccaagctcatagtggagacggacacgtttggcagccgggttcgcatcaaaggggctgagagtgagaagtacatctgtatgaacaagaggggcaagctcatcgggaagcccagcgggaagagcaaagactgcgtgttcacggagatcgtgctggagaacaactatacggccttccagaacgcccggcacgagggctggttcatggccttcacgcggcaggggcggccccgccaggcttcccgcagccgccagaaccagcgcgaggcccacttcatcaagcgcctctaccaaggccagctgcccttccccaaccacgccgagaagcagaagcagttcgagtttgtgggctccgcccccacccgccggaccaagcgcacacggcggccccagcccctcacgtag

SEQ ID NO: 254298 - DNA, 450 bp, Homo sapiens
ccatgccaggctgaagtttttttttagtagagacagggtctccctctgttgcccaggcttcagtaaatttaaagagatagaaataatacaaagtattttcttcaaacacaatgaaatgaaattagaaatcaataacagagaaatttgggaaaataacaaatatgtataaattaaagagtatatttctacaaagccagtaggccaaagaataaatcacaaaggaaattagaaaatactttggtatgaacgaaaaccatgatacaacatactaaaatttatgaaatactgctgaagtaatggttaaaggaatacgtatacccttaaaagcctgtgtttaaaaagaaagctctcaaatcaattatctaaccttttactttaaaaagctataaaaagaagataaaactaaacccagagctggcagaagaaaacagtaaagcttagagtagaaat

SEQ ID NO: 254299 - DNA, 696 bp, Homo sapiens
taccatgccagaagtgttcttggcatgtcatgaggactgttgccgttattagcgatgacaatgcagtcattatttttacactggcttaattgttcagcagacaccaaggaccgtgtcaacacagttctgcaaatggaaacaaacacgccatcattcagggtcccactttgatattctgcctttgcacttgtttcattttttctttgaagaacattctatagatcgaaggaattattccagacctctgattcatgctaggcttattctcttcctcattcagtctctcaatcaatcaatacttactgagtacttgtcattgcaagacctgaggaatagaggggctagcagaccagcctgggttctgcccttattggaatctttcaccttctactgcagaaggtcccacctttaggtagaatgatcagagatctctctgaggatgtcacatttaaactgtgactctaaggatgaaaagaagccagatttgtaactaatgaaaggatgttccagccggatgctggaactttgggaggccgaggcgggtggattacctgaggtcgggagttcgggaccaacctggccaacttggtgaaaccccatctctgctaaaaacacaaaaaattagccagacatggtggcagcacctgtaattccagctactcagaaggctggggcaggagaatcgcttgaacctgg

SEQ ID NO: 254300 - DNA, 207 bp, Homo sapiens
cctcctccactctccttggatttttgtcatacattctaacacactagcagggctcacctcaagtttactgcaagtatcacacacatgtcctctccaacaactaaactaggacatagggggccttaggaggcactttattgatcttagtttctctaaaatgaacacgaagcttaaactcattaactgtttactggcaacccattcaac

SEQ ID NO: 254301 - DNA, 257 bp, Homo sapiens
aacatgggaagtttatcttactaacctgtttacttatatgggcttaagactaacctttgtcctactagggatactttactgcctcctactcaggggtcagcagaagtttattacccacaaactgtgtttgctttaggcctgagaacctggcctttaatctttaccctctagtggtgtttactcataacttttgttaattagtcttactgaataaatatgagcctcactaactgaccagggctgagtcgcaactgttt

SEQ ID NO: 254302 - DNA, 1068 bp, Homo sapiens
ttaataatgttgaagtagtaatagtttgtcaatatttcaagaaggtaggaatggccattaaaaaaataaagtttgaattgattgagttgtaatttataactaagtgaattaaatgctttctaaatttgagcagactgttaatttgtagcctaagctctgtaaagcaattgtggagaacatctaaaggcattctcctagaagaggactttatatgtacatttgaggagacagatttttcgttttatattaacatctgagaagtagtcctttctcaaaagtgctgtggatgctgtagcacttgctctagtattcaggacttttccagtcagtttattgttagcttttggtttccttgagaaagggtttgactacaattcttccttttcatttcagttattagttttatgtagatgtaagtgctgttatcttgatggaaaaggagcttgaagtcccctccccctgggaaaaaaaaaaaaagcccttcccaaataatacaattttgatcagagtacctggagtgttattgtgtctggagttcaaaacatttgcttaaattttgaactagagatgttctcaaacctaagtttaaagttacttctagtcagggccattatgtttgcatcaaaaaaataactgaaaaaaactgaattgaaagacaatattatagtgaagcagatctttattctgtaatccagaaaacaaaatcgttttctgtttttgtgaatactttgtgtagaaatgtcttgacagccacgtttctgaggtaaaacggtttgctcagatacaaagctgaacggtgtattccaattagctgttctaacaatttaccactggaacctgtgaccctgcgaaaaggttgcagatcttttctgttgtcttaattgtgatttctagccactgaagattgggtaaacatagtaaaaaatgcattaagtattatttatatgtattttaagggtttaaatttaatatctccatttgaatattttatttttatggaaaggaagttacttcattgctagtatcagggatgtgtatgacgaatataatgtaggttttgctgtaaaa

SEQ ID NO: 254303 - DNA, 369 bp, Homo sapiens
cagtagcacagagtatatttgaaattccaataaaatcaatgttgacttgattgggaaattctgaaaattagaattaaagtctaaggagagacagattaagttattaattagctagggttgccagaaaacagcaatatataaaaagagaatataaggaagacgacttcctgtaaagctgtcatcatgcattcaactagaaatggatcctgcagtcccacatgtagaaatgagatgaaagtttggagtagctgcctcctttcaagagattcacaattttgaagtgttacagcatattcccagagggctgggtgagattgtgtgtgtggtggggtaaagtagagaaaaaagtgtcacagaaaattagtagtt

SEQ ID NO: 254304 - DNA, 342 bp, Homo sapiens
gtgagcgagctatagaacttccggacatttcaactttattatttcaagtgtaacaccaattgttgaggagaaaattagcatgcagtggcttggggtcaatcaggcctatcttgaattatctgtttctgtaaaaatgaggggaaaatgagatgtaggtctctgtgaggattaggagtggaaattacgtaagataacataaacattgtatgtgaaacttcttaatagcagagtacattgtagggggatcaataggcattgatttgtagatattaatagatactttttcataattttaaactctgtttttctaagtccatgattaaaaatattttccagcatatt

SEQ ID NO: 254305 - DNA, 360 bp, Homo sapiens
cgcgtttatgacgtacgagtgtgttttgtggaaaccactgagtagtgctccgcgtgtcaaagaaaaatattcccctaatgagaaaactgagaaacgagtgcagagaattaattccaaagttttaaattttcccattcgtgtcatagtttgggtaccctactcctcagacccggggcgagccttcggctgtgactcagcacataaaaaaccagaacgccggaagtattttcctacacccgccggatggacgctgctcccgagcgccgcaaatactaattggctcttctctaccctacagtcggcccgacagtggtggggtttcatcctcaagccctaagaaagtgctaaaaagaccagtct

SEQ ID NO: 254306 - DNA, 271 bp, Homo sapiens
gggacggaagggggagataaaaagcctaattaaattctcacagagcgtttatcctaatattaactagttaatgacctcaagatatgtattgagcttttactatgcacgcatggcaggaggggcgtgccccttccttgccttaacctggtgtggttctttgactttttactcctgtatactcgaagaaaacaatacaaaaatcaaagctgggaaaaaagttcctgtatggggtatttcaccgttttaatgcattaaacatgatgtgctcaaa

SEQ ID NO: 254307 - DNA, 474 bp, Homo sapiens
aaaaaaaaaaaaaagcatgaagctgcatggaggaagaatagattcctgaacaaaactagagctctgttaggaaggcaaagagaatgggtaagcagccagcattgttcactgtaactgtagacacctttttacacctaacaccctgtggtggttaattttatgtgccaacctgactgggccacagggtgcccagacatttggtcaaatgttattctgggtatgtctgtgagagtatttcaggatgaggttgatatttgaagtggtaatgtttgaagtggtgggctgagtgaagcagactgccctccctaatgtgggtgggcctcatccaatcaattgaaggcctggatagaacaaaaagattgagtaaaaggaattcctcccacttgactgctggagctgagatattagtcttttctaaccttcagtcttataccaaccatcagctctcatggttctcagccctttggactcaga

SEQ ID NO: 254308 - DNA, 211 bp, Homo sapiens
tggtcaggtctaggcagcaaacagcacatcgcctgccatgggttcacagactccagaggccctcacttcagatgacaaaggtgcccttcctgccaatgatcagagaggtctggatctgaagcacatttccagacaagtttttttttttttttttgagacagggtcttgttctgtcacccaagctggagagcagtggcgcaatctcagctca

SEQ ID NO: 254309 - DNA, 324 bp, Homo sapiens
tccattagaaaatatattcttcctgttttatagacataggaacagaattaacttcatattttgacagatttttttagagatctaagatacaattttgtgtaactaagaacataagatgggggctgtgtgtatgtgagtggaagtggttgtcggtgtaggggaggaggatgggaatacagggacgtgcaaagccctgaagccgtgctagcgatctcagtcctcccttcccacagattaacaagcccgtggaggaacactggaacacactggggaattctttcttagtagtgatttttttttgctccactttgtttcatattagtc

SEQ ID NO: 254310 - DNA, 298 bp, Homo sapiens
catcatctaaatctggtaaataagcccaaataaagtatggcttttttttgtctgggactacaagattagaacaggaaacccatatcacaactcctgacaccagagaaaaacaggctcctttgggtaaagatgtaaagaggaacttggctcatgaaaagattcaggaagccaggcgcagtggctcactgtaatctcagcactttgggaggccgaggcgagcaggtcacttgaggtgagaagtttgagaccagcctggccaccatggtgaaaccctgtctctactaaacatacaaaaatt

SEQ ID NO: 254311 - DNA, 396 bp, Homo sapiens
aaattcaacatacacaattccatatctctgtccagtttggtaaagataacttctttagttaattaaatcagatctggcctctggcctcctcttattcccctgcctcaactctccaacttttcccatgcatctctctttcccctgctctattcatagaaccataaaacctcaattcagaaggacaataaaggtcatctagtgtggcttcccacttaaaacctaaataccctatagttaacatggggttgagctataagtttttctcagaaccaactcaacttggccaggtgcagtaggttcatgcctgtaatcccagcactttgggaggctgaggtgggcctggaggagtacgagaccagtgtgggcaacatagtgagaccctctctctacaaaaaa

SEQ ID NO: 254312 - DNA, 531 bp, Homo sapiens
tatacagaatcgccctgaaatctggctatggaaaatatcttggtataaattcagatgaacttgttgttgggtgttcagatgcaattggaccaaaagaacaatgggaacaagtctttcaaaatattagatcctgtgctgaaagagaaaccacgaaaaaagatgacattcaagaagaagacaaaggaaatgtaaaacaatgtgaaatcaattatgtaaagaaatttcagagcttccaagaccacaaacttaaaataagtaaagaagacagtaaaattcttaaaaaggctcagaaagatggatttttgcatgagacgcttctggacaggcacggcagtgatccagatatagagccgttgctcttgcttctataagtgtaatattttgattcaaaaaaggaagtaaaaggaagagagttgattacatttggctactgacattaataataataaataataattgtacttgtaatataaacatccgaaagttttagttataagaatggctgtccacataataaaattatgtaaaaat

SEQ ID NO: 254313 - DNA, 397 bp, Homo sapiens
caaaagggcccattgaaaacccagacaggcttgaactgtaagtcacaccggagagagggttgctgaggggaccctagagggaggcagtcccggagcacagctttgcttctttggctacttcctcgctttggaggttgctttcttctcaaggtggaccacctgctagaacagggcagcactgctgttcactggccagcttggagagaagactgcccatgtgattctaagtcaggcccttgtgactgaaccaccatgaggctggactgtggggactcgggtatcccagaggcagagcacaccaggtctgggaggggggccactcagacggcaacattgtcattcaatatctattgaacacctactgtcttaatccatgtttgttgctaccacaaaaaaa

SEQ ID NO: 254314 - DNA, 1027 bp, Homo sapiens
gtgagatgatggtaacattaacagaagtagagaaaccaggaataggatcaaaattggaggggaaggggaaaagggccttttgttttgagacatcaacttagaattgttgatgggctatccaggtgggtagataataaaagtttttgtgggggaggactaaaactaaagagttagacttaagagagaaatacttgagaatcacttacatggagatagatgatagttgaagttaaagaagagaacgagatttctaacggagggaatacactatcaaggaaaggattagagaaccctgggggagtgtgaatatttgtgcctcatttaattttcagaaccagatcatgaggaaagaatacttcccattttagagattaaaaaacaaaaccgaagcacagtgcttaagtaactttctcaaggccatataactaataagtggcagatatgagattttgagccctactctaaaacttgctcctcaatttgaatgtttacatatttatgtaaataatatattttacaatattaaaaacgtttttgtagagatacaataaccatataattttacaggattgtcttttttatttacgtttttctttggagtataatacatttttaattattggcctgagaagaagatacaatagattatttttggcaaatggtgcactcattcatgagagacactgtattttctaaagcaggctgatctctgcataatactggctccctgaaaataaatccttgctgggccgggcgcggtggctcacatctgtaatcccagcactttgggaggccgaggtgggagcatcacgaggtcaggagttcgagaccagcctgaccaacatggtgaaaccccatctctagtaaaaatacaaaaattagccgggcgtggtggtgcatgcctgtaatcccagctactcaggaggctgaggcaggagaatcgcttgaacccaggaggtggaggttgcggtgagccaagatcgtgccatggcactccagcctgggcgacagagcgagactctgtctc

SEQ ID NO: 254315 - DNA, 624 bp, Homo sapiens
ttcattgtgcaagtctttcacctccttggctaagttaattcctaagtattttattcttttcaatggtactatacatggaattgtttttgtcttttttggacaaattggataatccttttcaggttatccattggtagtttatacgaaatgcaactgatacttgggtgttgactttgtatcttgctactttgctgatatcattaattagctctagcagtttttttgtggcatatttaagattctttacatataacatcatatcatttgtgaacagaggtaatttttttttttttttttttgagacggagtctcactctgtcacccaggctggagtgcagtggcgtgatctctgctcactgcaacctccgcctaccaggttcacaccattctcctgcctcagcctcctgagtagctgggactacaggtgcctgccaccatgctcggctaattttttgtatttttagtagagacagggtttcactgtgttagccaggatggtctcaatctcctgaccttgtgatccacccgccttggcctcccaaagtgctgggattacaggcgtgagccaccgcgcctggcaaacagaggtaattagacatttttctttcttttttttttgaggtg

SEQ ID NO: 254316 - DNA, 518 bp, Homo sapiens
ttcattgtgcaagtctttcacctccttggctaagttaattcctaagtattttattcttttcaatggtactatacatggaattgtttttgtcttttttggacaaattggataatccttttcaggttatccattggtagtttatacgaaatgcaactgatacttgggtgttgactttgtatcttgctactttgctgatatcattaattagctctagcagtttttttgtggcatatttaagattctttacatataacatcatatcatttgtgaacagaggtaatttttttttttttttttttgagacggagtctcactctgtcacccaggctggatgatactgtcattctgatttaagtgtttgaggagctgccgtagagtttccacggcagctgcactgttttccattcccaccaacagcgcacaggggccgatagccccacgtcctcaccaacacttgtgattctctggaggtttttttttttttttaatagcagccatcctcaggggtgtgaggtggc

SEQ ID NO: 254317 - DNA, 463 bp, Homo sapiens
aggagaaatgatcagacacatgtgattttatactgatttatggactgtagctaatgctttagctggatggtcagggacttagaaggagcatgatgggcaaattggtgacaaggaaattgggagaagtatatgaatagacttctctgagtgggcaaaagatgtgaaggtatttgcgtccacatgaatgttcatcaaaaggtgacatcagcagaggaggatttttttttttttattttttttgagacagagtctcactctgtcgcccaggctggtgtatagtggtgtgatctcggctcgctgcagcctctacctcccaaattcaagcgattctcctgcctcagcctcccaactatctgggattacaggcatgtgccaccacgcctggttaatttttgcatttttagtacagatgaggtttcactatgttgcctagcctggtctcaaactcctgagctcaaaacca

SEQ ID NO: 254318 - DNA, 275 bp, Homo sapiens
taactagcacctataatccctgctgccctgccctggaatgctgaggcagaaggatggctagaggccaggagttcagccttagcaatatgagcctgtatcaaaaaaaaaaaactttattaggttagctgcatagtcgtggtacacgcttctgtgcctgtagtcccagctgctcactactcggggacgaggcaggaggatcacttgaggagtttgaggctgcaggtgagctatgatcacatccctgcactccgccatgggcaacagagttagactct

SEQ ID NO: 254319 - DNA, 418 bp, Homo sapiens
tgtttaggtactaataagttgttaatttttattctaccatgaaaggatactaacacacacacacacacacacacacacacacataccacttgactatcgtctacatttcaattttaaaaaatttaagcctaaaaagtaggatggacataatttcacaatgagggatcatccttcccaagaaagagaaattgataacactacattgaaaacacaacctacttacacatgtcatcctttctttctcactttgccatggtaatgtcaaaaagtttacctttagtttcttgttgtacttgattttaataagccactttgaaactcaggcttttcacttcttcaaactggctgttttctaatcatctggataaacagttggcatttcatgtgtctgttttgtgccattgggcagaaacctgct

SEQ ID NO: 254320 - DNA, 434 bp, Homo sapiens
aattattataacaatagatagcaagaaacttggctttcatttgattcctctgcccagcttcttataaagtgacatccatcttatttctgtattacaccaaagtaaaaacaatatttatatacattaagattatgtaaagactaggatgctgtaatggtgtctggtatatatatccacgatacaatcatatagtacctccactctgaagacacagaatatgaattcgctttagtacctagcaaggagccaaagagtaccttacttcctatgtctgagcatttgaccgaacttaagaaacaacaccccagcaaccttgtcatttcaatttttcacacttttgtctgtatgtgttttatgtctcaacaaagacttatctccccaacccactgccacaggataattctctgtaacaaagctcagtctcaatctccacc

SEQ ID NO: 254321 - DNA, 5219 bp, Homo sapiens
gtctcctggaccccctttcgtgacccctctcaacacctctactggggagacgaggaccccgaggttctggggggcgacgcgacctgcccgaagtgacaagggtcctgggccgcactgctccgccggggtctgcgctcctcggcggagcgggtgggaaggatgagtcctcggggtggagaaggaggagcgggtccccgggtaccgctcacccggccttaggagcccgggagcgcgcgtagggacgcggagttgaggctctccatctgcggccagggaaagggatacagtcccccgggcccctcccggccgctcggaacccaccccaggcgcgtccccgcgggcgcgcgctccaggcggggccgacgggctcggaggcgcgcgcccgctgccgggtccgccgcgcgcgctccctccgctcctctcccccgcccctcccgggcccgcgcgctcccagggtccgccgcgcgcgcgcctcgcgtcgctccccatccccgcccctcccgccgccaccccgcccccggccgggtaccctcgccggacccgagagagagcgccgccgccatcttagttgctgccgctgccttcagcaagacgctgctctgaggcggggagggcgccgcgtcctgagcgcgcggcccagcgtcacggcggcggcggcggcggctcctccttggacccccggagctccccgcgccgcggagcagctggccccaggcccctagagccccgagagctccgagagctccgctcggcgtcccgcgcgcctccctgccgctcccgccccgggctggcgatgctgcgccgccccgctcccgcgctggccccggccgcccggctgctgctggccgggctgctgtgcggcggcggggtctgggccgcgcgagttaacaagcacaagccctggctggagcccacctaccacggcatagtcacagagaacgacaacaccgtgctcctcgaccccccactgatcgcgctggataaagatgcgcctctgcgatttgcagagagttttgaggtgacagtcaccaaagaaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaact

SEQ ID NO: 254322 - DNA, 5097 bp, Homo sapiens
gtctcctggaccccctttcgtgacccctctcaacacctctactggggagacgaggaccccgaggttctggggggcgacgcgacctgcccgaagtgacaagggtcctgggccgcactgctccgccggggtctgcgctcctcggcggagcgggtgggaaggatgagtcctcggggtggagaaggaggagcgggtccccgggtaccgctcacccggccttaggagcccgggagcgcgcgtagggacgcggagttgaggctctccatctgcggccagggaaagggatacagtcccccgggcccctcccggccgctcggaacccaccccaggcgcgtccccgcgggcgcgcgctccaggcggggccgacgggctcgcgcgcgcgcctcgcgtcgctccccatccccgcccctcccgccgccaccccgcccccggccgggtaccctcgccggacccgagagagagcgccgccgccatcttagttgctgccgctgccttcagcaagacgctgctctgaggcggggagggcgccgcgtcctgagcgcgcggcccagcgtcacggcggcggcggcggcggctcctccttggacccccggagctccccgcgccgcggagcagctggccccaggcccctagagccccgagagctccgagagctccgctcggcgtcccgcgcgcctccctgccgctcccgccccgggctggcgatgctgcgccgccccgctcccgcgctggccccggccgcccggctgctgctggccgggctgctgtgcggcggcggggtctgggccgcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaact

SEQ ID NO: 254323 - DNA, 528 bp, Homo sapiens
cagctctgccgtggcatcgcctgcccggtgccctcctctttcttaatggaggacattgttagtggggcgccaacctgcagatctggatattgacttttttgttttttgacggtgaacagctgagacgtttacaaggttttttgttttttgttttcttccctttctccttgaaactaagtggcttgacacagacaagtatcagacatgtgaggatgaatggatctggccattttttcgttatgaattattatactctatccctctctcgactttgggaggcatgtgtttcatcttataaatagaaagtagcatatttttgggcaggatctcctttatactgtgcagtctaggagaggtcagtttaaaaataaatatgcacttgaatgttacattactgagagccaggctgtggctgggacaagctgcgtggacagcagcatcaaagccgggagcgcagctgtgttgaaaggagtaaaagccccagagtgcagcccaggctgacagtcaagtaattacattttgtttaaa

SEQ ID NO: 254324 - DNA, 429 bp, Homo sapiens
accactgttttcaagaatttaatattcagtagcataaaatttgctttaaggcatacctaggattgcagttcagctctaaaagcttttgctgtactgtgttccagaaactttgttttgagaaagacgattggacatctgacagcttcattgatagctgacacaaattgctttctcattgccttgttatcatattcctggaagtgacttgtgtatgacatgagatcgaaaatagaaaataaaaaagattaaaccactttttaggtacaaaacaaatttttacaagcctttaagccgtcaaatcagaaaatgtttctttcaaaacgtgatgattctctcttactgtttatgaaatgttggaatatcatagtttacagatttttgtggaatgtatgatttgcttaaataaaaataatagctacaagagtaaaa

SEQ ID NO: 254325 - DNA, 524 bp, Homo sapiens
ggagttcaacaggaagctcagtggaggatgggggccacccatctgtcctttcaagacaggaaagacttatacaggttcatctgctgaaaagagtccactgagattcacaggttcaagatatgggagagatgaggtgagcgcacctacattatgcctgggacacaaaaatgaaatgaacatggctcctgcccacagggagtgtgcagtctatcatggcggtcgatacgcatccacataaaaaacagggacaaacagaagagcacaaatagagcactgtgagcattcagatgcatctgtgaaatgcgtggatgatggcaggtggaaattcgggagcagcaaaaacagagcccctatactctaaagctgtaaaggaccctggaaatcacgcagtcagtgctctcggctgacaggtatgaagggaataagtgactgcatagacacaggtgattaacgacagagctgggatcacacaactctaatatctccactcttaatctggtgatgcctcccctaaaccacactgc

SEQ ID NO: 254326 - DNA, 1340 bp, Homo sapiens
gattactcactatagggctcgagcggccgccggacaggtgccccgggagcttcccgctcgcgaagacccagacggctgcaggagcccgggcagcctcggggtcagcggcaccatgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtatctggccatccgctacccgctgcactcccgcgagctgcgcacgcctcgaaacgcgctggcagccatcgggctcatctgggggctgtcgctgctcttctccgggccctacctgagctactaccgccagtcgcagctggccaacctgaccgtgtgccatcccgcgtggagcgcccctcgccgccgcgccatggacatctgcaccttcgtcttcagctacctgcttcctgtgctggttctcggcctgacctacgcgcgcaccttgcgctacctctggcgcgccgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcccaaaggcaggcgacagcatcctgacggttgatgtggcctgaaagcacttagcgggcgcgctgggatgtcacagagttggagtcattgttgggggaccgtgggccg

SEQ ID NO: 254327 - DNA, 258 bp, Homo sapiens
tttaattctcaaaggatgaaatgacttgatatacgtaaaagcatttagaactgtgcctaacacatgataggcattactgggtttagtgatgatgctggtgctgatgatgccaatgatgcagatgatgcagcaaattacaaattaaataacaacatattaagccattatgtattcagtttttcttattcttaaatcttaaggcaaagctttgatcagaagaataattgaataattactgtattagatctacttttagaa

SEQ ID NO: 254328 - DNA, 464 bp, Homo sapiens
aaacatatcacctgatgatcgccattttcatttcaacgtcatccttcattaagttgtctacacaagttttattccgttctcttaacctgaagcttgcttttaaaaacaaaatccacgaacccatcgcacatgctaagcagttacactcctggatggccaggagcttgttcaggtgtttattcactcattcatggtttttggagcaattactgtgcccagtgctggggcaacaaaggcaagagacagttctcaccttcaagttgctcccaggctggctctgctacccaagagctacaaacagagatcttcctgaactcgccttttggcctcaggatgatgtggtatagaaaaaattcattagcaaacagtcacctagaaatttagagctgtaacatttgttaaggaacacacagaaaaagagcacacattgatgctttgaaacaaaataaaaactcattgcatta

SEQ ID NO: 254329 - DNA, 483 bp, Homo sapiens
tatgcagtgtttgtccatgagcatggaatgactcatactggcctcagagttagggactcactttaaaggaaaggggatgcagtagtgggcacatgactaagaaatccaccgatcctctcatatactgcaccaccagaagctgctggattagcagagcaaaggtcacagaacgttttcctgaatcggattctgggttaaagctgccagtaggaagaattcacatgagatttcaaaggtggaagagaaggagaaggtgtttttttcttgcaacagtttggctggggagctgagatcttcactgagggcttcctttggctccgggttcccgtggacaggcagccgatgtcatcagtggtggcttctctgtgatcactataccaccaggtctcctaaagtggccttcttgacctttgcctccccagctctttcaatggttatgtgaaactctaattatgtacattaaatatctttcagctcataaaa

SEQ ID NO: 254330 - DNA, 557 bp, Homo sapiens
ctaacctgaatattttcttttccctttttcccctatgtgactgagaagtattttgaggcaggttctgtgttggcaaatgcatatttgagagcttctatttaaaggcaatatgttttccttctacatggaaatgtaggagaaaggctataaattttatattacattgctcatagaactatataaagttttatataaagttatagttgtatgttattgaactggaggtctgttgcttcagagtgaaggggcttttatttttaaatgtttctgtatgtaaatacagtatttagtaaatagaattctaaaagggtgatctgcagtggtaactctagatatgtgctgttttatagagtagccactggccccgtattagctatttgagcacttgaaatgtggctggtccaaattgagatatgctgtaaaatacacactgaatttctaagacttagtataaaaaataatgaaaaatatttcataaataattttatttcatattgattacttgttgaaatactattttatatatgttgagtcaaataaagtatattattaaaatt

SEQ ID NO: 254331 - DNA, 378 bp, Homo sapiens
tgtgatgtatgtggaaatttagtccatgttcctatcccaattgaacctgtgggatagttcctatcccactagcctttcatttgtttacattaagcactagtaatattttgagaatgcactaagatgaaaattataagtgagaactgtcttgggactgactgattctaaggtcgggaaataaaattgaatcatcatttcattatgcattgattatgaatgtgtccttggtaaagtgtgtttgtgatgtctgtctacaattttacatatagaatcgtttaacttaagaaggaaattatgagctacttattcttgagacccagtgctttttttgcctcaatttatttcctaggcagataccaaagtcatcatgcttcattt

SEQ ID NO: 254332 - DNA, 555 bp, Homo sapiens
gggactgaagttgcgcagcagcacaactggctacttgttttttttgtttttttttttggtagagatgagggtctcactttgttgcccagtcttttaaaacttgttttaaatacactgttttaaaagttgtttaaaatcttttttcctgtgacatgttggaattttatgtatttttggagtgtggtaactgtaaagcgtttctactttggtttagtttttcataatctctgttatgtggtcactgtaacaaattccataaacttagcggcttaaaacaacagaaatgggctgggcacggtggctcacacctgtaatcccagcactttgggaggccaaggtgggcggatcacttgaggtcaagagttcgagaccatcctggccaacatggcgaaaccccatctctactaaaaatacaaaaattagcctgagtagcagggactgaagttgcgcagcagcacaactggctacttgttttgttggtttttttttgggtagagatgagggtctcactttgttgcccagtcttttaaaacttgttttaaatacactgtttta

SEQ ID NO: 254333 - DNA, 571 bp, Homo sapiens
gggactgaagttgcgcagcagcacaactggctacttgttttttttgtttttttttttggtagagatgagggtctcactttgttgcccagtcttttaaaacttgttttaaatacactgttttaaaagttgtttaaaatcttttttcctgtgacatgttggaattttatgtatttttggagtgtggtaactgtaaagcgtttctactttggtttagtttttcataatctctgttatgtggtcactgtaacaaattccataaacttagcggcttaaaacaacagaaatgggctgggcacggtggctcacacctgtaatcccagcactttgggaggccaaggtgggcggatcacttgaggtcaagagttcgagaccatcctggccaacatggcgaaaccccatctctactaaaaatacaaaaattagcctggcgtggcagcaggtgcctataatcccagctactcaggaggctgaggcaggagaaattgctggaatctgggaggtggaggttacagtgagctgagatcgcaccactgcctccagcctaggcaacatgtgagactctgtgtcaaaa

SEQ ID NO: 254334 - DNA, 248 bp, Homo sapiens
cttttgtctagaagttttacattttcaggtagtaactataatagttaaactgatagaagaagagaatacaatagtggttgctagggcctggagagtggggaaaatagagtgcttgttgttcaatgggtacaaagttttagttatgctagaatagtaaattctagagatctgctgtacaacatattgtttattgttaacaacatggtattttgtgtttcaaaatttcttaagagggcagatctattttg

SEQ ID NO: 254335 - DNA, 179 bp, Homo sapiens
accgggtcccggggcggtgggagccccggccgggcagaagggcttggcgggccgttagaggaccgccacggctgtcgagtcccctcccttgttggacttgcgcgccctggcgctcggaacctccggcgctgtgcccaccccgctctagctcgcgtctcccgactccaattaggtcaggc

SEQ ID NO: 254336 - DNA, 549 bp, Homo sapiens
catcattttatcaattctggtagtgtttgcatttgttcttggaaatgttgccaatggcttcatagctctaattaatgtcaatgactgggttaagacacaaaagatctcctcaactgaccaaattgtcactgctctggcattctccagaattggtttactttgatcatattattacattggtatgcaactgtgtttaattcagctttatatagtttagaagtaagaattgttccttctaatgtctcggcaataatcaatcatttcagcatttggcttgctacgagcctcagcatattttatttgttcaagattgccaatttctccaattttatttttctccacctaaagaagagaattaagagtgttcttcttgtgatactgttggggtccttggtatttttgatttgtaatcttgctgtggtaaccatggatgacagtgtgtggacaaaagaatttgaaggaaatgtgacttggaagatcgaattgaggaatgcaatacacctttcaaacatgactataaccaaccatgctagcaaacttcacactgtt

SEQ ID NO: 254337 - DNA, 335 bp, Homo sapiens
tctgtctcaaaaaggaaaaataaagggcaaaaaataatatgtataaacataaaaataatgaaataaagctttgccatgtcaagcgtcatcagagcagaagttttcagactaagacaaccagcagggattttcatgggcttctctgtcaagacccgccttggccagcccatgctgtcatccccgattgggtttgcagaagcaggcgtcctgggcgaccaggcctcctgggcaacatgtacatggcctcctatggcacctcttgcctcccatcttagacaattcgctgcctgatttctcactcccaggagattagatagctaggcttcagggaaagt

SEQ ID NO: 254338 - DNA, 488 bp, Homo sapiens
tcaaatgcaaatattgtgcatagaattgttttttaaatcgggagattttttaatgttttattctttctgttttgttaggatacttatagtcagaagagtagttagcataatgttctgctaaaggaacttcttgatctagatgtttaaaaattattgaacaaaaaagtgattttgaatatgcttggaatatttatactgaagtttgcacattttcattctaaacaaagtgttttgctattctcaaaacaaataattactctggttaactctatagtgtgataaaaagagaactctcctcgtgtacagtggtattgcatgttataatctgctgctcaggatgttaaaatattcaatatgatatttccatacagatattattcaccttaaaaaagaaagggaaggaagtttgagtaaattattttggttgttctttccactagaaaacctttttatttctaacaaacttctctccatcccttttcctgtca

SEQ ID NO: 254339 - DNA, 477 bp, Homo sapiens
gcgtgtatgatctctgagtggaaaacttctctgaaaataaatggattaccctttttactacactgtctgatgtctcttcagcagatagcattgcttccctgtgatctctaacccaccacaattgaaatgacaagcgttgaaatgggggcctcacggtggcgccctctgcctttgccggccctttctgcagcacggaacggttcacgccgcagagcaccggttctcaaacttgaataatgcctggacacccttgggaaggatagaatcatcttcagaaaccccacaacacgtcagtggagtccactttgagaaatgctgacctaaaaattagaatcttattctattaaaatggcttacatttgagaattatcactgcaaagaaaagttccgtctttagaactgctaaaaggttgagtttttacatctttactctgctattgaaacaaaactattaaaattatcttaaatatcctgaaa

SEQ ID NO: 254340 - DNA, 346 bp, Homo sapiens
  misc_feature (29)..(29): n is a, c, g, or t
  misc_feature (235)..(236): n is a, c, g, or t
  misc_feature (244)..(244): n is a, c, g, or t
  misc_feature (250)..(250): n is a, c, g, or t
  misc_feature (334)..(335): n is a, c, g, or t
agaagacgtgacacataacaactgaaggnaactcatggtccaagattttctttgcctataatgaatgttattaggacaattggaaaaatttgaataagaccatttagtataaatatcagcattagtttcctgattatgaggtttatattgtggttctgtaacagaatggccttgtttttaggaaatctacactgtattttgagataaagatataggtaggtaggtagatagagcnnatgtggtnaaaggntaacatctgaggaatctgagtgagggtacatgggaattctttgtagtattcttggaaactttctgtaaatctgaaattatttcnnaataaaaagtt

SEQ ID NO: 254341 - DNA, 468 bp, Homo sapiens
cgtggtgcctagtaggtgcacaagtgacccgtgccaaatgcacaaatgcttgtctgcctcctgttgatggacatctctgctttcttggctgcccctttgtcaagcactgacttttgattcgtctctgtgatgccttaacccccaccccagggtcgggcacgcagccaggccctcagtcactacctctagagtgacatgagtggggccaggtgcagtggttcatgcctgtaaacccagcactgtgggaggctgaggtcaggagtttgagaccagcctggccagcatggtgaaacctcgtctctgcgaaaaatacaaaaattagccgggcgtggtggtgggtgtgtgtagtcccatctactcaaggggctgaggcaggagagttgcttgagctggggaggcggaggctgcagtgagccaagattgcaccactgcactccagcctgggcaacagagcaagacactgcctca

SEQ ID NO: 254342 - DNA, 642 bp, Homo sapiens
  misc_feature (67)..(67): n is a, c, g, or t
  misc_feature (259)..(259): n is a, c, g, or t
aagaatgtcggggcagcgaaaattatggggggtggtatggagaggtaatgggcgatgtttctcaggnctgcttcaagcgggattaggggcggcgtgggagcctagagtgggagagattaagctgaagggaggtcttgtggtaaggggtgatatcatggggatgttagaagaaacatttgtcgtatagaatgattggtgatggcctggatacggttttggatgatttgagaagctaaatggaagatacaaggtccgaatnaaaggaggagaaaaatgggtattaaatgtctaagaattgggaggacctaggacatctgattagagagtgcctaaggagattcagcatagtcctgccagcaaagattatttacttcaagagttaagagtggcagtttggggatagcaccaggagatatcagctgtgatggcttggagaaacagtgtaaaccggcagtgtaaacaagagcagggcatgtatgagtagttgagaacggtgaataggagtatgactagacagaagatagtagggatgacaagtttttttggggcacagtctaagttggtctggtgtctggaatgagactggggcctaataaaaaggagcgtctatacaggagcttaaatgggatgtactttgtagca

SEQ ID NO: 254343 - DNA, 236 bp, Homo sapiens
tgtgtgtgtggtcaggcgggcaaattgaggccagagagcacgttaatgtgcattctggccagaatcaattcctggggaaagttggaaaaatctcctttcctttctaaattagtgtctaccaggaaaaaaagttgtatatcttaagatcatacttgtctcacagcaaactgatcctggtgttgagtcaaattgagcctgttgatcaggtgtgcatagtgctccagaggctgtcattt

SEQ ID NO: 254344 - DNA, 637 bp, Homo sapiens
ctaatgtcctagaggagatacctgcacatggagagaggatgggtacaatccttctgcaagggatcagacagtaaatattttaggctttctgggacatacagtctctgtggcaaccactcagttctgctgatgtagtgtgaaagccaccacagaccattcccatggttggattccaaaaaatgttatttacaaaagcagtagcaggctggatttgacccatggccttagtttgtctacccctgagctagaggaatgctagaggtcttttccaactccaaaatgctgttattctctgaatttaaaaaatcatctctttcaaatatatctaagttgaacatcccaagtccatgtgcagaaatagtacatttcactttgagtttattaacaaactctgttgaccaagtgagttctttgtttcatcttgactgtgcagtatttttaaaataatagcttctcagaaaacctatgcttatgccatgaaaatctttaaagacacctcagaggccctcttccctctaaagaaaagaaaagaaaagaaatgaaatgaaaagacaaatcacctgttattctaccaagcagagagagcagccatggtgaagactttgttgaatagtgagaatcaaaatctctgctgcgt

SEQ ID NO: 254345 - DNA, 379 bp, Homo sapiens
tgattttttaaattcagagaataacagcattttggagttggaaaagacctctagcattcctctagctcaggggtagacaaactaagtccatgtgcagaaatagtacatttcactttgagtttattaacaaactctgttgaccaagtgagttctttgtttcatcttgactgtgcagtatttttaaaataatagcttctcagaaaacctatgcttatgccatgaaaatctttaaagacacctcagaggccctcttccctctaaagaaaagaaaagaaaagaaatgaaatgaaaagacaaatcacctgttattctaccaagcagagagagcagccatggtgaagactttgttgaatagtgagaatcaaaatctctgctgcgt

SEQ ID NO: 254346 - DNA, 272 bp, Homo sapiens
ccattcattctaatagtgatttgtatttcctgtgtgttctcatgtttccaagcaggaaattcagtctgacaaaatatttgcaatatggtaagagagatatagcctatttttaaaggagataaaggtatcttcagaactcagtaatttattatgtactatttgttttcattattttcagttattttggtcaatcttatttctaatataaatgaaaataacccttaatttaggttttttatgttctgcattttaccctatatttaaaaattggt

SEQ ID NO: 254347 - DNA, 286 bp, Homo sapiens
agggtccgcctcaagtcttcagcagagtcaggtgtgatgagcacgtgcatgtgggcagggaaggaaccacccaggaggagcagagggaaccatctcgaagcccacgtaggcctgagagtagctcactttcccaccatccagagagagcagtctgtttctaaggaacttaactgtgtccccggacgaagctcatttttacaatgaaattctgaatcatgttgttctttattacacatccttgattgtgcaataaagattgattcttgattgatacccaccaataaaa

SEQ ID NO: 254348 - DNA, 509 bp, Homo sapiens
gccaggcggcgagaacgcgctgggggaacccttggtccgctctgcgcgtcgctctaggatccccgaaaaggagcacgggcgcgaaagcggccaggctgggccaggatctagaaagactgcctggcgcaggctccctgcccccgcgggcctgctgtcatggactcgtggagagctcgcttcccgcgcggacccttcctgcaggggtccacgtccaggcaccggcggctcggacaccccacccccggccgggcacctgccctgggtgccccttaacccgggcggtagctcgttaagatggcgaagtgtccggtccggaacacgcgaaaccccaaatcccgcctgcccgacctcctgacccccggccccacgggacgacagactgggcctcccgacgcgcagcgcgctgccgggacaccggtgcgtgcgaaacggaggacctttgtaacgccacgtgtttgctctttttgaaaaaacaagaataaatgtgttaaactgtctgaaaagcttgc

SEQ ID NO: 254349 - DNA, 432 bp, Homo sapiens
cagatattcttaaagcatatgaagatgacgtcctcttaattgatgtaattcaagatgacccagacctctttggagtctccaatgaaggggagctctcatttacttctgaggtcccaaagataagccaggagcccaatgttgctggagagcaccaatcaacagactccaagtacatggaaactccagtaaaaaaagaaccaagtgatgacttaagagaacttcctgtactggactgtggatggataaagccagacatctgtgcttccaactcagcagaaagtgaaataaaacgtgatcccaaagatgtaaacacttccttaggagaagttgctaatgagacctctgaaaatgaaacactgggagacttcagtgaacaaataaaaggttcagacttggatgaaaagcatagatttacagacaaagtgattacca

SEQ ID NO: 254350 - DNA, 343 bp, Homo sapiens
cacacacagaatagaaaaatgaatttatttaccttggattagtaagaccattttgttggaaacccatagtgcaaaattggctttcctttgcctcagttgtactgttgccatatttgacctggcccaggtgaaagtacctactttcatttacccttctatgtcagtgattctccaatgagcaattcatggccaatcttgtttcatctatacccgtgccctcttccccactccatatttgtgtatatttctgacatatcatttcatcctgtaaatgtttcagtacgttatctctaaatgataaggattcttctttaaaaccaaatcacagtattgtcacaccaaa

SEQ ID NO: 254351 - DNA, 308 bp, Homo sapiens
tcctttacgctacacatttatgtcatatcttaggaacaaagaatggaatatgaggtttcaggagcctggattccagggtgatgactgatcaagggccctcccattgggaagagattagcaggtcagggcaatatggcacctaagaagagtcttcatgtaaagtgtggtggaatggcagggagaatctgtgctcacgtttggtatgaacaagtatacgaaagtagcagcatctgaaaggaaaggggttgaatggatttatatgaacattacctggaaattgccagagattcttaaaggtaatctagtaa

SEQ ID NO: 254352 - DNA, 455 bp, Homo sapiens
gaaacaaactgctgtctggaaagctttttggacgcataaacaaactgagatggttgtgctctgaggaacataaagcagtctgaagtaaacagtcgcacacagacgcaacaactacagtatcttcaggatgcaaagccatacaggcgctgtcagttcccttctactggggggcaagaaaacctccctttgagctgtggtgacagggttacatgggagggtttggttgctcttcagttcagaagccatcactgccagcacctgcaacttgctgctctgcaccttctgctctgaccactggtgagagaagtcactccttccttctcttgctcttaagatccctcttaagtcctgcagggtaacacctgcttggctgccacagaggtgtctgggtctcctggtgcctttatggatactcaccactcatgcagggtcttcagggagaagatgaagaaatc

SEQ ID NO: 254353 - DNA, 1455 bp, Homo sapiens
ttgaactatggcacaaggataaaatgagtaaagatttacttctgggaattgcgagaatccagctttctaacatcttgtcttcagaaaaaactcgttttttaggttctaatggtgaacagtgttggcgtcaaacttacagtgaaagtgtgcctgttatagcagcacaaggatcaaataacaggatagcagatctttcttacacagtgactctagaagattatggactagtaaaaatgcgtgagatttttatctctgattcatctcagggtgtatctgccgtacagcaaaagccgtcttctcttcctccagcaccttgtccttcagagatccagacagagcctcgtgaaacgttagaatacaaagcagcacttgagctagaaatgtggaaggagatgcaagaagatatatttgaaaatcagctgaagcagaaagaactggctcatatgcaggctcttgcagaggaatggaagaaaagggaccgagaaagagaatcactagtaaagaaaaaggtggctgaatatactattctagaaggaaaacttcaaaaaactctaattgacttggagaagcgagagcagcagcttgctagtgtggaatcagagcttcaaagagaaaaaaaggaactgcaatcagaacgtcagcggaacctgcaagaactgcaggactctatccgtagggccaaagaggactgtattcaccaagtagaactagaaaggttaaaaatcaaacagctcgaagaggataaacaccgccttcagcaacagcttaatgatgctgaaaataagtataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaccctcaaaagtgaggaaaatggatgtttta

SEQ ID NO: 254354 - DNA, 724 bp, Homo sapiens
catacattatccccatccacatcatagccttaacttcacgacgctagaaatatttataagattttggaaaaagagttccaacagttcaaggaccagcaaaacaacaaaccagaaatccgtctacagtctgaaataaatcttctcaccttggaaaaggttgaacttgaaagaaagttggaatctgcaactaagtctaaactgcattacaagcagcagtggggacgagctttgaaagaacttgccagacttaaacagagggagcaagaaagtcaaatggctcgtcttaaaaaacagcaggaagaattggaacagatgagactacgttaccttgccgctgaggaaaaagatacagtaaaaaccgagcgacaagaattgttggatataagaaatgaattgaacaggttaaggcaacaagagcaaaaacaataccaggattccacagagattgcaagtggaaaaaaggatggcccccatggcagtgtattggaagaaggtttggatgattatttgactcgcctgatagaagaaagggatactttgatgagaacgggtgtgtataatcacgaggatcgaataataagtgaactcgaccgacagatcagagagattttggcaaaaagcaatgccagtaattaataacatttggaaaagctttatagagactctaagtctaaattttaatttctttgtaaaaccctcaaaagtgaggaaaatggatgtttta

SEQ ID NO: 254355 - DNA, 555 bp, Homo sapiens
gaataaaaaagaatgcctgaaaaaatcatattagtgatcagcatcggttatttaactgacaactgattcatttatttgacatatttggggttttttggcgactttatttttcttccttttgtagctgaagcagaaagaactggctcatatgcaggctcttgcagaggaatggaagaaaagggaccgagaaagagaatcactagtaaagaaaaaggtaataacttgtgtaaaagtgaggaagagaaggaagaatattaatgataatatcttgtatttgcgttaaagacagtctctggaaggaataactaattttagtggtgatatgttggcatggaagaagtgagtggtggctctggatagagaagggaggcgtttcactgtaaagtattttgtgcttttggaatatgcaaatgtattacctattcaaaaaatatataatataggccaggtatggttgctcacacctgtaatcccagcactgagggaggattgcttgaggccaggaggttgagaccagcctggacaacatagtgagacccccatctcttaaaaaaa

SEQ ID NO: 254356 - DNA, 415 bp, Homo sapiens
aaaattgaaaacacaaagtaattttgagattcatgacagccttagggttcatattacttgactgtgataaatttagaagattatacatagtttggctggttgttcctgcatgctgacggtatttcttccgtctttaacccttgcaaagaagatttaaattttgctatttttgaacttgtttaccaacttggtcattcttgatacttgttattgcccaaattttacttgtaattccttttagaagcataaatagtggatttcaatcatgtcaatatttctgcagtatttagaatggcatgaattagaaaacatgaatttttcaaagaaatcataactttttcttgagtccagccatttgctatcatcaataagattagttaggatactggatttcatcagtgattccattatctga

SEQ ID NO: 254357 - DNA, 365 bp, Homo sapiens
cccttctgtcccatctttaaatgttgaagtgtcccagggctcagtcctagagccccctttcttatttatttattttaatttttttgagatggagtctggctctgtcacccaggctggagtgcaatggtgcgatctcagccactgcactctggcctggtgacacagcgagactccatctcaaaaaaaaaaaaaaaaaaaaaaagattaccagaggataagttagatagctggtagagagatcacgaaagctatgtttgatctctggagcaaaaactgtgttgaagttctcccatggaatggttcccatacaagattcaccatattaatgccttttctaagaaaaggggacatggagaattattgga

SEQ ID NO: 254358 - DNA, 479 bp, Homo sapiens
gtaaacagccctgggacaaagaacagactacgggtattgccttcttaatcaacaataaagtattagttggcttccaggcagacaccactgactttcaagagaaaggcacgggagtaaggaagtaaagaattcagggcaaacgtcgagctttcctctgggctccaatgtaaaagaagtggatagcggctgactagtgtacatattatgtatgcagactttgaaggaatcccccttgtttttagctgttcttccattgctcctggagactctgagctcagagattttctaggctctgatgggcagagtggctcgtttcctccctgaagtttccttcatgccacattctggattacaacctcctccaaagagtgtcatctgtcaatataatgtcatctcttgatttctctgttttcttttcttcactataataggtaattctatgttttagcagagctaaatacatcgccttcatcttcaat

SEQ ID NO: 254359 - DNA, 386 bp, Homo sapiens
  misc_feature (6)..(6): n is a, c, g, or t
  misc_feature (49)..(49): n is a, c, g, or t
gaccanccaccaattaccattacccttccaccaaggacctgggatttangataaaccttccctaaccttccacttaaccaggtttgaaaaaatgacctgcattatatagcaaacctaatttttttgcccttgtcattctgaggtcatgaaataacttggaatcgtaagtaggattctatgtacaaatagcagaagaaaggttcaattgttttcctgtagttttctttcattagtatattgaatgggctgtgaaatctggaatatttcacaaatagaaggtgatatagatacagagagataccttcctgggcatttgtaataacatgtagaatcgaaaatgtgaaactactaatctaagttattaaaacttatctttttcactaaaa

SEQ ID NO: 254360 - DNA, 476 bp, Homo sapiens
atatgctggattacatttattgatttgcgtatattgaaccagccttgcatcccagggatgaagcccacttgatcatggtggataagctttttgatgtgctgctggattcggtttgccagtattttattgaggatctttgcatcaatgttcatcaaggatattggtctaaaatgctctgttttggttgtgtctctgcctggctttggtatcaggatgatgctggcctcataaaatgagttagggaggattccctctttttctattgattggaatcatttcagaaggaatggtaccagttcctccttgtacctctggtagaattcggctgtgaatccatctggtcctggactctttttggcaacctaccttttaaaatattcctcatagtcagtggttaaactctgtatgctttgttgagggaggcattacattgttcttttttttttttttgaatgagtacacagtatatgcaggaa

SEQ ID NO: 254361 - DNA, 413 bp, Homo sapiens
caagaccattaaccttctctttaaaataattaacagctatgttcaagtatcttcttcacactagaagctatactaagtgcttggcatactttacttagcaccaccctatgagggagacactcttatccccacttcacaggtacagaaactaaagtatagagatcaccactacttaaaatcaaacccaaagcacccacgttcagagttagtgctcttctatactatggatacatcatctcatttttaatttccgtgtttttatgatatggtttctacttctgccactcatttcccatttatgacattttagtttggggtgcctgctgtgccatctaagaaagtatcttaaaggtctttttttatgacatcctggaagaatttcctaagtcaggacatttaatatttaactaagt

SEQ ID NO: 254362 - DNA, 727 bp, Homo sapiens
aaattagtatccactaattagaagagttgtatctattaatataaaattgaaatgggccaggtgcagtcccagcactttgggaggccaaggtgggaggatcacttgaggccaggagttggaggccagcctgggcaacatagtaagaccctgtgtcgacaggaaaatgtttaaaaattagccaggcatggcagtgctcatgtgtagtcccagctactcaggaggctgaggcaggagaaccgcttgagcccaagagttggaggctgcaatgagctatgatcacaccactgcattctagcctgggtgacagagtgaaaccctctcaaaaataatgaaactggtatcaacagtttcatatccagcaccagacattatgtgacagtggaagagagactttcaaagttctgagagaaaatgaatttgagcgtagagttctttgccatgccaagctgtcaaccacagataagacaaaagaaagacattagccagggcatggtggctcatgcctatatcccaacactttgggaggccaaggtgggcggatcacctgaggtctggagttcgagaccagcctggccaacatggggaaaccctgtctctactaaaaatacaaaaaatcagccaggcgaggtggcacacgcctctaatcccagctactccggaggctgaggcaggagaatcacttgtacccgcgaggcggaggttgcagtgagctgagcttacgccactg

SEQ ID NO: 254363 - DNA, 230 bp, Homo sapiens
tagattttcatagaagcccaaatcctattgtgaactgtgtatgcaaggtatctaggttgcacactccttaagagaatctaactcatgcttaatgatctgaggtgggaccatttcattctgaaaccatgccccctccccacccttggtccatgaaaaaattgccttccacagaattggtccctgatgccataaaggttggggactgctgatctaaagggagaggtagactc

SEQ ID NO: 254364 - DNA, 430 bp, Homo sapiens
tcttctgtggttatcgcgctttgcctgccgctgagtctctctgaggtgatgctcctcctgtcgttggcttggccctccaacccagactgcatactgtggcctctcaaagcaatgtcgcctgatactcaggccagaaagagaagggaggagagtggggaggagaggggtggaggcgatagcagaacttccttccagagtctctatattcttctgtgttgtttgaacacaacaaccatatactatctctgtgatttaaattcaaatttcaatgagaattaaaagttgaagctcaggccacactgctgtgcgttttttagagagatatgtttgactgaaagcatatcaaggggcaggaagaattttttgctgggcagtataaccagggcagagaaaggtttttatttcttaaaaatattttctatatcataaa

SEQ ID NO: 254365 - DNA, 230 bp, Homo sapiens
ttttaattttttcttaaatatgtcatttcaagctgcattggaaatgtatatttacagacatttactgaataattggtttattaatatgacctatatggtcattagtttaggagagaaaaataatgaatcagtcatgttcaaaacagtaatatagacttcaatggcataaaacattcaagataagcacactgttttctttgttcttactaaaccaattgatgattttaaag

SEQ ID NO: 254366 - DNA, 156 bp, Homo sapiens
caagtctttatttacatagggtgtaactctgtatacccaatgggaaacctctagagggtacataaaccctagaagatttgcaaccagtgctcttgagccacttgctcaagtatgctcccactatgtactttgatttcagtaaatcattgcttcatt

SEQ ID NO: 254367 - DNA, 358 bp, Homo sapiens
gctatcaaagtttgtttttaagatttgttaggtcaggtccagagttgtctgtagtcttgggctaattgatttccactatgaatgagatattattttgagaagtttatctaatactccatattttcctatttctttccaatcaggccagtgagaatatgaactattcccatcatgatatcagcctctggaattgttctgcaagctcttttccattggttctttgcccagcctaaggtagtttctctcacatatttgcatctcagcataaagccaaaaactagaaagtgtccctgtgtagaatttagagctgtctttctgtgtatcttcctcctctccagtagtctctcctgaaaagcta

SEQ ID NO: 254368 - DNA, 1192 bp, Homo sapiens
aggcaggatacttgtgtctcagatgcggtcgcttctttcatacagcaattgccgccttgctgaggatcaaggaacctcagtgtcagatcacgccctccccccaaacttagaaattcagatggggcgcagaaatttctcttgttctgcgtgatctgcatagatggtccaagaggtggtttttccaggagcccagcacccctcctccctccgactcagacccaggagtctggccctccattgaaaggaccccaggttacatcatccattcaggctgcccttgccacgatggaattctgtagctcctgccaaatgggtcaaatatcatggttcaggcgcagggagggtgattgggcgggcctgtctgggtataaattctggagcttctgcatctatcccaaaaaacaagggtgttctgtcagctgaggatccagccgaaagaggagccaggcactcaggccacctgagtctactcacctggacaactggaatctggcaccaattctaaaccactcagcttctccgagctcacaccccggagatcacctgaggacccgagccattgatggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagccccagctacgcttcctga

SEQ ID NO: 254369 - DNA, 863 bp, Homo sapiens
catagatcctgaaagcatcttcatttgcttcagtggacccaaaattctctagtctacgcttctcttcagttgtccctttcttttttagaagggatttcttatggtttaggcaaattgatagcagtgttgcttgaattctccttggtattcttacttaataaaggtaacattgctttgaccttgatttaagtgttacttcatagattattttcacctattttctgttcccttgattttacactcccctagtaatagtttataattaaatagtactgaaccttaaaacaggcatagtcccgaaatgcttcacatatattaactcatttaatcctcacaaacagtttatgctagtattgtagtagtattcccagcatagagttaaggaaactaatgcccagagaggttaaatgatttacccaaggtcacacagctaataagaggtggagtcaaggtccaaacccaggcagtctggcttcagaagacttattcttaactgctgcattatacagcctggttagaggcagcacttcttattgacagtttgctttctgcttggcagtggatgtaaagaaagttttggagaaagcctgactgggtagtgaggacattattaatatgttctttgaactagccacatgtcatctgagcctcagtatcagcacatgtgatttgggatgttaaccactttttacggttgttagaattaaaaggtacaccaggcaagacacaggtggtttacccctgtaatcccaatgcatttggaggctaaggtggaaggatttcttgaggccaagagtttgagaccagccaggtcaacatagcaagaccctatctctgccaaaaaaaaaaacaaaacaaattca

SEQ ID NO: 254370 - DNA, 1917 bp, Homo sapiens
ttccagtggtacaagatgtggaggtggaagacagtgatattgtgtccggaatttattccttcttgtgggttctcggtctcactaacttcaagaatgaagccgcagaccgtcgcggtgtgttacagttcttaaagatggtgtgtccagagtttgttccttcagatgttcagatgtgtcgagtttcttccttccggtgggttcgtggtctccctgacttcagaagtgaagccacataccttcgcaatgctggccaagaagagctgaaatagaaaacagcctagaacctaacactatttactgtaaaatttttgcaccaggatggaaggggattcttaccacaatgcaaccaccgtcaatggcaccccagtaaatcaccagcctttggaacgccacaggttgtgggaagtcatcaccattgcagctgtgactgctgtggtaagcctgatcaccattgtgggcaatgtcttggtcatgatctccttcaaagtcaacagccagctcaagacagttaacaactattacctgctcagcttagcctgtgcagatctcatcattggaatcttctccatgaacctctacaccacctacatcctcatgggacgctgggctctcgggagtctggcttgtgacctttggcttgcactggactacgtggccagcaacgcttctgtcatgaaccttctggtgatcagttttgaccgttacttttccatcacaagacccttgacatatcgggccaagcgtactccgaaaagggctggcatcatgattggcttggcctggctgatctccttcatcctctgggccccagcaatcctctgctggcagtacttggttgggaagcggacagttccactggatgagtgccagatccagtttctctctgagcccaccatcacttttggcactgccattgctgccttctacatccctgtttctgtcatgaccatcctctactgtcgaatctaccgggaaacagagaagcgaaccaaggacctggctgacctccagggttctgactctgtgaccaaagctgagaagagaaagccagctcatagggctctgttcagatcctgcttgcgctgtcctcgacccaccctggcccagcgggaaaggaaccaggcctcctggtcatcctcccgcaggagcacctccaccactgggaagccatcccaagccactggcccaagcgccaattgggccaaagctgagcagctcaccacctgtagcagctacccttcctcagaggatgaggacaagcccgccactgaccctgtcctccaagtggtctacaagagtcagggtaaggaaagcccaggggaagaattcagtgctgaagagactgaggaaacttttgtgaaagctgaaactgaaaaaagtgactatgacaccccaaactaccttctgtctccagcagctgctcatagacccaagagtcagaaatgtgtggcctataagttccgattggtggtaaaagctgacgggaaccaggagaccaacaatggctgtcacaaggtgaaaatcatgccctgccccttcccagtggccaaggaaccttcaacgaaaggcctcaatcccaaccccagccatcaaatgaccaaacgaaagagagtggtcctagtcaaagagaggaaagcagcccagacactgagtgccattctcctggccttcatcatcacatggaccccgtataacatcatggtcctggtttctaccttctgtgacaagtgtgtcccagtcaccctgtggcacttgggctattggttgtgctatgtcaatagcactgtcaaccccatctgctatgccctctgcaacagaaccttcaggaagacctttaagatgctgcttctctgccgatggaaaaagaaaaaagtggaagagaagttgtactggcaggggaacagcaagctaccctga

SEQ ID NO: 254371 - DNA, 564 bp, Homo sapiens
aggtacatcttccctttccttcaacagtccaaaccctccagaactctctcgaggcagtgattaatactaaacaaaggacttgaaggataggagggattctgaacagggtagaaataaatagtagtgtgggatattcgtatagttttcttggaagaggtaatatttgagtaggatcttgaaaaatgagtagacgtgtaaatgccgcaagtaaaggcaaagatatatacatcattgtcggaataggaaagagtgtggcacatctgggaatgatgaggggccttatgcagctgggggagtctattggtcagacatgaggctggaaatggtgcaagggctagatagggaagggcttcatatgcgatgccaagaggcacagactatgctgtgattccctggcagtatagctggtgggacaaagagaaatcaaactcaaaaagttcccctcttgtctaccatgtgtatactcaagtaggtgatgagattgtaggaagaaggtaggatataatagcagataattgggtagccatatagaaaaatcaaataaaatttgacctttaccttata

SEQ ID NO: 254372 - DNA, 185 bp, Homo sapiens
ccatctgtgtatcttctttgatgagatgtctgtccagatcttttgcctttttaatttttttgagacagtctctgtcacccaggctgaagtgcagtgcccacagagagaactgccacaggggcagagtcacacagagagggtaatgcatagtggagccacctcacagttccacttgggtcatgccc

SEQ ID NO: 254373 - DNA, 816 bp, Homo sapiens
tacaacagctttatgtggggtgaatcagatgcctgtattacagaagcatctaatgcaaagcaaaataaaaacacttgcatgagcgcacagaggtaggtgtggaagaaagtgaaacactattttaggttttagttacactctgctgtggtgtgctgcctagtatttgcaggttaatgcaaatactaggggttatgaattgtttctaagtctattattaaaaatagccttgcttcatttcttcctaaaatggagacaaatatgtatagtgtctgtgttaccagtatgtgtaagagtaatatcttaatgcgtgtaaaatgttcataggaacctgtatttcaaagagctatttttgcaagtgacactatccttttaagaaacttttttattcaaacttttttctccatttataactattctattatttcttaatgttcagaacccttttcattatctacaaggttaaattttaggtaagtaatgagaaaataataatatgtggagaagaaatgagtgaggagtcgagatgtgtgtcaatcaagaatgagtttgtcagcccttgtattatgattttactcgggaggggataattattgaaggatgtaatgtaagggcagtgatactatatggtatgtaagactgttaaaatcactgaggtaagctattacttgaactaagcatagaaatagagacagatttttaatgcatttaattatcaaaatatctaaattaaagatttgatgtggctgttcactggaaacaaatggcagacaaacagaatatttcttggaatcataaatgacatcatcctgtctccaa

SEQ ID NO: 254374 - DNA, 426 bp, Homo sapiens
cagcactgatacctaagcttttccaggggtttaatctgagtgggagtatggagagtggcttcactgtggagcaaaatgaggtagccgtcaggagagggaagcgagggcacacaacctttgtgctgtcattgttaggtttactgaggtgtaatttacagactgtaaaatccacccttattagtatattttctaagttttggcagaagagtacagtcatacagctaccaccacaatccccctataagtgtccccatgccaccctttgtagtcaacccacacccctactccttgcctctggtaaccattgatctgtttctgactgataattttgccttttccagatgtcatttaaatggaaccatagctttttaagcctggcttcctttactcagcattatatatttgagattcatccattttgttctc

SEQ ID NO: 254375 - DNA, 662 bp, Homo sapiens
catattgctcagaaaaatagattcctttcaaaacattactgctcaccgataatgcacctagtcacccaagaactctgatggaaatgtacaaggagatgaaggttgttttcatgctggctaacaaaatatccactctggcagtgcatggatcaagaaataattttgactttcaagtcttatagctgccatagacagtgattcctctgatggatctgggcaaagtaaactgaaagctttctgaaaaggattcaccattctagatagcattaagaacatttgtgattcatttgaggaggtcaaaatatcaatattaataggagtttggaagaagttgattccaaccctcatggatgactttgaggagttcaagactccagtgggggaagtcactgcaaatgtggtagaaacagcaagataattagaagtggagccagaagatgtgactgaattgctacaatctcacaataaagttgcttcttaaggatgggtagagaaagtggtttcttgacgtggaatctactccttgtaaagatgctgaaatgacaacaaaggacttagacttaattgataaagcagtagcagaattccataaacttaactgataaatcagtagcagaatttgagaggactgacttcaattttgaaagaagttctgtgggaaa

SEQ ID NO: 254376 - DNA, 375 bp, Homo sapiens
tgcatctaggagacccgcagaactctggttgggtcctgtccccctagccagtttggtctgatatgctctgaaccctcttcttgtcctgctggatcagcactgacaacaagtcttcttctgcagctcctgccactgttaatttggacccgtcacttccttgcagtagagctgataggccaactgcagaaccgtagtctgcctccaactgttcactctagagtatacagatgtctccctgtgtttcttctactttagatatttcggccatttgctatcacacatattcatgcgaatgcaggaatttcacgaggtacaattctcttccaatgtaaacctgttctgtgaatgccttctgcaataaaatccctctacaaa

SEQ ID NO: 254377 - DNA, 543 bp, Homo sapiens
aaatgccaggttgagctatctcctctcctctatcaccctagccccaggtgggaacaggaggcgagactccctggggacagaggcaggcggggagaggacgtccctgccttttcccccgagccactgtggctttccctcagtgcccaagcaggggataccactgggaggtccccatccccttcccttccctccccaagacgcctttacggaaaccagtggaagtttcatctcagaatgaatgggctgcactatcaccacctctgcccgagcctcctctgttccacaaaaggccaagttcacactctctccctctatgccaatgaagtgtccccctcctcagtacgtgtatccctttcctaggcctgccagaacaaagtgtcatagaccagatggcttaaaacacataagttgacttttgttatatatttttatatagagatgaggtctcactattttgcccaggctagtctcaaactcctgggttcatgtgatcctcctgcctgggcctcccaaagtgctgggattacaggcatgagccaccat

SEQ ID NO: 254378 - DNA, 228 bp, Homo sapiens
ttagagagaagggtactgtgcttttacaacaggtaaatgattgccacacaaagggtgcacttttgttgtgaggctgctgcccttggttgcagcctacagacagtgaagtttctcttcgatgcctgattagaatggagagcgcactgcctttttaggtccttctgcctttccatccaaactatccatcgttaacaaggccctatggcagtgcagcagcgctcgtcgacg

SEQ ID NO: 254379 - DNA, 690 bp, Homo sapiens
tctgtttataagcctgattttaggagagatgaataatacttgtctttcactcacagaaacagattttcagcatatataatattttaagggttagaatttggcctatgatgtgtctgcatgaaacaaatcattgtaagagaatttgattgtaccatataatgtaaaattagaacaaaggagtcacattgtccatgtatacattatgtgcagagcattcaagtgcatttatctataattcaacaagcccaaaatcatgaaaatattacacttgatattcgcaacattgattataaaatctgaacaagcagcaaagggcacttcaaagtcttgaaatgtcaatatttgtaggccatgcaaatatgtttaaaatatattctgtttggggagctacccagaagccaaacaaaagtacaccagaatcctattatagtacagtactaacacacaagagaagcaagcatcaatctatcttataaaaatgttattccagtcactacataccctacattgcgcatgatgaatttctattatagtaatgttattactagatattataactatatattattctgcatattttaatattaattgttatgatttgaattttaggatgggcataaatatcccattgtctcagcttccctttctaggcactgcaggttaaagagtaaatccatgtcttggcctcct

SEQ ID NO: 254380 - DNA, 316 bp, Homo sapiens
acttctcccaacgtttgcttccacttgaattgttcaaccctcctgctagttctcactcagtagaattcagaaggtttctgtgattgttacctctaatccttggagttcttaaatttttcaacagccttcacctgtactcttcacactggtaacctcagggcagagcccccggtcgaacctgccttaaaggaggttctcagcatatgtgtccaccttgaaggaacctaggaacatccctgtaccaaggagttcatgagttacttttagggtagatgatgggggtctctttcacacccctaccatgaaggataggcca

SEQ ID NO: 254381 - DNA, 912 bp, Homo sapiens
tagtatacaaaaagtagcatgtattgtgtccagttaaggatatttattgaaacttttaagttcattgtatttatagatactgtgctacaatttaaaagacatttcttactgaatttttgtcaaaatccattgacctagataggaatctgtattggagtaaagatggttctaaggggaaggagtgtagagaagcaatgtgggagccacatgcggtggttcatgcctatattctcagtactttgggaggcggaggtgggaggatagcttgaggccaggaattccagaagcaatgtggaaaggacactagggaatgtaggttctagtctttatccaagctctttgacttcaagcaaatcacatttttctcctggaccttacattcttttttctcattgcccttagtaccttctgtctgacttcaaccccacatctgcttgacaagaattaactcaaatatctcttcttaacacctacctgattctggcatacagtaagtgcttataaatatatgttaaatgggtgagaacctttcccttaggtctgtgggtactttcactgggcttgtatatctaccactccatttaaaactctacttacagctttttaagaaaatgtatttctaagccaggcacagtggctcatgcctacatttccagcagtttgggaggctgaggtgggtggattttgtgcttggaaattcgagaccagtctaggcaacgtggcaaaaccccatctctacaaaaaatacaaaaattagcagggtcatagtagtgcgtgcctatagtcccaactacttgggaggctgaagtgagaggattgcctaagcctgggaggtgaagactgcagtgagctgtgggtgtcccactgcacttcagccttggcaacaaagtgagaccctgtctcaaaaaaaaa

SEQ ID NO: 254382 - DNA, 419 bp, Homo sapiens
catgcccgactaattatttttatttgttgtttgaaacggagtctcgctatgttgcctaggctggtctcgaactcctgggttcaagtgatcctcctgccttggcctctcaaagtgcagggattacaggccttagccactgtgcctggtggactaactgaattttttttttcttcatgtcagacgcgcaatgtgccgacgtcgtaacaaggttcgagggtggcgcatctcacacgggaacacccaatcatcacgcttataaagtacaaaaagtcaactaactgaattcttacaaggcatgggtgattagtaaagagggaaaaataattagacctactatgtgcagagcactctggtggaaattggaaaatcagatatttacttcagagcaattaaaactacaaacataaacactcattaac

SEQ ID NO: 254383 - DNA, 4945 bp, Homo sapiens
  misc_feature (90)..(90): n is a, c, g, or t
  misc_feature (94)..(94): n is a, c, g, or t
tcactgttctggagagaaacaaatgcatactcacagcataaggcagtcctcgacacccatgcctctgagtggtcccataattatgagtgnaatncattcttatacattgtgactttcttgaaatgtttatatgcagcatgacgaagttgccccttttgcacttccctgactccagcggacgtctagccctgcatcattgttcttgtttttatgtcccagttgaccttggcattttgttttatcactttcctggttgaagccaaaaaacaaagggtactactttcttctttctttccatatgtaccatactttaggggagagaggggccagtgtttggacactgttgatttaaaaaatcttattttcaggatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaattt

SEQ ID NO: 254384 - DNA, 2860 bp, Homo sapiens
  misc_feature (1)..(3): n is a, c, g, or t
nnntaacagattaccataactccttaaataaataatagattaccataactccaaatggagagaaagtatggtttttttctctcttacggaaagttcatggtctttatgaaaaatccaaccagaagccttttcacacaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggtaatcgcccctggtcaaatgatgatgctatggcatcaatcctccaaaggaagaggaacccgggttgccgcatggtttaagtaggggagctatagtaacacttagtgccctttatatcaatgtgggtttattgtgttcatacatttctttctgttttacaaagtcaaaaacatcctttgctggttttgcaccagagaataggggttagttatcatctgtgtttaccatgtggcctcacatgagttaacagtttaaagcactagagattgttatagagagttttaagctaccagaataaaacagattgattttttctcagagcttgagtacagctgaatattgcctctatcttaaaggaagtagacaatccagaagaaaaaccagaagaagagaaagaagaggttatagatgaccaggagaacctagctcatagcaggagggtgagtactgtctgacattactttgctccttctcattcctgctacctccatcatgtgaacctcttctgttctcttgactttgtatcatctcattgatttgacctgaaggttataatttgggctttttccgtaataaagattttattataatttttttatttatttttctctatacacacagtagttttgtagtgattattatctagtgatggtttgaagaggttgttttttttttttttttttactaacaatctggtttccactgcacccatcctgtttttctttcatattaaagtttcaaaataactgaccctttttgaaaagtttatgtttgaccttgcctttatttacaactattccccacatttaaaatgaaatattttatttttaatcttctgttttccaagttatatgtgtcatcttactggtagttaaatgaatttctgtaaatttccattaaaaatacttttataaaagctatccactcgtcctcatttgaagcttccttctacaccagtactatctctttctagaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaaggtaagtcacaaatgcatcctttataagtccagtctggcaagggctgtcttagtgaaatgagaggacctataatccccagaagaaactaatctcaatattactagattgaaagttctaaaatgctttgacacaaaaggctggagtcatcctgctacctgtttccttatttttagtcagcttaaatcactgatagctgaaattattcctctcttagtgggcgtggagagggtgaaggaagatatccttgtgttctagttgctcaattcattcttactgcagctgctgcatctcctcctgtcctagtttctagatgacgtttgtctttatgaactacactgctacctcttgatttataaactaatgatctcttttttaccttagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcaggtacgtatctaaaacctttctgattatatgaccaatgattgtttcaggtctgc

SEQ ID NO: 254385 - DNA, 858 bp, Homo sapiens
  misc_feature (11)..(11): n is a, c, g, or t
gtgtcactctnaggatccccacactgggtcgagtcccccaaaaccaaaaaggtaagtcacaaatgcatcctttataagtccagtctggcaagggctgtcttagtgaaatgagaggacctataatccccagaagaaactaatctcaatattactagattgaaagttctaaaatgctttgacacaaaaggctggagtcatcctgctacctgtttccttatttttagtcagcttaaatcactgatagctgaaattattcctctcttagtgggcgtggagagggtgaaggaagatatccttgtgttctagttgctcaattcattcttactgcagctgctgcatctcctcctgtcctagtttctagatgacgtttgtctttatgaactacactgctacctcttgatttataaactaatgatctcttttttaccttagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcaggtacgtatctaaaacctttctgattatatgaccaatgattgtttcaggtctgc

SEQ ID NO: 254386 - DNA, 309 bp, Homo sapiens
gcagtgagccaagtttgcaccacagcactccagcctgggcaacagagtaagactcagtttcaaaaaacaaaagaacaaacaaacaaaaactagagggtctcctcttagttcttaaaccctcttagtcaacatttgtgagcctcttttctgtatgttttggcatctttattcctttccttcgtgtcttgaccaaattcaccagatcatgactcagaacaaaatcctgaggttgaatatagaggtctagaacatcttcaaattaactgtttctcctcatagagaattaaagaaattgagaaagcaaaaaaa

SEQ ID NO: 254387 - DNA, 757 bp, Homo sapiens
tctaagaaaaatcacagagtttattggctttgtaaaacctgccacttcatcctgacaacattttggatctaagaagttataagttgaacaactcagcatcagttgtttttacactgaagtgttatttaaaagaagcagatacagtcaacttcacaattttatgaacacttaaaaaaaatgaattgacaagaagagacagagtctcactctctcccaggctggaatgcaagtggtgccatcatagctcactgcagcctcgaactcctgggctcaagggatcctcctgcctcagccttctgggtgactaggagtacagagctccagagcaccaccccactgtgcctcattcaggaagtgctgtgatcaagaaaccactactgctgctggtgccaggactgtgattcccatcaacagcactgatggcctgcacctcacctctgacacccatgggactcttgtatgtggacaccagaaagtctgctaattctggaacaaaaacctgaaatgtctccatgagatggactgctgaaagaaatagaaaaccacagaggtgaggcctccaccgtacttccaaatgctgtattgcacatggaatgcatttgatttgtcagatcaatcactttcagaatccaagctgcaaaggagttttggaaacacagaccagagttttccagcctctgtcagacgagaaggctaaaaaagattggaatggatgatgggcattcatattcacataaattcgacttctatatatgtg

SEQ ID NO: 254388 - DNA, 380 bp, Homo sapiens
ctgctaacctttgaatttctcttttatgactattatactacataattgaggttagattctatataattttgtagcctatatttttccattggtattaatgaaagactttaataacaccttcctgtgttattcaaaagttttcagaaacataatcttaatggcttcatactattctattatgtgaatatgctattattatttacgtagtcatttctctactgttgtgtatttaggtgatttctagatttttgctattataattaataatctaaggaatatttatatatgataattttgttttgccttcttgattattttcttaagatagatcccaataagtagaattactacatcaaataaaatgaatttttaaaaagcta

SEQ ID NO: 254389 - DNA, 370 bp, Homo sapiens
agtcctgtcatttctagctctggaattctctgtggcatccccacagctcttaccctagtcaggtccccagtcttccctcctggacaccacaacagcttccctaactgtctcctgactgccagtgcagcctgatattctagcatacaagtctgatctccttgcaaaaccctccctggatccctctggcccttaaccaggctgtgcagcctggccgtggctcacggcctcagcctcagcccattgggaacctccccacgtcccaccctaagctccagttgcagagaacatgattacagtaagcagctcctggaactccctatgctctctctggctttctcgactttccacatactgctcccatgcggaactc

SEQ ID NO: 254390 - DNA, 506 bp, Homo sapiens
gcagaggggaaaaaaaaaaagaattgaaaaaaaaaaacagcatccagcacaatgcctggcacatagtaagtactcaaatgttcctcaggccagtcatggtggctcaaacctataatccgagcacttttggaggtgagtatggaggatagcttggggccaggaattcaagcctatggtaactactcaaatgttgcttaaatttcaacccagaagccaggcgtggtggctcacacctgtaatcccagtactttgggaggctgaggtgagtggatcacctgaggtcaggagttcaagaccagcctggccaacatgatgaaaccctgtctctactaaaaatacaaaaattagctgggcatggtggcgggtgcctgtaatgccagctacaggggaggctgaggcaggagaatcgcttgaacccaggaggctgaggttacagtgagctgagatcgtgccactgcactccagcctgggtgacagagcaagactccatctcaatttaaaaaaga

SEQ ID NO: 254391 - DNA, 449 bp, Homo sapiens
gcagaggggaaaaaaaaaaagaattgaaaaagccagtcatggtggctcaaacctataatccgagcacttttggaggtgagtatggaggatagcttggggccaggaattcaagcctatggtaactactcaaatgttgcttaaatttcaacccagaagccaggcgtggtggctcacacctgtaatcccagtactttgggaggctgaggtgagtggatcacctgaggtcaggagttcaagaccagcctggccaacatgatgaaaccctgtctctactaaaaatacaaaaattagctgggcatggtggcgggtgcctgtaatgccagctacaggggaggctgaggcaggagaatcgcttgaacccaggaggctgaggttacagtgagctgagatcgtgccactgcactccagcctgggtgacagagcaagactccatctcaatttaaaaaaga

SEQ ID NO: 254392 - DNA, 421 bp, Homo sapiens
tctattcttctcccaggtgcatttttaactcttttctatccaacagtgtctggaaaattctatctccaaaagacatgatcagcagaatgcagatgaatgatgtctcctctcagtaacaatcaccttcctattgtctcctagctggatttggctttccctagaggttgcagtgatgtcatgttggaggggactacagcacttaggccaccctagagtgggctgtaaggcccctacggctctggatgccttgacttgttctctgctaagaccgtgttctcatgggcagcaagcgggattgcaggtgagggaaatagtcaggagcctgaaaaccttcctttctccctcccaagacccttcctttaactgctttgtggctgctgctgtgatttgagttgatagattaaagaatttctatattaaa

SEQ ID NO: 254393 - DNA, 451 bp, Homo sapiens
atacttgtagtggcaggtaaaataaatgtagtccttgccctcaagacagttacaaattaggcagaagtgaagcagtaatagaatagaaactactcagccaatgtttgattacccatatgaaagcgctgttctgtgaaccatatgaagcaccagatataatccttgcattccttgggggtgtgagataggctaagacaggtctgagattgagatgctcttaaggaggaataaagggtaaatttctggggatatgcaagacacaggttggggatgggagaaggttgaatatactgacagtacgggtcttaaacaaaggaggggagtgaatgatattgctgtcatttctcagcaaatcatagtgataaaaaatgtggcagttacaactatacctgtttgaaattcctattatataccatggcaaaaaaataaattatttgcaaggacttaattg

SEQ ID NO: 254394 - DNA, 333 bp, Homo sapiens
ccccatcaaaatccctcccactcccaaggtactaaggaagtcctcaactgcctcctagaattggaagaagatggccctattctccgtgtcatcagcctggacatttatggtgaaaaactaggaactcttatggaagggtccagttcattcatcccacaaacctattccgtgccgggtaccctggggaaaattaaggaaatacatgacagaataaagagaaacaatccttcctttctcttaacacaaacaaaaatcaacaaaatcctttccttgacctcccatcccctccagataactcatcaatcctccatttcccttccctgaaaagcttct

SEQ ID NO: 254395 - DNA, 171 bp, Homo sapiens
ctgaaacctggaaagttgtgtttctaaaaaaattaagagttaaaacaaatgtagcaataccttaagatttggcactgcttagcggtgggtacacatgtctttattctatcctctacatttctgtatgctccatatatttcataataaaaatataaggtgtgttgctcctga

SEQ ID NO: 254396 - DNA, 483 bp, Homo sapiens
catcacttcgtagctcttaacaagtctgtaaatttaataaggtgattttcctaaaccaatgagtctcctaaaaacggttacagattcctcatttcacattgagaagaaagatcacagacctagaatgttaaaactgtccaggaaaaaaaacagttgtaaagctttggaacacactagtagatcttaatctattcacaaggaaatatcagacaagcccaaagtgagagatattctacaagataaattgcttgtactcttgacagctccaaggccatgaaagacaaagaatgagaaactgttctccattaaaggagcctaggcatgacagctaaatgctgtttgattctggattggattctggacccaaaactttttgtctttctttttttctctttcttgcttctttttttctctcttttgctatagatgacattataggacaattggcaaaatatgaataaagtctgcaactagctaatagca

SEQ ID NO: 254397 - DNA, 435 bp, Homo sapiens
aaagtttcttttgctaatgaacatttccagacctgttcctcattctagtttccttttctttctgtccttttttcttgtcaatattctgatccattaattattcattgttattcatctaatttccactgggttatctattaattactcatcaaacacaaatctttttgttttcttccagactgtttcgtaacctatttatcttatgctaaagagacaaagtctctgacttttaaacttacttcttatggccacatttctatcatctgtcacctgggcagagctttgtgaaggaccaggtaccactcatgtaaaaccgctctgggcttccttctatagggaggcaggggaaaactagcagagccgcagggtctagaaggttggttcccaagctggatgcattttggaatcatcaggggagcgtgaaaaaaaaaaaac

SEQ ID NO: 254398 - DNA, 217 bp, Homo sapiens
caaagatttttttaaccttttatcatttctaactaattaagagaaaatttgcttcatataccactatggctctttgtaaatggccttaaatgaaaatttacacttttcttttatcaaaacagttgtgagctgccatttccttgggtatgaaactgattataagcaaagagaccattaaaaaatgttaggtagctttgctgaagttttcttctctaaa

SEQ ID NO: 254399 - DNA, 423 bp, Homo sapiens
ctcccttgatgtatatttaaccacatttcattggctctttcctttttgttttggttgggggttggagaggagttccataaggaattgatgtgatttttctcctggccatttctctaagaataaccctttctgaatgaggtatgttaatcaattcagagttggtcatcttattcctttgtatgatagaagagtagattttaaaatataagcaatgagtatgccttgctttggggtatctggcactgattaccttcttacagcatcacagttactctctttggaaaccctttcttcaatctcaatccatgtcatggaacttatcctactcttaactctaggaattattcgtgaaatctgacaaattagagtgtcacatcccccggtcacagttattgataattggctcaaggagagtcacaggat

SEQ ID NO: 254400 - DNA, 298 bp, Homo sapiens
gtgcagccaggcaggcatagactgaagtaaacatcttgcatgactcagcaggattggagcgcaggtgcacaattccatgcattatataatcaacagctatgtagccataacatgggaggctcatcatctggctctaagccactattgtttgtgaggcgtataaatgcaatactgacactgaaagagctgctgaataaagccatgtctcatctacctgctgtctctcaagtgttcttccagctagctgccccccaccacccactcccctcagacctcagctggggactgaccctgacat

SEQ ID NO: 254401 - DNA, 489 bp, Homo sapiens
aatgagtttgagatgaagtttgagatgtgcttttttatatacaaaaagcacatcttccaccttaaacagttgtatgagacctaaatgaaatacagtgtgcaaagtaccttacaatgcatggaacaaagtaggccttcaacgaggattattcccctttactttaacaatatgatagcataattgcagagagagaaaattggggtaatgagctttgaatagctaacggttttatcagttgtaaatgtgaatcatttggaagcaggagtgttgtcttattaatgacaggtcttattttatagcttagatttaaattaagtcactggtgcaaggcacttcatcagattattttcccaaagtgcaaaagtgcatgtgatccaagaaagagagctgtatttgggtatgaactgcaatgatacatatttatgtcatatctaataacataattgtatgttggattttttcagttagtttataaatattcagaagtaa

SEQ ID NO: 254402 - DNA, 273 bp, Homo sapiens
  misc_feature (50)..(50): n is a, c, g, or t
gaatgattgaataaaaacatatgaataaggaacatattatttggactggnggagtgagttaactgtccagccctggtcagtcagctcttgaaggggtagtttcctggcagtgaggtggtgagccaaggagaggaccacatttctctgcatgcaaatatccgttgcccaaagcattacatgggaagtcaaactcaatcagcaaacaatgattgctgaaccttattaatatggtccgggagatagaaaaaagagtacggaggggtgtcagagtct

SEQ ID NO: 254403 - DNA, 415 bp, Homo sapiens
ggcgcaagaaaatttgcatataagtggacctgcacagttcaaacctgtcttgttcaagggcaaactattcttcctcacttcagtcaggtctgtactcagatgtctttttcaaagagggctcctctgacctccctatccaaaatagcatccttaccccactttatttttcttgatagtacttattacctcttgatgttgtttgttctactagagtaagggaaggagtaagctttgttttgcttactgctgtattttatctcctctgtgtagcaaaaccttaaccctgagggaatttagggttttctctaatttgttgagtgatagtaacagaaattgcacacttctgtggataggacccattgtcacttgttgtttttaacctcaactaggccctcagcattgctcagtgattcta

SEQ ID NO: 254404 - DNA, 340 bp, Homo sapiens
tgtaatgcagtacatgtttttgtccccccagattcatcatattgaaaccctaatccccagtgggatgatatttcgagatgaggcctttaggaggtgatttggtcatgagggtagagcccacaggatgggattagttccgttgtaagtagagacatgagaaagctggcttcctgtctctatgtttccatgctcctccaccatatgaggatacaagaagaggacagcagtctgcaaatcaggaagggagccttcaaccagacactgaatctgccagcaccttgaccttagacttcccagccttcaaaactgtgagaaataaatttctgttgtttaagccacc

SEQ ID NO: 254405 - DNA, 326 bp, Homo sapiens
ccaggagataaaaataaaaaatttgtttatagtcatccaaagttaaagaaattagaagaagttgtaattgaacacttcaagtcatggaatgctgaaaacactactgaaaagaaacgtgatgagacccgagttatgatcttctcttcatttcgagatagtgttcaagaaattgcagaaatgctttcacagcatcagccaattattagagtaatgacttttgtcggccatgcctcagggaaaagcacgaagggttttacccagaaggagcaactggaggtaattatttttggaattgataaaaataaaaataagattgattagctttg

SEQ ID NO: 254406 - DNA, 500 bp, Homo sapiens
cttccatttccaagtgtgtcgatttctccccatcaaggaaaacagctaaggcaatgtgttgatattttctttgaccaagtcatcaggagtcacatagacatacagcactcaagaagtgcctgtaactaaaggcacatctcgttcatctacaacccttgtaatcccaacctttgtctgatgcacaaacccttccctagttctccccaccaccaccactgcacctccaagtggggacaacgaattgtttcatttgcatgtggtttttctcatgaaaaatatcattaacatgagacagccccaaaccaaggaaaccagaagtggggtttgtgcttggtcttactgagagctttccctacttgaccagaccccagcattgttctagatttgtctcttgtgggctacaggaatgcaaacattttgtagtttcctcttttttgttttcttaatggcttgatgagccacacatgtttctctaaatgcatgattttaaattcacacaa

SEQ ID NO: 254407 - DNA, 490 bp, Homo sapiens
gctgcctgcccttcacccctgctccatgaggtaattctgctcccctctgattttttgtatcagaattaactggcttgatgaaggtaccatgcgaaatgagctgctcttaactgggcagaggttttgcatcaggccacctcacaggccagcctatggaaagcttctggagggtcggtacccatgtctggtcagttgggaacagagtgacagtgctgcaactatgcataaaaagctgcctttgaaacctgggggcatgaaggagactcagtgccacagactctttcagaaacaatgtattcatttacctgcaagaagaggagaattgccttcgaaattcttagcatttggattgcagccattgagaagaagaaaagtggcattttctaagaggcaactgctgacagccaaaaaaagtggcgtttcaccattgtgagtggtttgctcccacagactggggtctgaagctgaaataaattcatcataccacaca

SEQ ID NO: 254408 - DNA, 453 bp, Homo sapiens
ccatcccctggcggaaccgcccccagaattaactggcttgatgaaggtaccatgcgaaatgagctgctcttaactgggcagaggttttgcatcaggccacctcacaggccagcctatggaaagcttctggagggtcggtacccatgtctggtcagttgggaacagagtgacagtgctgcaactatgcataaaaagctgcctttgaaacctgggggcatgaaggagactcagtgccacagactctttcagaaacaatgtattcatttacctgcaagaagaggagaattgccttcgaaattcttagcatttggattgcagccattgagaagaagaaaagtggcattttctaagaggcaactgctgacagccaaaaaaagtggcgtttcaccattgtgagtggtttgctcccacagactggggtctgaagctgaaataaattcatcataccacaca

SEQ ID NO: 254409 - DNA, 475 bp, Homo sapiens
cctcacctcatcccctgcatgccattctggcaagtccgaaagcccagctttctgcccagaaagtggaagcgcttcccttaaggcaagagcctgtatgttcccttcagctaagctctggcataaagtcactttctttttaccatccttgtgtttgtcatttaaatttgcaagcaacaaggggcatgacgtgtattcctaggactgagccattagcctgtggggtctgatgctttctccatttactgtcacaattggattgcactgtaggacacgcagctggtacccaagatttggtctgtgtggggaaaaaacccatgtatctggtaacagaagtgttctgtgttgagtgttgagagtatactataagacagttgtttttcctattataacattttgtctttcaacttttttcttcatgtcttctgagacgtaaaagttgtaaattttgaggaaataaattgatttatttttcctt

SEQ ID NO: 254410 - DNA, 373 bp, Homo sapiens
ttgtttgtttgttttgtttttgtgatagctttggtcccaatatttgggggaattttattttgaacatccagaggggagataagataatctactctgcaacaaagtctaaactcagatatctctatttctgatttcctgaaaacgaaacaaaggctgaagtaagaaagacattaccatggctaatacaaactgctgtcttcagcgtttgtctcaagttctttcataaactggactctcaaggtcagttggcacgcttcttccccattggatttgcttgttgggtggataataatgcttttacatgagaggttttgaaggctggagcttataaacaaaaacgcttgataaataaaaatgtgagctgcaggagaaa

SEQ ID NO: 254411 - DNA, 428 bp, Homo sapiens
ctctgaatatatctgctcttagctggaaggaaatacagaacatcacctcttctttggatggtttcagtgggtgtcttggtcatttttttacaaggtgtaaaacatctgccttttccttcactgacagcctaacttatttatttaatggactgtgattgattcaaaacatagttgctgccaattattcagaatttataccactggacgaaaagcttgttccagtggcacttgttgaaggccatgttataccactaagctaactccggttcacaatgcttgtcaaaaataaaaacttaccttcttggactagatttcttttcaccactcataatttgaagtcaactaaaacagggctcttaacatcttccttgctgaaatatgtctctgcatgtggtctccctttgagctacaatacacctgcttcaagg

SEQ ID NO: 254412 - DNA, 383 bp, Homo sapiens
ctgtgcctggacttgtgggggaggtaagcaggttctatgtgagaagacaacttgagaacatcagccctgagagccgcggtaccacatttcatcagagcacacaggactcgccactcactcccctcccttagtgctgaccaagtagccctcccagccacttctgcctgtcacaaaggcagatgcagagatcgtcattcctttcctcacacgtcttctgaggcctcgtcccagcaggatctcagttgtgtaaacttcaggcaaaggccaactttgtatagagctgtgggtagcacgtcacaaacagtagggaccctatttcgctgagtctgtgagacacagcccattgtcaggtgcttcctgatttcagggagattaaaatgtga

SEQ ID NO: 254413 - DNA, 441 bp, Homo sapiens
ttttgttgtgggagaggcctttctaagtaccacatcaaaggcagaaatcataaactaaaacactgatagatgtgaatgcataaaaattaaaatctttatatgggcaaaaaaccttttcaaaaggtttgacacatcaataaactataaaaatacttgcaacagactgggcgcagtggctcacgcctgtaatccctgcactttgggaggctgaggcaggtggatcacctgaagtcaggagattgagaccagcctggccaacatgatgaaaccccgtctctactaaaaatacaaaaattagccaggcgtggtggcacgcctgtaatcccagctacttgggaggctgaagcaggagaatcacttgaacctgggaggtggaggttgcagtgagctgagattgcaccactgcactccagcctgggtgacaagagcaaaactgtctca

SEQ ID NO: 254414 - DNA, 453 bp, Homo sapiens
cttgccactgaaatggatcaatatgctttctaattctggttattttttaatggctttaatttcttcaaacattgtcttcttatgtagtgtttttaatttcttaagcaaaaacaaggcaaaaacttttagtgactctccatcacctgaggataatcctgcttgactggttggatcttaggactggctttatgggcattcaaccagtgcaatcacacagaaccctgtgcttgtaagagcctcctactcctaatatgctatagtgctgtgctatcaccaacttgaagttcttagtaagtttttaacaagagataccttatttgcatgtgactcttggcactacaaattaggtagttcgtcctagatcaaggagatgtctcctctactctcaagttactggatctggattccttgagcactaggattgtaaaataaccttcaaaggggctgaccacg

SEQ ID NO: 254415 - DNA, 266 bp, Homo sapiens
ctttagagagaaaatggtgggacagttaggaaggggtctcactatgttgtctaggctggtctccaactcctgagctcaagtaatcctcccacctcagcctcccaaagcactgggattataggcacgagtcactgtgcctggcctggcattagggtcttaagctcatttcgttctgttccttgaggattaatttggccagaacagttagtattcacaagtggcaacctaaaattaagtatgtgattcatatccaggatgaggcaagt

SEQ ID NO: 254416 - DNA, 336 bp, Homo sapiens
cacacccacggcagacacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctctcgcgccagccggtccccgcgtgcccgccccttctccccggccgcacccgagacctcgcgcgccgccgctgccacgcgccc

SEQ ID NO: 254417 - DNA, 414 bp, Homo sapiens
ggaccctgacaggggctatgaaaatagtgtatccgatcccagaagcactggagagtagcagggagagtgggttttgagggtctggatgtgtaggccagttatagggatggaagacaggaagttgtgctttggcgctagtgaccttgagtgatggtgaggattacagtgggactttcttgtgggtatttgaaaggctaattgagaattctggtggtggaagagaaggaggggagggatgaaggaggaaaacagaccaagtgaaagtgaatgagtgagagacataatgaatgaatgaatgaattgttgaatcaggtagatgtgaaaatggggctggattattggctggtttggaagccatttcttcattgagacctctcagtgtaaaggaagagtggattatcttctccatggggg

SEQ ID NO: 254418 - DNA, 388 bp, Homo sapiens
gacctcaggtgattcatccgcctcagcctcccaaagtgtgggattacaggtgtgagccactgggcccagctacaatagaatactttaagctatataccttgctttttagacataatagcttctgtgtaattaattgacaacagtatagtacaaacataacttttttttttttaagttccagggtacatgtgcaggatgtgtaggttggttacataggtaaatgtgtgccacggtggtttgctgcacctgtcaacccatcacctacatattaagcccagcatgcattagctatttttcctgatgctctcccttcaccccctaccccataggccccagtgtgttcccctctccatgtctgttaaatgtaacttttatacgtacttggaaa

SEQ ID NO: 254419 - DNA, 250 bp, Homo sapiens
aaaagtgtatgtaacttttaagtaacctataatcttcccttcctcaggttcattaagcactgaaccaatagcgcacaggctgagaaacttacctcacccagatgttttgggcctgaattctaacccctctgaaagccacccaccaccagcttctgcaccaggcacccagtcttggctgggacacagggtagcatctctcatggccagcagacctctgttgggccatgttctgatgcatttctgatctgtc

SEQ ID NO: 254420 - DNA, 278 bp, Homo sapiens
ggcattttttgcaaacccttagccaaagcattgatccggcaacagttcaccaggatagtcgtgatgccaaagggtcaggaaagtgtgttttctttcatctgtcgctgggcaactgtcgagggccataactctgagctgaggagacggacacctgtggcctcaaaagaaatatccatgttatgtgtcttgtctcatgggatcctatttgagtgttagaaacaggaaagttcttcttgttcatgttagcagttgtttgttgagccctccctccagccttc

SEQ ID NO: 254421 - DNA, 371 bp, Homo sapiens
gccaccattcccaacctaaactttttgcaattagaaagaattaatgatactttaaaaatatcctatgccccctaacagagtctcttgaatgtaatgtactcaatgaaaattttcagtaaaattgttagtgcatttttttctgtttcttatattacatgtctatgcatacagagtttgtaatattgtaatacttttcttttaaaaacagttgtagtaatcaatggtatgccattcactcagtgcttttttagtactaagtaagtttgatattctttttttttttttttcactgttgcccaggctagagtgcagtgagccgagattgcaccattgtactccagcctgggtgacaagagcgagactttgtctca

SEQ ID NO: 254422 - DNA, 713 bp, Homo sapiens
agcaaatagaacaaaacagagtatgatacaacaatgtagatgaattccagaaacatggtatgcagaagagccaggacacaagagtatacataagttatgtgaaggcgaaactattctatcgtgataaaaatcagaatgctggttgtttatgggagatagaaattaactggaagggggcacaaaggaactttctatgtctctgttatggtggtaaatatatacatttttatatatacatatttatacataggtgtataaatttatcaaaatcaaaactcattctgtgtacattttgaagtccatgaattttgctgaatataaattatacctcaactctaaaaaatttcatgttgaccctaatcaactctcacctgaagtgcttcatctattttcctaatggctaccctggtccctgtcctaattaaccttcaaagctgttttaaaacttttctcttctgcctattgctctgattccaagagatgtggtagaatgtaaattgtcaagatttggaaatctggagaatgttcaaggttaaagacagaaatatctaattaacaagcccagatacagccttggacagtcgaacgcttgggcaagtgttcactgctcgtgttcacttttctcttttgtgaatgatactgctttctaaatatattttatttcttgagcaagagggagaaaagaggagtccttcaaatttactttttgtttt

SEQ ID NO: 254423 - DNA, 741 bp, Homo sapiens
caagcttgagagtgaaaaactttaggggtgacgagtcatgagacctaatcataggactatagaatgctctaccctcccccgctttcttacccccactttcttagccctattttctgcagttccttttacccaattcaccatgtccagctctcaagaaaaaaattacaagtgtactagaaggcaaataatacacttcgaagagacagaacaagcaacagaaccagattcagatatggcagggctcttgaaattatcatatcaggaatttaaaacaactatcattaaaatactaagggctctagggataaagtagatgccatggaagagcagatgggcaatgtaagcagagaggtggaattctaagaaagaatcaaaaagaaatgccaaaggtgaaaaacagtgaaataaaaatgaagaatgttttaaatgagttcattggtagacttgacacagctgaggaaagaatctaaaaccttgagtatatgtcagtagaaacttccaagatagaaaagtaaagggaaaaaagactgaaataaactgaacagaatatccaagaactgtggaacaacaataggtgtatcatatgcatgatgagaataccaaacgaagtaaaaaaggaaaggaacagattaaatatttgaagcaggaacaacagaaattttcctgcaaattaatgtcccacactaaaccacagattcaggaagctcagaaagcattaggataaatgcaaaaaaaaaaaaa

SEQ ID NO: 254424 - DNA, 405 bp, Homo sapiens
agcttggttcacagttacatattagtgtggttagtgtaatatttctcagtttctctagattgttaagtgccatgtgagcaggaccttgggtatgcttactattgcatccgtagagcctagcaccacatctggtttatacaaccataggcactgaagcacacaatgggtaactgcaagtggcttgatggagtcttatcaagctgtgactgaagaaacatgggaactgaggctacatagaggatctacaacaatggctttcaaactattttgatgatgatctacaatgtgaatacaatttgtattacagttcagtacacgagcatgttcatagcatatgtaacatagattttgtataccagtactttgccataagctcatgtaatacactcgttttccacatcaaaa

SEQ ID NO: 254425 - DNA, 487 bp, Homo sapiens
acttgatcctacattttatgctgacaccttaactctttgtcaaaggctattccaatctgtaatggaaggaattcagggatgccttccctttctgtgtgcattgtataaagatagaattggagattcgctggcagaaataccctcagctgcctctctggtcttttccagcaactcccagaagagccctgatctcagggctcttgtctgccccaagcctgggaagctttgctcagggaaagaagaacagagggaactgggctgcaacggagatggtgttaattggagcaaaagattttgcctactggaaatagtagctgtaagcgagatgagatccaaagaacccagtgaaactcttcgggcctgcctgcagcctggctcctccagggaagacaagactgaaccccccattgaggcaaggcaaaaaaggctcaaaatgaatcaattaacagcacatataagataataaatgcctgtatttttttttctt

SEQ ID NO: 254426 - DNA, 310 bp, Homo sapiens
agagagaatccagaagggtgatgccagcatcagccagatgccggggtgtggactagtgacagccattggcttctgctccatgagggcctcttgctgacagtggtggggtttctgtaaccccacctgactgggcccatggatgccgtctccaaaggtggaagcagcttggtgaagtgggcagagtggtgttcctgaggccagaaatgatggaatccctaactcaactcttaactgctgtgtgacttctggcaagtcattttgcctctccgagcctcagttgtctcatctgcaaaatggggatgacaatgcc

SEQ ID NO: 254427 - DNA, 429 bp, Homo sapiens
tgcactgagtttctacttttatctctccttcataaaacactccaattataatacagtacaatattttaaattaagttaaaacccacctcaattttgacagtgagcaaagaagaaaaaaaaagccatagcatagcagttatcctgtggtctcactttctcttccttgtttagacttggagttagtttgggtgtatttgaaacctttctgcagtgatgcactttctgaaacatatggcctagggtctgccagtggtgtatttattggtctttttcaccttttggtatagacctgagatattctagtgggaaaagaaaggagtctgctcttcttaaaactctgctgcctcaagggtggagcctattaaccactgccaaaagtttagatgaatttaaagtttaatataagatgactcctgattgttaaaaaaa

SEQ ID NO: 254428 - DNA, 506 bp, Homo sapiens
gtctctaaacattttggggaagattctggaatgtcttaagtgtttacagagtggctttttagctgtcctggggcatccagatttcttctttggggtgatgtttgtgccaagatccctcatgccttgatgctgctgactctgttaaagaggaataaagctgccgtgttgaagccatcctcaccaatcatgcagaatctgtttgtgccacccaatactctaaatgctcctcagggatttttaatgatgttcttttttttttctttttctttctttcttttcttttttgaggcagagtctcttgatatggcccaggctggagtgcagtggcacgatctccactcagcgcagtctccacctccctggttcaagtgattctcccacctcagccacttgggaggctgaggcatgagaatcgcttgagcctgggaggcagaggttgcagtgagctgagatcgtgtcatcgcactccagcctgggtgatagagtgagacaccctgtctcaaaag

SEQ ID NO: 254429 - DNA, 218 bp, Homo sapiens
ttttctttttgatgtcttttatttccttcttttacctgattgctctggctagcacttcaagtactgtcatgaatacaacaggtgagaaaaggcatccttttcttgtcttcaaggggaacgcttccagtttttgcccatttattattatgttgttgtgggtttgtcacagatggctcttactattttgagaaatattccttcaatgcctagtgtctttt

SEQ ID NO: 254430 - DNA, 323 bp, Homo sapiens
actccagcctgggcgacagtgagactctgtctcaaacaaacaaacgaaaacaatgataaaagagatttaacatcactgaaagttgtaaggaagtaaaccctaaacctccacccctccattaaagcaatgattataagactatactttgaacaattatatgacaacagattagctaacctagatgaaatggacatatttctagcaacacagaaattgccaaaactggctcaagaagaagtaaaaaactttagtagatgtgtaacaatggattatgtcaataatcaaaacctctgaacaaataaaggcccagaaccagatgactt

SEQ ID NO: 254431 - DNA, 318 bp, Homo sapiens
cacgaggcctgccgcggggcctccctggagagggactagccctggggatctgtggccacagcaagcctgggagggtgtttcctaacagcaaagctgggggcaggcgtttcctgaagccctggaggctgcgccatgtggggaggtagagaacctggcctgagagccccgagggccacatcgggactgtggagtccccacagcagctggctggatgagatggttcagaagccctctgaaaagtcactcccttgcccagagcctccagggacttgccatggctctggggatgaggcccatgctccctggcagctcctgtac

SEQ ID NO: 254432 - DNA, 302 bp, Homo sapiens
tgcccctgccaaagctaccaccagttgtgtcaatgctatccacaccagcaatgtacccccgaaccctcgtaccaagaaatagctgatttgcacagagatagatgacatgggatgcctgtctcaatgacaaggggatacactgtagctgtatcttttcttctccctgaaacttccatgaccatgaccctagccttgttgccagactgaaatgaacaagcatttcctctcctcttcactcctaagcttcatttttgtttgttattgatgtcttttttttcattcataaataattttcctttggc

SEQ ID NO: 254433 - DNA, 644 bp, Homo sapiens
gctcgctgacataaaacaaaaacaaggtgacaggagagggagatgagaggctagatggttaatttagatggtcaggaagatctctaggggggcattcaagctgaatggtactttgaatgtttttcgtaagaatgggaggaaataggccgggcacggtggctcatgcctgtaatcccagcactttgggaggccgaggtgggtggatccacctgaggtcaggagatcgagaccagcctgatcaacatggtgaagccctctctctactaaaaacacaaaaaattagccgggcatggtggcgggcacctgtagtcccagctactcaggaggctgaggcagaagaatggcgtgaacccgggaggcggagcttgcagtgagccgagattgcgtcactgcactccagcctgggcgacaaagcgagactccatctcaaaaaaaaaactttgggaggccaaggcgggtggatcccctgaggtcagaaaattgagaccagcctgaccaatatggtgaagtcctatctctactaaatacataaaaattagctgggcgtggtggcacatgtctgtaatcccagctacttgggaagctgaggcaggagaatcccttgaacccaggaggcggaggttgcagtgagccgagatcgcacc

SEQ ID NO: 254434 - DNA, 499 bp, Homo sapiens
tgatgtaaaatgtggaaggaaaagacaatacaggccaagagtggaagcagtgagaccttttacaggcctccttgattattcaaatttagttaatgtctcaattatacaaaaaatacttagttgctaattacgtaaagaccatcacataattaagaggaaggagcaaataacctctggcccttggtttttttatgcaaatgggagaaattagctacattcattcatccatgaaaaacatttattgagtgaacatcatgtgtcagacactctgctatgctctgcactgagaaaaaagatgaaaaagaccctaattttaactaacactcaaggaacttaggacaagtatggtagtagaagaatgaagaacagaccaggtgtggtggcacacacctgtaatcccagcactttgggagcctgaggcaggtggaccacctaaggtcaggagttcgagactagcctgaccaacatggcgaaacctgttctctactaaaaaaaaaaa

SEQ ID NO: 254435 - DNA, 441 bp, Homo sapiens
gtccccttggcttcctcctccgcctcctccttccagggtctcctctgcagcactccctggcctcccaggcactacctccccttcttgtcacccaagagcagttggcacagatctctgtgggcatcacacagacttcctcccatcaccctctcagatcctcctctgcggcccccatgctaggtgggagcctcattgtctctctaactgtggcaacaggcgaagcacgtgctctcactcacagggtccttggagtgcctgctctggttgccacatgccatggggtgcggttgctgctctcaagaagcccacatcctcctgcaggggacctagcccacggagagtgccaagtgtatgcttgtcagaggtgaaagaggtgtgtgtgtgtgtgtgtatgtatgtgcatgtgtgtgtgtgtgcatgtctgtgcttgtgcatgcgtgg

SEQ ID NO: 254436 - DNA, 681 bp, Homo sapiens
tagattaccaccaatcagccatctgtgtcatatgccatcattcttcctgacatctctgaattacaaactcaaccaagagttccagtaatgaatctagaaggttactttttcacattttacaccctgtaaattttatagaataacccagttctcactctcattctgcttatttgatccaagtgaagaatactatccaatattcacccacagttcctctaggtagggatgggaggaagtagggagtaaatattattaccaaggagagagggaaaagaagaatatagatatatatgtatataatcgtaaatcatatttttatatataaagaatacatataattttaaatattattaaacaacacaagaaaaagtaagtatggagaaaaataatcatgcacatttcaaaagaatacagaaagtgggaggaaaattacattctctatgagaataaggcagaaatattccccaaaaggagaaaaaactaaaagggagaaattactcatatattggtcacgtttatatggtaacttttacacttttttaaaaagtcaaccccatttttgttttcactgaaaaatagtatgtgtcctgcagtatatactcaataaatgtttgtgaattgaatttaaattattttactttggcaggttatttctttttcacagtgctcacagggaaaatc

SEQ ID NO: 254437 - DNA, 488 bp, Homo sapiens
gtaagaacctagagttttatgtattattattattaagccttccgagggaccactttgcacgcgcacacaacctgcctccgggacacccgccgggggcgccagtggggtgcgcacgcccaacggggagacccgggcaggtacccgagcaggtggagcggcgaccgtggagggtgtcgggagggaaaccgtaggtggatagagtgggatccccgagagcccggacatgacacgcgggttgaccacccgctgcttaggcgatcagttcactttcccactctgcgctcttggcgcgctgccccggggctggagacccgcggtttctgagagtcgcttctcgcggcgccggctgccgcccgcgcccacgccgctcggataaccccaggttctggcaccgcgagcgcaaagccgcctcggagcagggaaatggtgcccttctgttccgctggtcacagcctcccccaaagccgagaacgaactttgcctacgac

SEQ ID NO: 254438 - DNA, 510 bp, Homo sapiens
gtttgaaggttcttatttccattcagactcaaactctccctcctcaacactttcacccatgggtcctatccttaagggccatacaaaactaatcgaatctcttagaacagctcttcacactgttgaacacagttgtcactgctccttgtctccaccctctgagtgctcctacctccagtttcttaatctaattcactctttcccagacaccattgctctgcctgcttgttttggacatgactgtcttaagtggtggctccaggcaagcctattcttcacagtctttatgaaatgcattccttcagtgcctggaacaatagcagggacttgatttttatatttgctacgtggaagagcatattctagctaaccccatagaatatgcatttagtattgtaaacctcagtttacaaaaacaatttcttcagtacctctcatgtcattttctccccaagtctcagtcctcattagatgagggaaaaacatcacttttgcttctaactccttcag

SEQ ID NO: 254439 - DNA, 576 bp, Homo sapiens
gtggctaatctaggaatgactcttgctcttctgagagtcactggtagaactgtggaaacactgtccatgtccaagccctttcttcattcgttagcaccttcattctttcaaaacacgtttatgtggagtccatctggtgtcagggagaactgtaggagccagctgacaaagatgaccaacagagttggggccctggcctcagagcctaccagagtgaagcgagagatggtcacctcatggcccacagcatgacggtgtcatcctccactgggcattgcgtgggtaggagttgggacgggattccccgaggaagttgtaaagagcctgaggccccgcatttgagtgggaggccactgggccaggcaggccaggggacaggaggacaggagcagaggcaggccagggccaggcagaagcctgtgaggcaggagtgggcgagcccagcagggcctccaaggtcatgggagtgtcttagactctcaaggatggtgggagccatagtagggtgtggagcaggaaagtagcacaatcacgtgtgcgtatctgcgtatttaaatgtatttaaatgcctcaggt

SEQ ID NO: 254440 - DNA, 720 bp, Homo sapiens
gtgcaaatcattttaaagagaaagaaataatgtcaaatttattatccttgatagtagttgaaagttcacagtaatatggaaaaggtatacatgggactatttctgccctcggaagcgtctgcgcagatagcatggttagcaagtggcaggaaccatggggatttcagtgtgtccctggctgccaaggcctgggggccgaagtttacaaatacacccttggctgaggggaaagggactggggtcctgttccctatcattacatgttccagggacacacaggcctgaagaccttcctaaacagtgacgatatcacctcaggcgggacccagcagaagcccgcgagtccccggtgccccgccgggatgggcctgtgggccggcaggactccgggcggccctacagcttggtgggctgctcggggctgagggggccaggcccgctgggcgggggcagcaccatgggcagcgagttgctgcccctctcgtgccagcaggtgtccaggatggggtagagcttgccctggaagtcggcctggaaggtgtagagcggccgcaggtcatcggggcggtcggcatcgaagaaggtgagttcgccctgctcatagtgcaggtagagcccgatgcggtgggggtggccggccacgggcaggggtacccgggggcaggcaaaggcttcgtacacccggccctccttcaggccgatcagccacacgccgtgctc

SEQ ID NO: 254441 - DNA, 587 bp, Homo sapiens
gtgcaaatcattttaaagagaaagaaataatgtcaaatttattatccttgatagtagttgaaagttcacagtaatatggaaaaggtatacatgggactatttctgccctcggaagcgtctgcgcagatagcatggttagcaagtggcaggaaccatggggatttcagttgacgatatcacctcaggcgggacccagcagaagcccgcgagtccccggtgccccgccgggatgggcctgtgggccggcaggactccgggcggccctacagcttggtgggctgctcggggctgagggggccaggcccgctgggcgggggcagcaccatgggcagcgagttgctgcccctctcgtgccagcaggtgtccaggatggggtagagcttgccctggaagtcggcctggaaggtgtagagcggccgcaggtcatcggggcggtcggcatcgaagaaggtgagttcgccctgctcatagtgcaggtagagcccgatgcggtgggggtggccggccacgggcaggggtacccgggggcaggcaaaggcttcgtacacccggccctccttcaggccgatcagccacacgccgtgctc

SEQ ID NO: 254442 - DNA, 1995 bp, Homo sapiens
agcggagtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggtcaggacgaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttccccaaagcgttttatttgaaaggataacttgtgttttggttatttgtgtattcccacctgtgctggtagatattattaacccattaggtaaatactattacagtcgtggtttctgcagcagctcacactgatgtagctggcgtttataactaccttctttcgctacccgtttcgcattccctttgccctgagatagcatgtcagttggtcatgatgcttggcctggcaggatgactcaaaccttcattacggaagagtctgaaccattagatatcctgcctggatggggttgctgtgattttccattaactctaatcgaaaaacacgggaggactaagaagctctctagacatatcacacatactcttccttagcccctcgtgtggtgggaacccgatctcaatgttgaaatctgtatcatcagccttcaacgaaaaggcagaactaatgggagattttaatgtgtgtgtgtgtgtgtgtgtgtgtgtgtgtgtgtgtgtgtgtgtgttggtagggggtatatatacatgcacacacacactttctaatctcccattatacatataatacacattacacatattatatatacacccccatatatatatatgtatgcgtgtgtgggggggtatatccaatatatataataaaggtagttcctagataggattggtctgatacaataatttggagctgcagtagcagtccctgtaaggctgttgtttccagatacgacttgaacgttctatgctttttattttttttaaagacagaatcttgctctgttgcccaggctagagtgcggtgacacgatcacaagtcactgccacctcgacctcaccccagttcaagcgatccttgtgcttcagccttcgaagtagctgggattacaggtgcaccacaggtgccatcacgctgcaatttttgtatttttagtggagatggggttttgccatgttgtccaggctggtctcgaa

SEQ ID NO: 254443 - DNA, 507 bp, Homo sapiens
tcctcctgtctcagcctcccaaagtgctgggatgacaagtgtgagtcatggtgcctggccacattttctattttatttcatgttttaaaagatgctggtgtgacccctaaattgatttcatgatccactagtaggtcttttttttaaaagacagagtcttgctctgtcacccaagctggagtacagtggcatgatcatagcttactgtaacctcgaactcttgtgttcaagtgatgctcctcctgtgtctgcctcctgagtagctgggactacagttgcataccaccacgcctagctaattgtagtttttgtagagacagggtcttgctgtgttgcccaggttgatctcagactcctggcctcaggtgatcctcccacctcggcctcccagagtgctgggattataggcatgaaccatcacacctggccccactagtgggtcttgacttgtgttttctaaaaatactgtttctgagataaccagctcaactagataactgtgggaga

SEQ ID NO: 254444 - DNA, 561 bp, Homo sapiens
cagctatctgaaaactcatccagatagcaaatgtatcaggaataatgagggtttacattttcattggtgtgtttgctcaaatatttctgttcattatttgtccactttcaggagagatagcatattaaggttaatcagcagcaatttattttgtgtggtacctgaaatttctactttataatcgtacatgacatgattaccacatgataaaatcgatttttatttcttgtcttacggaaagaaatcctattatcttgtcttgtcacattgagtatttttaaggcactctgtcttatatcagacattttgaattttaaaatgatcaatgtccaggttaattttatatacattttcatatctgtctaattttttttggcattttatagtgctttgaaagatacagtgtgtaaaagacaatttatgttttagagaatgatgttccttaccttgatgcatagtcttcctgtttataaagatgttacatgtttatggtggaatagtcaatcaaatactggcaaatacaaaaataaaagtgaaaattactccaaattccagagataa

SEQ ID NO: 254445 - DNA, 331 bp, Homo sapiens
caatgcacactcgcagtgacagccctgacaggaggggcatgaaagacggtggctccctctctgtccctcctgtcccttcctctctggtgtctgtccccctcactgctctggggtccgtgagctccaacgggtagccctggccacatggactgacgtcctcttgggccgggccctgtgccacctcctatccaccctgactccctctgctgcttcccccaaactccagattgggaccgagtgctgcccaggtggccccctaggacttgctgtgactgttttgcccagaggcccctcggacagtaacgccacagacctcgctggtcaccgggca

SEQ ID NO: 254446 - DNA, 312 bp, Homo sapiens
aagtggagacagggtcttgctttgtcacccaggatggagtacagtggcacaatgaaagctcactgcagccttgacctcctgggctgaagtgatcctcctgcctcagactcctgagtagctaggactgcaggtccatatcaccatgctcagctaacaggattcttaaatgaatacaaatgagcagaccacacccaggcaagaacccgtgttctgaaggcctcaggtatatcccaggacgaaggtgtctgaacagggatgctctcctgtggctataccccaccccctgcacttgtggttcccttgactccctgc

SEQ ID NO: 254447 - DNA, 234 bp, Homo sapiens
atggctgtggaatccatttcctctgggtacagtgaaactgcttcccctagcttccatttatgatgatttccattatttggaacgtttgttactctttctctctctttctgtcacacacatgggtacagtgagagctagatgcagtttagaaaccaaatctctgttgaacagactgttaatttaaatttttgaaaacaaggaaaaaggaataaaaattctagttctgtagttcag

SEQ ID NO: 254448 - DNA, 393 bp, Homo sapiens
agtgagccgagatcacgccactgtactccagcctgggcaacgagagcgaaactccacctcaaaaaaaaaaccctttttataggctaaggagttagaatgtataagcagcagaaatccatggggatccaatgctattgttccctggcaaatttatgtagcattttgatggagacatcaaactcggcacccaggcttctcccttttcgtggcaagggcaatggctacctcttcacccgacatctctggacaaggcaaaaactaagagaatatccctctacccagtatacccacacctccaatgtgatgggtgagaaattattaaagaataattcccatccctagcaccccaacccccactataactacactgcccacttggagcttctgggtgag

SEQ ID NO: 254449 - DNA, 542 bp, Homo sapiens
gtgagtttaaatatacatattcatttatgttgctatcaccacattctgggtaatgggcatatccatcacctccaaaactttctatgttttcctttgttgctgttgttgatttgttaacatttaaaatgagatccattctttctaagattttatatgtaccacatattattgttgactgtaggccctctcatggcagacctctggaacttattcatcttgtgtaactgcctccccttagatgacaactctttttctctcttttctgcattccctggtaactactattctaatttctatatctatactttttcctatttcaggtgtctcacataagaattgtgcagtgtctttctgtgcctgacttatttcacttagcataatgtctttcaggcacatccatgttgtcacaaataagaggattctcttattttttaaaaggctgaataatgttccaattatgtatgtgtgacattttctttatgaatttatctatttgtatgggttgttaaaactgtgagaaacaaaatgactttaaaaaaaaa

SEQ ID NO: 254450 - DNA, 372 bp, Homo sapiens
ttcatgccagtaatcctataatcttagcactttgggaggctgaggcgggaggatcacttgagcccagttcaagaacagcttgggcaacacagcgagtccctgtgtctagcaaaaaaaaccatgtgtatatatatatatatgtgtgtgtgtgtatatatatatatatatatatacatacatatatatacatatataatttgatgggttgtgagaagccaaccccccccaaaaaaaggggggtgtagagcagcttcccctgacaggtgccgtggctgcccccgtagtgggctatgtctgtgcacaggcgacagggaggagggctccggagcttcccttgtggtgggggtgccttctccctgtgaggatgctgag

SEQ ID NO: 254451 - DNA, 327 bp, Homo sapiens
agaagacattccaggctgaggtaacagtagaagtggagaaaagaaagtatttgccatggtttgggaaaggctaagtgttgtatgtgttcatcgcatagggttttgcaagatgtcctgggagacgagcctgaatatagatggggccgtgctcagtaggaaaagggaggagaatttatacttactgaacaccttttatataccaggttctgaggttgggcgcagtggctcactcctgtaatcccagctacttgggaggctgaggcacaagaatcgcttgatcctgggaggcagagaagtgagccgagatcgtgccactgcactccaacc

SEQ ID NO: 254452 - DNA, 298 bp, Homo sapiens
  misc_feature (16)..(16): n is a, c, g, or t
ccagcttaaggaatgngtgggaattagtttcatactgtagattaggcagacttgtgctactgctgtccacccacacatctacatgatcaaaagacagtgcccttcccactactaaattgctggttacccatcccttcttctatccctattgtccctgctaatttcaggttcccaatgcctacctgctggttgcctgcaatgacctctacatcactctccttgtattcaccactacagccacactgctttccaggtcttatacccacagagaagtctttctcaactacttgtctctcac

SEQ ID NO: 254453 - DNA, 699 bp, Homo sapiens
ggacagatggagagacacagaaaatatttttcagtataacacagataacttctaaagcaggtgttttgtttaccaactgtctcttggaaactcttcagttcaaaatggtgaggttattttttgtatacgaaatccagtctacttcctaaaattcaacccggcatgcagtttcttgggatatactatctgactccacagagacaaacaactattcagactgcactgcgtactgagtttcattattgaaatccttacactggattttaatgattttttcttcctatttgtcatcccatcctgttacataatgtcagagctgtatctttcatttcttggaatccccagagcttctcaatgagcttgacacacagcagacatttaataaaattatataaagttaaattatgaccatctcttgagtatgtgacttatacataataggaagtaataattaaaatgcatatttgcccattttaaataaagaaagatgcaaagtatcaggaagatggcagaataggaaataccagaacttcttctaccacagagacactagcgtaacaatatatggtatgtacatggggacaagaaacaggaagagatgtaaaggagtaggttttgtaagtaattgaagttaagttgttatcaatttaaaatatattatataagatattttatgttagatccatggtaacccgaaaa

SEQ ID NO: 254454 - DNA, 394 bp, Homo sapiens
acctaggataaatgtctctatgtgatattaggataaaaaatgattaaaaaattagaaagtttgtaccaattttaactaatgaaaatgtttgcattggctgggcacagtggctcatacctataaatcccagcattttgggaggctgaggtgggaggattgcttgagtccaggaattcaagactggtctgagcaacatagtgagacctcgtctctacaaaaaaatattttttaaaaattagccggacatggtggctcatgcctgtggtcctagctactcgggaggctgaggtgggaggaccgcttgagcccaggaggtggaggctgccataagccatgttcataccacttcactccagcctaggtgacagagtaagacccagtctcaaacaaaaaa

SEQ ID NO: 254455 - DNA, 155 bp, Homo sapiens
agaggctgtgaagaagaagagacttgtctctcctcccctgatcaccagcctgggccagggatagcagctggtgctacttggcaccttttagctgaggaaactaaggctttattcacccaatcaatggacgaagaaactgaggcagaaagcagaga

SEQ ID NO: 254456 - DNA, 195 bp, Homo sapiens
agtgctctcatagtctagcctaagaggagcacagaggcacaaagcatgcatcatcagaatgtgtgggcagagcatgacatgctgtggccttttgcaaccccaggacccagagtttcagaactaatcttcaggcaaatgatgatactggcttttccatggtgacatctggccgggatacagagatccctgagtaag

SEQ ID NO: 254457 - DNA, 227 bp, Homo sapiens
ttttgatttttatttcaatagcttttggagtacaagtggttgtgattacataaataaattatttagtgatgaattctgagattttagtacacctatcacacaagtagtgtactttgtacctaatatgcagttttttatcccacattctcaatacccttcctcttctgaatctccaaagtccattttatcactctaagtctttgcgtattcttagattagctcccact

SEQ ID NO: 254458 - DNA, 438 bp, Homo sapiens
caccagtgcacttcagcctgggtgtcagagctaggccctgtctcaaaaaaaaaaaaggaaaaattaattacacctgagggaaattcccatgcaacatttaatgaatgccttcagtgctgttataatgcattaatttctatgagaaatgttctctcttttttgtgccttttaggaaaattgcattttggtgatagaagataaaaacttggctaattaggccaggcatggtgggtcatgcatgtaatgatatgggaggctggcatatcacttgaggccaggagttcgagactagcctgtccaacacagtgaaaccccgtctctactaaaaatacaaaaattagctggatgtggtggtggatgcctgtaatcccagctacctgggaggctgaggcagaagaatcgcttgaatccaggaggtggaggttgaagtgagccgag

SEQ ID NO: 254459 - DNA, 397 bp, Homo sapiens
gagagaaagaagaagaggaggaggaagaaagggaggaaggaaagaaaccatcatattcttttttttttaaaccattatattctaaatgaagtaactcaggaatggaaaagcaaacatcgtatgttctcacttttttgttctgttttgttttttaagatggagtttcgctctgtcgtccagtctggagtgcagtggcgtgatctcggttcacctggtgccgaattcggcacgaggaaatatactgtatatttcaaaagaagaaaagttaaaagatatttgaagattgcaggggcaaaacaagcagtaactacatggacttttaagtgcggtatgaaatgcaacattacgcttacaaacagtactgtcaaacctcaaatgctttctttcttcagatgcc

SEQ ID NO: 254460 - DNA, 648 bp, Homo sapiens
atggtgaaaccctgtctactaaaaatacacaaattagccgggcatggtggtccgcaccggtagtcccagctactcgggaggctgaggcagaagaatcgcttctggcggagtttgcagtgagccaagattttgccactgcagtcagcgttctgttaggaatctaattgcacagcagtaggtgagcagccactgagcgagctttaccgcctcaactccacctcctgtcagatcagcgcacattaggttctcataggagcatggacagcacatatgagggatatctaggttgtggctgcttatgagaatctaatgcctgatgatctgaggtggaacagttacatccccaaaccatcccatccccgaccagtcccccaccagccccccacccagacctgtgggaaaattgtcttccattaaaccgctccctggtgccaaaaaggttggggactgctgcgtagaatactagagcttctcaaaacagtttatatatttttattttttgagatagggtcttgctgtgttgctgaggctgtagtgcagcggcacagtcatggatcacttgagcctaggaattgagggttgtatcgacctaggattgcaccactgcactccggcctgggacacagagtgagaccctgtctccaaaag

SEQ ID NO: 254461 - DNA, 360 bp, Homo sapiens
aagaaaacaacagctcaccaatgaatgacattattatttctatttccccattttttgttttgcaactagaaattcaggaattaatttatgtcaccaattcaaaatttcatctccagtagaaatgatttaaggggaaacaaagaatccatttgaagtagcctcatcatttgtgttcactttttgaattagcctttgtatgtttacagtctctttggatgattggtgactaatacgtaaaaaatggctaaacaatgatgtttcttcagaaaaggacattaaggagttttgtgagacaaaaagacacaaatattggccgggcgcagtggctccagcctgggcgacagactgggactccgtttc

SEQ ID NO: 254462 - DNA, 251 bp, Homo sapiens
ggggtccagtgagagtctggggtcaccgtcagcctgtggtgcatggtggtcaggcttggtagagccccagatcgtgggtggtaaagggaatgattaaaatttaatatcttgaagctgggagttaaaaatgatttgtgtaaaatagaagtccaacttttctgaatgtatgcttggctgacatggtttgtctatcagctccagggatgcaggtggtcaccatcccacccattatgaaaagattccaggccatg

SEQ ID NO: 254463 - DNA, 318 bp, Homo sapiens
tccttctggcctccagctgagtctcacctgcctggagcaggtagaaatgttggggaaagtgtggctgcctgggagtcaaggtcgctttgaaggatccactgagtcagtgtacagatgaggaaactgagctcaagagcaggaagggaaatgcccagaagccagtgaggaaaacaggcagagtgcgatctggattcagcaacaggaaatgtgatttccccacctatttgggaggctgaggcaggaggactgcttgagcccaggagtttgaggccagcctgggcaacgtagaaagaccttccccactccctcgcaaaaaac

SEQ ID NO: 254464 - DNA, 658 bp, Homo sapiens
tcaccatgaccaagcaggctttattcctaggatgcatgattttttcaatattcacaaatcaaaatgcaatttaccacataaagacaaaagcataaaacatatggccatctcaatagatgcaaaaaagctttatataaaatccaaaaacttttcatgataaaaaccctcaacagactaggcattgcaagaacatatctgacaataatgaaccatttatgtcaaacttacagtcaacattatactgaatagataatagctggaatcattcctcttgggaactgaaataaggtgaggatgcccactctcaccactcctattcaaaatagtactggaagtcttagccagggcaatcagaaaagaaaaaaatattctatacttggaaaaccctaaagactccaccaaaaggcaactagaactgataaatgacttcagcaatgtttcaggatataaaatcaatatacaaaaaattagcagcatttccacacaccaacaacatccaggtcaagagtcaggtcaagaacataatatcatttacaatagtcacaaataaaatgaaatacttagaaatagaatacagctcactaaagaggtgaaagatctttacaaaaagaactacaacacaccgctgaaagaaattagaggcaacacaaataaatgg

SEQ ID NO: 254465 - DNA, 422 bp, Homo sapiens
ttaccttttctaactgaatatttctgaaaaattctcagtgtactggggttgaatttcttcatcccctaccaaagggaaacctggatttcgaagcatgttaccttttctgtctgaatatttctgaagaattctcaatgtactggggttgaatttcttcaccccccaccaaagggaaacatggatttcaaagcatgttcccatgaagggaaaaattccacatccacgacattcatagaattatcaggtataaaagagactttgtctaaaatttgatctataattttctcttaaaaactaaatgatatagccacatgctgtgtatgtaatagatgtatgtgaatgtgcgtgtgttcttcagcaaaactgttgtactttatgcaggtataaaatgttgccatattcgttaattttgtcataacaaa

SEQ ID NO: 254466 - DNA, 470 bp, Homo sapiens
ctacatagttttgcaagcatttgcaagcataaacactcaggcatattatatgacagaaagatataacataggactgttatgagcatatgaactgtatttataaagaaataggtcataagggaaatgcataaacacctatcactgtggttgctaattgtgtgcaccccactttataactgtgggtcatttttatctttcacaaatgcagatgtatgaaaaggacatctgttcatttattgaggaagtttcaacatttttacatacatgtacagtgcttacatacaaagtcaacattgtgatcatgcactttcgtgaagtcagatttgcaaaacatgcataaaacaaattagaatcctttaagtctctataacttacgcttccagtgttggaaatgatgcaaaggtgaaatacatagcatagcaaattgtaaaaaataatactcacaatttaaaatagcggaaaaggaaact

SEQ ID NO: 254467 - DNA, 630 bp, Homo sapiens
atcactataaggcacaaatggtaacaatgcttatatgatagaatggaatcattaaaatgccaaatttaatcaaaggcaataagaaaaaagggaactaagatcacatgggacaatttaaaaaaataagatggtagatttaaacccaggcatagtgacaattacgataaatataagtggtctactcgtggataagttcaaactaaatggatgggaaaaaatataacatcctaacattcataaaggaaagctgaagtggttacattagaacaagcaatgttgctaaggataagatgagacatttcataatgataaatgggtgaattcatcaagaaaacagttctaaacaggtgtgtacctaattacagtttcaaaatacatgaagtaaaatctgctctcattgaaaggaaaaatatataaaatcaaaactacattttgaggccaggcacaatggttcacacctgtaatcccagcactttgggaggccaaggctgatggattgcttaagttcaagaccagcctgggaaatgtggggaaaacccatatctacaaaaaaatacaaaaattagccaagcgtggtggcttgtgcctgtagtcccagtttactcacacagagcaagcaagactctgtct

SEQ ID NO: 254468 - DNA, 343 bp, Homo sapiens
ttattggattcattctgataagggagaaagacctaagcatggagatacagagtagaatattacagtgtgggagagtcacacagacaggttgggagaactctcaggactcagatctcctggtgcagggtaggagttgcagtgacaggttgatttctcccatctcttccgacatgggtttccccatgtgccactccctgtagattagtagtggggtcacgaatatactcaaaccacactagcatgctgggacaatgtgtgtctttgtgttctgtaattgatctgagtctcctttatgagccccctctctcctgaatacttcaagttgccagttagcaagatatca

SEQ ID NO: 254469 - DNA, 1405 bp, Homo sapiens
agacaaggttacaccatgtttgtcaggctggtatccaacccctgacctcacatgatccacccacctcagcctcctaaagtgttgcaattacaggcatgagccaccatgcctggccacaagttcttactattaagagacatggtgataattcattctgaagaggaactctacaaacctgaaagatgtgacagtgcttttttcaacacttccatcctttctatacataaaaaatttatactagtgtgaaaccctagaaatatataaaatgtgaaacagcctttatatggttgccacatttgatagtaagataattcatactggcaaaattcctacaagcatgaagaatgtggcaaaacctttaatcaatgtgtacatcttattttgcaggaaagctattatccctgagaaaaattgtacaaatataaagaatatggaaaacccattaatgcctactcacatcttactcaacataagaaggttcatagttaatgaaagcattaaaagtgcaattactgtcaaaaaatctttcagaaaatataagcctttaaagtgaagaagagtatttattctgaagacaaccattacaaatatacaggaggtttattacacacattttgtactagaggaaaatcctgaagcagttgctcaagctttgctcaacatcagagaacttatattggagaagagtcctgcaaatgtaatgaatttggaaacactttaaaaaaaaaaaactacagcttagaaaacagcagagtttatactaaaatatatttttgcagatgcagtaaacatgaaaaaatatttaattcaaaattaattgtatgtaaatatcagaatttacagaataactaaggcactgacacttcagacattacattaaataagagtgttgagtatataaatgaattcacaactaaagttgttaaatttgtatataagtttgtgtaaattagtatataactttaaaaggagattttttgaagctttgtaattacattgaaagtatatttgtttccttgaaaacaatttttttgaaaagtgaataatgatgtaatacagctttcaaattatgctgttactttattatattcacgtgaaagtatgtgatcaattgttgctgcatcagagatattagagattctttattagttgggcattctttatgaccttttctataaaacagtaaggacattaaaatgtaagatgcatgacaaaaatataagtggagaggctcattgtaattaacctatattaagtaatgtttaaggtaggtgttcagagtaatacttttctacattatactgagagaaagaaattataaattaaagtatatcaattattttactaattttactgttacgtaataaaatgcaatatatttaaaaattgttagatgatgtgtgaa

SEQ ID NO: 254470 - DNA, 287 bp, Homo sapiens
cacagggtttaggagaggatcaaatgataaactgctcctgaaagtgtttcataaaatgtaagaatgtagtttaacaaaagactgtattggtttaagtgctactgagaaaaatgctgtatggtctggagggtatttttggaggaagtgaaagtctttggagccaaaataaaaacagtgagggaaggtcatgaatgattaagggaggtgattgtctgttactgtctatggaaaacagaaatcaaaacataattccccaaaaacagagaaatgaagctttcaagtattga

SEQ ID NO: 254471 - DNA, 122 bp, Homo sapiens
tttttgtgtcttttttgaccatctttgtctgcttttgataatactagccttattaaatgaagtgagaagtattcctacagttgatgatttgttgatttgtattccccttctgtcgtcttctc

SEQ ID NO: 254472 - DNA, 215 bp, Homo sapiens
acccagatacacatctggtcacgacttgaacctctcttaaaaggccctggacatcattcaatcctttggagctgtttctccaatgtttccttggcagaacccagaggtggaatgtgtaagaagggagcgtgcagtgagaagcacctccatcgggtttgagggtgcaggagaacatttagactgaaaggttctcttttatgctttcaaacatgaga

SEQ ID NO: 254473 - DNA, 442 bp, Homo sapiens
cattcattcagtagacatttattgcacatccattatgtgttagatttagaggagaaattgtgacataagggtaataatattctaatttgctggtgccagagagactgtagcagcaatgtatgtattcagttatatacctgtaaaagaagtttcttatcacctgaaataatccttcgtttgataatgaatcttttgtaactatgattttaattcacccaattcttaatattgttatcaggcacttaattatttattcctctttgaaaatttgactactgatttccacttgatagtctcattgcttggcaatggctaagttaaaaagtgatttacaatttttgttctttcagactatgttataggtgacattttgttcttttaatattaattcacaccaattaaattatatttaataaaggagttttgatctcaggactttaat

SEQ ID NO: 254474 - DNA, 378 bp, Homo sapiens
agtcctggtgacaatgcccatatccatggcaagggagcaacctgcctctgatcttccaaaggtctccatgagattcctgaaaaaagtggggaggtattcccttcttcagcatgaggcagctcactctcacttaggcctctgctctctcagggttttggaagggctaccatgaagataatgttgtcacaatataacacctctctcccctcttataattagtccaaagggccaattcctaccccttctccctttctcttttgtttcttactggatgaaggattgccatgggtgactacaacacaaccaaccaacaattaagagctcccctacccccagattccattctctcttcaacaataaaaaaaaaatacccccatc

SEQ ID NO: 254475 - DNA, 1144 bp, Homo sapiens
ccagaagcctattcagaaaatgaacaattaaaaaaatatagtaatgagccaccaacctgggaaataaattattcttttaaaataatttcaaatgttcaactggtctcactgtaaaaaaaaccttcctttatccctgtcttatatttttgatcccctccaaaacaagaaatagagcagtagcacacaaagtacttagtaactatgtcctcattttgatgtagggccaatgggaaagactggagacaaacgcatgctttcctgatccctccattttaaagctgtagctctggcacagaacctttaaaaagatagtggttctaactgttcaagtatgtgatgcctcatctacccctcactgtcaagaaaatcatgtattccactaagagtctcctaaataactaaagtttacgtcacacttttagtataacaatagacatctttataaaacctattattctagtctagtgctggccaaagacagatgatgccagtcatacatgtaatttaaaattttccagaagccacttttaaaaacataaaaaggcaaaaataattttattttctttaaccgagtataaccaaaatattgagatgtattttacatttttttggcttagtctttgaaatccagtgtgtgtttgacacttgcagcatacctgacattggactagccactttggaagtccttagcagtcacgcatggctattgaactggacagcacagctctgggccctccctgccttagtaaattgactttaatagacaaacgaaaaccaaattcggaccagtcattatttactagtatgtgtgccacagcaaacacattgcctttccaatgtcacagctaagcatgttaattctggatactttaataacccatttatgcctagtgttccattactggaacgctaagcatgtggaatttatctcctactgctcaaggtcatcgccagggtctgactgcaaaaattcaaaaaattgcaacctcaggcgtaaacgggttggttcttctttgccggggaggccatcattatggttctctactgcgtcattactatacttataatattgcagttccctaaggactgttgtgatgacagacttaatggtttggcctgtcactgaattctccaagaccactat

SEQ ID NO: 254476 - DNA, 1088 bp, Homo sapiens
ccagaagcctattcagaaaatgaacaattaaaaaaatatagtaatgagccaccaacctgggaaataaattattcttttaaaataatttcaaatgttcaactggtctcactgtaaaaaaaaccttcctttatccctgtcttatatttttgatcccctccaaaacaagaaatagagcagtagcacacaaagtacttagtaactatgtcctcattttgatgtagggccaatgggaaagactggagacaaacgcatgctttcctgatccctccattttaaagctgtagctctggcacagaacctttaaaaagatagtggttctaactgttcaagtatgtgatgcctcatctacccctcactgtcaagaaaatcatgtattccactaagagtctcctaaataactaaagtttacgtcacacttttagtataacaatagacatctttataaaacctattattttccagaagccacttttaaaaacataaaaaggcaaaaataattttattttctttaaccgagtataaccaaaatattgagatgtattttacatttttttggcttagtctttgaaatccagtgtgtgtttgacacttgcagcatacctgacattggactagccactttggaagtccttagcagtcacgcatggctattgaactggacagcacagctctgggccctccctgccttagtaaattgactttaatagacaaacgaaaaccaaattcggaccagtcattatttactagtatgtgtgccacagcaaacacattgcctttccaatgtcacagctaagcatgttaattctggatactttaataacccatttatgcctagtgttccattactggaacgctaagcatgtggaatttatctcctactgctcaaggtcatcgccagggtctgactgcaaaaattcaaaaaattgcaacctcaggcgtaaacgggttggttcttctttgccggggaggccatcattatggttctctactgcgtcattactatacttataatattgcagttccctaaggactgttgtgatgacagacttaatggtttggcctgtcactgaattctccaagaccactat

SEQ ID NO: 254477 - DNA, 401 bp, Homo sapiens
atattcccagaaatcagaattctgttcatcttatacatacatttttaaatgcctgtctctaaatgattattgttcactaggagcaaagaattgcagcctccactatcaagagagagattttcagagtttggaagtggctcctaccctctctttgttaccttgatgaaatataaacatgattataagaagatttcacattgaatcagaaacttccaacctcttgtctgtatgttccattcttcctttaactccattaagtgcatattgtaattagtatacattttaaataggttttaaatgggtgcatcatatgaaatattttcctattttgaagtaatttaaagccgaataaatttacagttttgaaatataaaataagctctttcagatttaaaaaaaaa

SEQ ID NO: 254478 - DNA, 497 bp, Homo sapiens
ccagtgcctcgaggagtgcttagtatagagacattcagtattgtttgttgattgaataaattatttccattatgccatctctcaccccacagtctctcttctgtttcctatcatcttgggcacagttgtgtgttctggacgttggacattttctgtcttctttcaaaaatcgtcttgcccaatcactacagcaacttactttctgcttaggaactgacatcttgctccagaaacaatttagtgtttctactcttgggaatttgcaaagcaacagatgttttctgcatactgtatctaaacccacagcaatttgaatagtgagacttcctgatactgtgccaggctctgaggaatagattttggagacagatatttggcacccctaaaattttagtaggcctaggtccagcctcgtccatgtcagtggcagttgggccaaattcaccgagtcagacattcctgccctcaggagaccccaccaccccacaagctgtggt

SEQ ID NO: 254479 - DNA, 844 bp, Homo sapiens
gccaccacgcccagctaatttttgtatatttagtagagacagggtttcaccatgttggccaggatggtctcaatctcttgacctcatgatctgcccacctcggcctcccaaagtgctgggattaagggcgtgagccatcgtgctcggccttggtctcccttctataggtaaaattggttttctcctttaaaatatagttcccatttcctctgcaaaccttatttaatggtaaccagttagtcctaattgataagggaatatactgttttacagaagtttagataaaaggtgtgaaaaaaagtgacaatttaaaaatcattttgcagtcctgaggaactaatcagtcttatcactaaaaatgggaaaaccagatatggtatgcttcttgaggtgatataacatgaagttcacaagaattattgccaaaaatcttgaacccaaatcaaatcaagtatagagagtcatcttccctaccacaagggagcagaatacaagacattctgttggacactacttgggaggctgaggtggggaagatagcttgagcccaggagtttgaggttgcagtgagctatgatcacaccactgcactccagactgggtgacattgtgaaaccttgtcatttaagaaaaaaaaagttggtattcttttcatatgtctgcatgactcacactgagaaatttaatttcactttgcctctctatccttagtttctttgatgtgctctccttccctcttttcattgggcttttcaaatatagcatagaggtttgctgcctttctttctgtcagccacccatcacctgcttcctggtctgacttcttctgtcccccttttcctgt

SEQ ID NO: 254480 - DNA, 724 bp, Homo sapiens
aaacttagttatgttcacacaacaaatgagtggcagagccaagatccgaatccaggcagtactgcaccagagactaggctctttaccccaccactaaactgcctctcacttaaagcaccacattatccagttaccaaaccagttcccccacattagctcatgtaagtcaggaatgagagactatacttaggcaagttgtaatttttaaaaattggtttcaggactggcaaggtggctaacacctgtaattccagcactttgggaggccaaggtgggaggattgcttgaggccaggagttcaagatgagtctgggcaacacagcaagatcccatccttgcaaaaataaaaatacattggctaggcatggtggcaagtacctgtagtcccagctacttgggaggctgaggtggggaagatagcttgagcccaggagtttgaggttgcagtgagctatgatcacaccactgcactccagactgggtgacattgtgaaaccttgtcatttaagaaaaaaaaagttggtattcttttcatatgtctgcatgactcacactgagaaatttaatttcactttgcctctctatccttagtttctttgatgtgctctccttccctcttttcattgggcttttcaaatatagcatagaggtttgctgcctttctttctgtcagccacccatcacctgcttcctggtctgacttcttctgtcccccttttcctgt

SEQ ID NO: 254481 - DNA, 397 bp, Homo sapiens
atgaagctagttatctgcttctttcttacaacattgccctgaaacttagcacctttcaacaacaaatactatctcacaatttgtggggaccagaaactggacacagtttagtggggtgcctcttcctcaaggtctttaggaggcttaggcctcataagaagctggacttctcaacagaagctggactggggaaggatcagctttaaactcactcatgtggaaattggcaagactttgtgtggcctgagagcccacgtttcttccatctattggcctgagcactccctcagttctttttatgtgggtctgtacatagagcatctcgtagcattggaatttgccttttcagtttgaggaatacagtacagaaatagataattaaacagaaaaacacaaa

SEQ ID NO: 254482 - DNA, 1161 bp, Homo sapiens
caaaatgtgaatatttttgtgtagttgagtgtcaccagagaccaggatgaagatgataaggctccagagccaacgtgggctgatgatctgcctgccactacctcatctgaggccaccaccacccccaggccactgctcagcacccctgtggatggggcagaggatcctagatgtttggaagccttgaagcctggaaactgtggtgaatatgtggttcgatggtattatgacaaacaggtcaactcttgtgcccgattttggttcagtggctgtaatggctcaggaaatagattcaacagtgaaaaggaatgtcaagaaacctgcattcaaggatgagcaagtctaccctcattcaattcaacagtgcaaaaaagagcactcacggaagaaggagatggaagaatagccatcttggcagaaataatgatatgtataatttttttatttaattaaaattgtattatgtaatatttgatactacaaaagataatgcaacatgtttgtcaattttttttattatactttaagttttagggtacatgtgcacaaagtacaggtttgttacatatgtattcatgtgccatgttggtgtgctgcacccattaactcgtcatttaacattaggtatatttcctaatgctatccctccccactcccccgccaccccacaacaggccctggtgtgtgatgttccccttcctgtgtccatgtgttctcattgttcaactcccacctatgagtgagaacatgcggtgtttggttttttgtccttgtgacagtttgctgagaatgatggtttccagcttcatccatgtccctacaaaggacatgaactcatcattttttatggctgcatagtattctgtggtgtatatgtaacatgcttgtcaatttaaaaacatgataagatgaacaccagtgaacacatcacctagagaatgaagcaaacatcaaaaattctattgcagcttcccgtgtggccctccgccatcccagctctctattccatgccagggatatcccattttgaacttcgtatttaccatgtcaatgtgctgttgacatttataggtaattttacatgtaaaactctatatatctctatgtgttgccaaacaataaatatttagccttgcttattttacagttttacaaaaaagg

SEQ ID NO: 254483 - DNA, 421 bp, Homo sapiens
caaaatgtgaatatttttgtgtagttgagtgtcaccagagaccaggatgaagatgataaggctccagagccaacgtgggctgatgatctgcctgccactacctcatctgaggccaccaccacccccaggccactgctcagcacccctgtggatggggcagaggatcctagatgtttggaagccttgaagcctggaaactgtggtgaatatgtggttcgatggtattatgacaaacaggtcaactcttgtgcccgattttggttcagtggctgtaatggctcaggaaatagattcaacagtgaaaaggaatgtcaagaaacctgcattcaaggatgagcaagtaaattggcctgtctctatcaaaagcatagaactccctaatttccacatattcacccaatacaaatacagcactatattt

SEQ ID NO: 254484 - DNA, 585 bp, Homo sapiens
ggcagctctgagcagagcaaaggcaaatggaataaaattgaggaccaagtttctcttaccatatattgacacttggctctcaaggaaccatttttctgaaaattcggtcttcttttttcctcagtgtgaaactccaacctcaggccacccaagctgtgtgtttctttctctttagtgaaaaagttcctttgggctattgctttgtctgtacctttatgagttttgtgtgccttcttccacacagcttttttggcttcctgttttttcaactgcaaagtgggattgtgggaatggtttaacttccccattctaagggctcttcagaactatcacaaacaatatatttgttttcttgaaaacagctttaattgtaaacagtttactaatggtagaatagagatttggagaaccaaaacatcattgtgattggaaaatgttgaaagtacacagcaagcattcatgatctgactgcttacttctcctgccttgcctttctttgatttgccacatactttgatgtaaccatgagacactacatagagttaattgaatgtgccgtgcccctgtgtctttatttgtactact

SEQ ID NO: 254485 - DNA, 635 bp, Homo sapiens
catgactttgggctcagccatgtgacttctgctggccagtgatatacataagctaaaataacagcatgtgagttctgagcctggactttctaaagcctctaaggcatttttctgtttgtcctcttgcacctctgccatcacctaagaaaagcattccctgagagctacatgagatagagtcatccccactggtccacagaccttcaggggaaagtatatattttcatctagctgcagcagcctgaaacagaactgcctattcaaatccactctgatgagccaagccccaactgaaccacagacacaagagcaatactaaatgactgttgttttcagccacagactgatgggttatacagcaatggcaaaccaatgcagcattcttcacttcaaccccaccaatagcccccaaccctcagccctagttttgctccatggcaggatggaacaaatgcagcaccaatatggctcacaccatttcccaataagatgagtaagtcctttgagacttgacaaaaaataataattttcaatctatcttaaagttcttggcacagtggctcacacccgtaatcccaccactttgggaatccgaggcgggtggatcacttgaggccaggagttcgagactagcc

SEQ ID NO: 254486 - DNA, 485 bp, Homo sapiens
aaatttccgatgagatgcatttcttcctgcctgaatgtcttgaatgcctgctggatttgtctccctgctaagacactcacacttgcaaatctgtgcttttcaaggtggggagatgaaaataaaaagtctgtgagatgtatttctgggaggcctgaaaacaggaagcaaattggaaccacagcatgtggggcacggatgctggattctgggggatatttgcttatttggaaaggctgcaaacattccatcctacccactgctaggagctctgcactttgctaacgtcccatggaaaccaaggttctctttaggactcgacaggactgggttatttttctcagcttaaattgtttttatatggttatcctcagtactcttttctgttttgggatattttcatactttttattttttaaaaaccccagaatatcttgattttgaaaaggtacattcacccaaataaagtgcccagcgcatagaaaagg

SEQ ID NO: 254487 - DNA, 370 bp, Homo sapiens
gcgatggacaattatgttatgatagcttatgtagccgaatgtgatacatgccaaatgccatacgtaaatacttgactataaaaactgcccccctccgttccaaataagtgcatttattgcctctatgtgcaactgacagatgaccacaagcagttagaaacacattatgcttgagatgtcttaacctgttcccaaatgccttctgttttccaaaggagtggtcaagcccttgcccagagacctctattctggaagagtggtccaggtggggccgggcactgggcactgaattatgccagggcgcactttccacctgtgtccagtttcaattgcttctgtgcaataaaacaaagtgcttataaaacgaaaa

SEQ ID NO: 254488 - DNA, 700 bp, Homo sapiens
aacagaggcccaaaagtccctggtatcaactccagaaggggcgagacccgaacaagttccaaaccaggcccaaatagtatcccaaactcagtcccaaacacattctcacccccggcagcaggctgcaggcctccagctacacacacggccctgggcaactctcagtctggccacccattcgatgctgccagccccaagggtgtgggaggggggtctcagagtgtcccagggtactggccacacatgcccgacaccagggtcataaggtcctctcagcagagccactgcagcaccaaaggcatttctggaaggaggcaaggacgcgtcatctagatgtcaagccccagcgtgcgattctgtcacagttcaccccaccttcaccccgagacggaagacggaagagcttcgcacacaggcgggaagaggtcaggaccagtccagcctcactggcttcagaactggcctgggggctaccttgacccacaggaagggaagaggaacgtgctctgggcagggcaaggcaggacctgcagcacccacagaccagcagtaaaggacccccggaactttccaagtctagcacaaaacccagaagccacaaaggaaaatactggcagatttaaatgcatgaagtcaacattctttttgtagagctaaagaaaccataagcaaaattaaaagccaaatgcattctgggagg

SEQ ID NO: 254489 - DNA, 434 bp, Homo sapiens
ctgctgaattactttattattactttttctgacctgtggtacctaatatcatttaatgttaactcagtcgttaaggaaatgttgatataaaaatgttgttattacaataatagctaatgtttttattgaatgttttcgttcattttcattagctattgaataatagctaatgtttttattgaatacttatgcaaatattctggtatatattttctatatcttagctcatttaacttgcgtagcagctgtataaagaataatactgttatttatctttatttatgagtaaatgactgaattcctcagtttcctatctaagatattatttggtagagtccatatttgaactttgctctatttgactttaaacaaattataatctgtgtaagctctatgttttttttttgagtcttcagaataaaatttatttaatg

SEQ ID NO: 254490 - DNA, 401 bp, Homo sapiens
tgtattaaatgggttcttatataagggagtgaactattatttaatgattaaaatgataaatgtaaaatctatcaagcaacatggggaatgtattatactgagtaataataataataaaataataagtgaaggtgggtgcagtggctcacgcctctattcccagccctttgggaggccgaggcaggtggatcacttgaggttgggagttcgagaccagcctggccaacagggcaaaaccccatctctacaaaaaatagctgctgtggtggcactcatctgtaatcccagctacttgggaggctgaggcaggagaatcacttgaacccaggaggtggaggctgcagtgagccaagattgtgccactgcactccagcctgggtgacagagcgagactctgtctc

SEQ ID NO: 254491 - DNA, 430 bp, Homo sapiens
gtattagggcaagtttcagctgtctgtaacacaaaactccccacatctaacacacaaagtgtagctttctctcatgcagaattccagaggcaggcagtccaaagctagtaaaagtgactttactgttagggactcattctcccttatactaaaggagaagagaataaacgctggagaagaaaccaaaactcgaacacactgaatagtgctatttttctgctctcagatccttagaagccccctttaaaatgtctttaggacattttaggaaatcttgcattaaaccaatttaaacactctttctttctttatttcttcttctcttccccttctctctcccttccttccttccttcctttcttccttcttttctattagagacaaggtcttgccatgttgcctaggctggtctcaaactcctggactcaag

SEQ ID NO: 254492 - DNA, 425 bp, Homo sapiens
atgttccctggtttgcttatttcatgggatgctctcacgctctctgctccagccacgctgacctcaaacacccggggcatgctccttcaggctttgcactggctgttccctctggctgggccactctttccacggatgtctgcttgacccactgggctggctctctccttctccctgtggcctgacctccctgctttgattctgggacatggctgctccatccccagtgaacaggacaagcacacgcccgcgtgtgcgtgcgcacacacacacacacacatgaccctgccctgcctccagcattcggaatcctagttctgccctcttctgctctcccttttaacccatctcatcgtccacttacttaatatgcatgttgttcacctcccaccaccaggccaaggcagggatccttctagaacata

SEQ ID NO: 254493 - DNA, 397 bp, Homo sapiens
ataaaacccatgcacagatgtgagacttaacgatcaggaaaaatcatttcttctttaagacagaggtaagaagataagactatgtatcattatatattcatttagttatttttctttccacaaacaagtatttaggtgggacaagtattttttttttttttgcactgttttagagaatctaagagatcaaaaaatgtataattttctcatgacaagcctcctatttttctcatacagggaaccagtttttcaggttaactttggaatgccctggctgagaagaggggttcattcagatggttagcgggccctaaaattttattttttctttacaaatgtcatttgaaaatattaaagcatgaaggtagacactattatataatatgcaatttatttt

SEQ ID NO: 254494 - DNA, 585 bp, Homo sapiens
tggtttctttcaggtcattgggcccagaagctaatagaagatatggttcttgcccttggaaagaagctgactggtttggggaagaagatttgcatgtgtgaaaccacaacaaagtgtctaggaatgaagacaaatttgtgctaagtggtgtggagttgaccacaagccacaagggggtctatgtaggagggtacaggagagggacaggcccaccagggagtatcccagaggaagtgggaatagagctggattctgaaggatttggaaggagaagaaagaagcaaagtcttttaagggtaaagaaggacatgaacaaagtgggtggtggtgacaatatctctgcagagactgagggatggaaaacagaccggttcttcttcagacaatggaaaaactctctgctgagaaatacttgttggcaaaaacctttcaaagtccccattcttggatctgactcggcttcaccatttctctaaccaccagccaaatctaggcgctcttttcctcgtttccggattcttttttaaaattaaaaatttaaatttattaatttaaaacaaataataattgtgtttatttaagaga

SEQ ID NO: 254495 - DNA, 476 bp, Homo sapiens
caatcattccagccaagaagataatactttttaaactcttgtacgtactttgattaatacagattcaaaagaaacctgcagactgaattcatctgacaattcagaagaaattctcatccaaaactgtgtatgtgttagaatatatatgtgtgtatatatgtatatatataacattcacacacacattttcactttttctaatttcttcccatcaattaatatttataagcatattaatttgaaagtcaatctgagacagggatacaatttctagataagacaacacagatggtggcatgcattcttgcagactatttttatattgactctcttacagacaatctgttttatcagctttccaatgggtccacagtatgaagaactccaaaaaagaaacttccaagattctaaaaacacttggctgtaaacagacttagtgggcatagcttctccctttgccaagtctttaggatgca

SEQ ID NO: 254496 - DNA, 638 bp, Homo sapiens
tcctggacttttacccctgtttcctattctctagtccccctcctgaaattagtgctgatcagaacagaagtttgaagaaactacctgaggctggagaaagtagcaccagaaaagagcagaaggaacaatcctcagagtaccagccccaacaagataaaattcactatgtctgacattcaaaaaaagttatcaggcctgcaaagaaacaggaaaatgtgatccataatgaggagaaaaatcaaatcaataaaacagatcaagaattatacagaagatagaattggtagacagagacattaaaacagttcttataactgtattccacatgttcaagaagctagaggaaagattgaaaatgataagtagagtcatggaagttattttaaaagatctaagtctaacttctagagatgaaaaatatggtatttgatatgaaaaatacaatggataagattaacagcaaattaaacattgccaaaggaaagactaaataacttgaagacatagctataaaaacaataagaaatgaaacacatagagaaaaaagactttaaaaagagcacatcagcgagccttgagacaacatcaggtggcctaatatatgtgtaattagagaccccaaaggagaagggagggta

SEQ ID NO: 254497 - DNA, 659 bp, Homo sapiens
attcaatgattttttggggtgaatatttgggataatgacatttgtttgtcagctattccctttgattgatttaggtttgttaattctggtcttagcttaatgcttattttattaacacttctgtgtgtcagaagactgcttgtttcaaaacacattgaatagtttgctttgcaaataaaactatagtcctggaacggttttatgattttgatatcctaaaagtttctaatgagtgcagtagtagtttttgaccaggtaagcgaatatttggtggtatgttcatttgctggttcataagcttaggcacgtaggataagtttgtgaccataattatgccagtttcctagtttgagcggttaaaatgactttgcatttcaaacacagtatttgaatcattatacatgtgattcattagagagataatagtactgaggtagcatatgctggaacactttaaaaataagctttcagatatgtcccagtatcttttttgtcctggcaaatagaaattgttataataatactctttcaggatcctcttattaagtgccacctaataagtttaaaatgatctccaaaatgtcactaacacaaatagggaatataacagaactatacaagcctttgcctgtcctggaaaagtcactagagcaaatatt

SEQ ID NO: 254498 - DNA, 391 bp, Homo sapiens
gtggtggtttctgtgagtcaaaataaaagagctcattctcatcgcataagtggttttctgctactggtttttgcttgagaggcctggttcatctgctttctccagaactgtcctgtgccaggaaataacttaagccaaggcaagcatagagcctgttatcagacaagagagttaaaccaaagggatgtatacatggattattacatggagaaaccataatcagaatagtggtttaaagcatgaagtctgatgaaatgattgattgtctctgcagcagcttcttagcctcatgactcttagaaagttatttaacttctgtaagcttccgttttcccatatttaaaaagcatactctattgtgagactttaccattgtatatttgacccagca

SEQ ID NO: 254499 - DNA, 475 bp, Homo sapiens
ggatttactttttgataacagtcaaatcctatgactattgtgtaaaggtgagggacccagctaggcaattctgcttggggttaaaataataataaatgtacctgaaaataaggaggttgacttcttatacagcagctacacaccagctcctcaaacacacctacctcaggacctttgagcttaatgctctcactttgtggaatctttttatagcatgttctttttcactgatatgagttacaggtcacttaaaaaaggcctttcctgaacaccctaatggagagtggtccacaatcactctcaacaaccacatttgtctaaatcaatgtcatgcttgcttttttatcaactgttatcaccatttattaattttttgttatttttcatctcttcttctgacccatgctgtccaacacagtaaccagtagattaaaattccaattaattgtaattcagaaacttaaagaaaaaaatg

SEQ ID NO: 254500 - DNA, 163 bp, Homo sapiens
gtgtacaaaacaaatctttgagagtcaggggaattgaaataatttttggacagagacgagacaggcttagagatattgactgaggactaaagagtccctggctttgatttctggttgctgaattgtgctctagaaagcactactgcttaccctaagtccaact

SEQ ID NO: 254501 - DNA, 715 bp, Homo sapiens
ctacttgttataaaccacataatagtcatttgtcttcgaaagaatttttaaaaataaggacatttatatttacccacagatttgccatttctagtgttcctcatttttctagatttccatctgatatcattttccttctatttgaagtacttcttcctttaagatttcttagaatgcaagccttctggtgattaattatttcacattgtgtaaatctaaaacagtatttggttgcaggattttgttgttgttgttgtagtaaaagcacataacattacatttaccatcttaaccatttttaactgtgtagttcagtagtgttaagtgtattcacattgttatgcaacagatctctagaacttgcaacactgaaactctatacaatactaattcctcctccccatttcccccagcctttggtaaccatctttctactttatttctctaactttgactactttagatacctcgtatgagtggcattacacagtatttgtccttttgtgactgcttattttgcttatttcattttgtgtaatgtcctcaagtttcacttatgttgtagcatgtggaaagatttccttaatgctgcatagtatttcgttgtgggtattataccacattttctttattaatctgtcgagcggcattgcacccgcttccacctagtgggcctcttctgggcgcccactctcgatcactcggccgccctcct

SEQ ID NO: 254502 - DNA, 439 bp, Homo sapiens
cctcctgcaaattattaaaccactgtggtgattttctcatctaagaaaacaggttgttgctctggacattctcaaatatacttttccaggcttttatccacctggaataaccccatccacaccccatcaccaccatcacctttttatattctcattttcccaacatcatgctagagtcttgtattctccatgaggtcttactgtaacaacttaatcttttcttgtatccaaaaatctcatggaattctctgagttcttcattctggcagtgattagatattgcctcatgtaatataactaattcatgtgtgcctgccctatttctctaatatcagacagtttgtcttaatctttgtgtttatctgtcatcatcatcatacactctatatagcacttattgaatgaatgaatgaatttgtgcagagggaaatgactaagt

SEQ ID NO: 254503 - DNA, 307 bp, Homo sapiens
ccccaaccacatggaactctaagtccaattaaatttctctagtaaatttcccagtctcggatatgtgttcatcagcagcatgaaaatgaatacagctgggattacagatatgagccaacgtgtccagcattgactttattttcttagaaccactttaggttcacagcaaaattaaaaggtacagagaatgcccatgtaccacctctcctacactcaggcacagcctcctccactaccaacaccccccaccagagtggtacatttgtgacaatggatcaagctacatcgccacattatcatccccaca

SEQ ID NO: 254504 - DNA, 444 bp, Homo sapiens
ttttcctagttcttctgcaaagaattgaactgttacccctccctgcattctgttatccttttcagtgaggattccggaagagtctgagagaaggctggaagaaggctggagggtggtgtcatgggatgcatgtgcagattcagaagtggcaggtgcagaagaagagcatccaggacaagcagctgtctctatgccacatcatttggcaccctgcgatgtcaccttgcttttcaggagtgcagccggttgtggacattttggaattgttttgcttttggaatgggtgttggggtgaagcattcttctgctgggttttcagatgtagctctaactagccacatcacttcagccaagtcatttctctctgggacccgtcatcatcactcataataataccatatgtgtggaggttgagggcaaggaagtaaaacagatgtgtctgta

SEQ ID NO: 254505 - DNA, 515 bp, Homo sapiens
cctattctaggcacttaaggaaacttcagagaacaaaatagatgcccctgtggtgcttatgttccagcaagaagggtcagacacatggaaccaacccaaatgcccatcaatgatagactggataaagaaaatgtggcacatacacaccatggaatactatgcagccataaaaaggaatgagatcatgtcctttgcagggacatggatgaagccaggaaccatcatcctcagcaaactaacacaggaacagaaaaccaaacactgcatggtctccctcataagtgggagctgaacaatgagaaccacatggacacagggagggggacaacacacaccagggcctgttgaaggggggcaaagttagggagagcatcagggcaaatagctaatgcatgcagtgcttaatacctaggtgacgggttgatgggtgcagcaaaccaccaatgcacacgtttaccgatgtaacaaacctgcacattctgcacacgtatcccagaacttaaagtaaaattaaa

SEQ ID NO: 254506 - DNA, 338 bp, Homo sapiens
attatgtttgttttgcatccacagagttctgctctctgaggatctaacatgtacacccagctctcttccacagggtggaaatagagaacacagaagggggaagacccacataatcactgtgtttaagtgtaatgtgctttgaaggaatgtgttactccaaaggagaggtacaagctattttgtcagtcagtagagactgaaccaaataaagtaacttggccaggccatgaattatagctgggatgggggatattattttcacacactgtgatttgtatgtatgcatataaacacatccacaggtatatatacacacacgaagcatgaacgtagtgtaa

SEQ ID NO: 254507 - DNA, 484 bp, Homo sapiens
attagataaactctaaaatctcactaagttcactatcactaacactgatgcaggatttttcttcttggtcattttgcaagacggggacccccggccagtgacactccacccgggcctcgctcggccacgctggcatgccccagctcacctatgttatagcttgtacctgcattcggtggttcccgagctctggtactgcacccaagaagaataaggatacgctgggcattgaagtggtaaggagggcgaagaagagttttattgagcaatgaaaacggctttcagcggagaagggatgcatggttggtccccctacgcaaaggcagtgcaggaaccaagggcgggtaatatcagaagaaaatcgtgcgatgaaaatgaagatcagaagcgcatactgaacaagcaactgactttgttaatctcttgaaaaatagcatcaagggggatgtttttaaattaaagaagaatgattttgcttttcaaa

SEQ ID NO: 254508 - DNA, 339 bp, Homo sapiens
aataattgatgctaccttattacataaaatagagcatttataggacggtgataaaattaaagcaagcatttcttagtgaaacaaaccattgttcctgattgttcatcaggtaatttatcataaaattatttttcctttatacacatgtggagttatagacatttatgttgaatgctttaaaattgtctttagttttctctcatattgccttagtttgtagtaatttagagtaattagagtaatatgagtaattagagtaatttctcatgttgtcttagtttgattacttataaattattcagtactttctttcattaaaacattattaataatatgata

SEQ ID NO: 254509 - DNA, 867 bp, Homo sapiens
aagttttccatatcatacacactcttcttttaaatcatcagtgttaacaggtacacttgctagcagatagataaaactatggtttaaatagcctcctaatgtgcagttttaaacattaagtctgtaatagctaaacctagttttgccattgcttcaggaagtgacagctaaaactaagacagagatgtatcaaaacatggatgacgaaatgaagagagagcacttggctgcagaacagcgcatggtccacagaatccaaaggattatgatggaatgccacagagagaaggtcgaagctgtggagaaagccagggctgaagaaagacacatcgcccaggaagcaatccaggcccagaaaagcaaagccgtggaggaaattgtgaatactggtgtcacagttattaaggatgagaagaccagtgtggcccgactgatgagggaaaaagaacatgaaatgagcatcctctatggcatagctcagaggcagaggcaagaagaggtacaggaagtgcttcaagaagcagagaaaacacatcaggccactcttggcaatatgatggataaactggctaacacccagggggagctgctgtctatagcaaaacaactgggaatcatgacaaattggaaagatttcctagaggaggaattacaggaaaccaggatggcatttcaaaaatacatcaattatacctttcctaagctttcaccaggacatgcagattttattctgccagaaagaaagaaaacaccttctaatcttgttattaaggagaacaaaacaactcttgattagaagtcttcagttgaaattccactacaaaagacatcattccagactaaataaatttactcaaaaaccaaaaa

SEQ ID NO: 254510 - DNA, 444 bp, Homo sapiens
cctccattggccaacagatcaagtctgcacaccgcagcctggctgcgagggtccttttcatccagcctcattcatcagtgttcttgtgagcatctactctgggttaggcccagacctcctgggttaatcagattgaacaaaggggtgtaatagagaaccaaagggccaggtgcggtggctcacgcctgtaatcccaccactttgggaggccaaggcaggcagatcacgaggtcaggagattgagaccatcctggctagcacagtgaaaccctgtctctactaaaaatacaaaaaattagccacgcatgttggcgggcgcctgtagtcccagctgctcggtaggctgaggcaggagaatggcgtgaaccagggaggcggagcttgcagtgagacgagatcacaccactgcagtccagcctgggcgacagagcgagattccgtctc

SEQ ID NO: 254511 - DNA, 629 bp, Homo sapiens
tactataaatatttaggacgggaaggcatatggtttaagccaactccctgccacactcaatgtgtagttttcatgttttaaactatcaatgctcaatcattactgttgtgctggcagtcctttcttttgtgtatgtgagtttctccctattaaataaaccctctcttttggaagaattctcatggcaatgactataattacaacccaaagctgagctgtaaaatgcagtgatatgacagcttttgtgatagaaagggtggagaaacaatgaaagcttataattttctttgagatgtctcaaagtctgacagcagccccacccttatgatgtaaatctgcagtgacctaaagtttcaggaaagatgaagctagagagacatgccaagtcaccgccacattgaccaccagcaaacaagcaagaaaagattcagcataatgctgaattctctatgacttcttcaaatagtctggaatggtatttcctgacatttccgaatatgagggttctttttaatgtcaaaactttttgttccttacttgagatgagctgttctttttatatccatcatttgaggaaatatatggtgataatatgcaattaatttattactttgaaataagctatttac

SEQ ID NO: 254512 - DNA, 422 bp, Homo sapiens
gattgatggctgggactgggtggggctgagacagcggtcagagatgagagaggagaaggaacgagactccctccgcagtgctcctcaaccatgtcctggagctgagcttgttgttttgtctcacacctcttaaaaaaaaaaccagaggacaggagtgtggattcccgttgaccaaggctgtcaggtagaggagtgtttctcaggggttgagccttcccccagccagactggacctagctgctccctcctctctgctccatagaacactggacatcgattgtagcacctgtcatgtcacatttttctctggcgtactgttcgtttttcttgtaaatacaaaggtgatacatgcttattgtagaaaatttggaaaatatagacatgtatgaatgataaaataaaggtctcctgtaattgcccac

SEQ ID NO: 254513 - DNA, 396 bp, Homo sapiens
gcattctattatgttatgcaaattcaaataatgggcttttttatgtgaactacatccgtttacatcctcattatcccaaggtttcggtattcggccaggtaatgacagctgtgaaaacagacttggaaacttactgctatcttcattaatttactgtaggtaactgacctagtcaaacatccctgaatatgatataaaattcacagactgtgtttacccgtgaatccggctgaattccagctctgcgtttctcatcccatattaaacatgacgacagatgcaccaacagaggttactggggaacctctcccaggcattgtcttgcagagataaagttctgtaattaagctgctgttcaccaatgtggaaataatacagtgtattggaaaacggtaa

SEQ ID NO: 254514 - DNA, 671 bp, Homo sapiens
agagctttttatttttaattaaagtcttcagaggatcactttatattatgggattcaaattctgatttttatgaaaatgtcgtaggtcagttgattagttgatacgtatttttgcactgattttttttttaactatgtcttctttcagtgataactggctttatttaagttggtaacctatactgagtatatgtttacaaagtggatatggaaacttgatgttgtgaaatcagacctcatatatttttgtttgaagcattcaactttctatgttttttataatgaaatatttttttctatgaaatatttttgtgctttgttcttaaacgaaaatgccagcacttgggattattatagtttagtgtgaagattattcttatgtggcacagcataactgagatgttatattttaaaatatgatataattcctagtttcattatttttctgtaaatactaaaatttttctattagaaaatcttaaaattcctgacttttgagagtactgtggagattgttgaaatacatttttgataataataaaatgaaaatcttttaagggaccatgtaaatatagaagttggattaatatgtgaattatttttatacatttttaaaaaccatttgtcctaagtatacactttaaaataaatatataaaaagtgttttcaag

SEQ ID NO: 254515 - DNA, 434 bp, Homo sapiens
agctttgttatctgtggagtaaatgacagagaagctgccttacagggctgaaaaagaactatatgacataatggctgtaaagtgtttaacaaagtgcttggttccaagtctgcataactacttgccattattatgaccatcactgatatgagatgcaggaatcattcatgagttcagggcctaatgtcccctccataccttgaacctatttctatggcagcccctgtaaccctgtattgaggcattcatttagccagcacccatcagacagtggtcttctaccaggaatgggctatgaactcaagctcaatgtaggaattaaagacaccaagagaagtgtattaaggattacagtcagccagaaagagaaacacagaaagagggagtgtgggagagagaaagaaaatgctaattagaatacctgaattcatttg

SEQ ID NO: 254516 - DNA, 1472 bp, Homo sapiens
ctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttctaaaatggatgtgtagtttattttgccttttgtaaagctcttttggctattgtaacttaacaaataaaatcataattgtgtgcatctctgagttcttga

SEQ ID NO: 254517 - DNA, 1375 bp, Homo sapiens
ctctcccacactggttttatttgtaatttgcatttatatactcattttaaatgacttttcagtgtttttcatagtttataatctgatggctaactaactttcaaaacagcttttaactaagtttgttgtaggagaaatgactgcggtaatttccagttctataatgtttcatgttgagccaaaagagtatatcttgcactttaaaaacgctgcgtcctattccatttgaatgtaaattcttaaaagttgagaccaattgtaaccagtttaactcattttagatgacctttttttcttataatatttgcaagtgacaagtttgaaaacaaagcaagatcagtgcagagaagccacatgacatgttgggtgacagattggtcatttatttaaataaagttaatacagattaaatttgtttcaagagctattgaattttcaaattttcagtgtatttataacttttaagaacatgaagtattagcttaatatagttttctctgttggtttcttcctcaagtttgcattgttttcttttgttaaaattagagatttctttttattttccagttatagtaatactagctgtcagcttaaaccctctgtaatagaacatggaaacagacacataaagacattagctgaaaaaatagagtgaaaatcaactattttttactcccgctaatttcaatcaatcgttttcaaaagcgcacgagattcactcattggatttatgcagtgccctgtctgtataaaaactcttaagagttcctttatatcatattcttcagagccaacatttgtcctcaaagcaacgtttcccacctccttttactgagtactgaaaaagttttagcaaagtcacagattaggttgaatttcaaaatatatgtactttaaaaagttctgatttccaaatataataaagttaaaattaagtatatactttaggaagttaccaataacttccatcaaagcagagtaggatatatggtaacattaattttcggtcatttcaaatgaggtatatttcttattagggaaattaaagtccctatatttattatatattttttccttattaacagagtattaatctagtaaaaaataacccagcagtaaataataaagaaattactgaatgagaggataatgaatctgaatcatagcaggaatttgcaatattaattatggttagctatttttctctcattgatttttgtgccacttgaatggaacagaagcaagccttatgttttggaaggtctgcggtaaaatgctgtgactgtttactttcaattgcattgtgtgttgcctgtgactgctttcaaacgctagagggggcctctgatttaaagaaataaaaaggacttttcta

SEQ ID NO: 254518 - DNA, 424 bp, Homo sapiens
ggaaattgtccattttctctaggttttctagtttctgtacatagaggtattcatagcagactctgatgatcttttttgttctgtagtatcagttttaatgtcacttttatcatttctgattgtatttatttgaatcttctttcttttgtttcttagttaatctacctactgtctctgaattttgtttagtctttcaaagaaccaatgttttctttcattgattctttgtattattctttatctcaatctcatttttgtcttctctgattgttatttcttttcttctgatagcttagggtctagtttgttcttgtttcatttttctagtcattgagttgtaatgttagattgttaattcgagatctttctatctttttgatataggcatttaatgctataaactttattcttagcacagctttag

SEQ ID NO: 254519 - DNA, 336 bp, Homo sapiens
tgcttctccccctcccttatttttcctttatctgcctggaagatccttctcaacttccaagtgtcaacccaaatactgacttcctataaaatcatccccaatcccaaattcctgtcccccaaactaaaataagcactatgtttttaatagcaccttagacatgcttctcttctagaacccattaccttgtgttgtaatatttctgtgtttatctccccactagactgtgagctccttgagggcaagtcttaacttttattcatctctggatctctagaacttggaacagtgcccagacacaggaggtgctcaataaatgttggttgaatgtatgaa

SEQ ID NO: 254520 - DNA, 496 bp, Homo sapiens
cagtccctctgtgttccgtgtgctggaggcctggctctgcccaccaccctcaggtcttcttgcctcttcccttgtgctgctgtgaggggttgggcttgtgggaaagtgtccctgcagcacagtgccctgggtattgtggaggtcgggaatcaacctgatttgtgcaggccgaggcccgggggcagggcctgaggggtgggatcactgggcctggcccaggcctcctgcgcccctttgctgcccccatcacctacgttgcttgccccttgggcagggcgtcctcactgcctctggaggctgcgatgggcagatctctcccccagggctgcacctgcgggggctacgaaggtccccaaaagcggtgaccctcctgcccccaaatttagtccctttttctgcctggggctcccttccgaaatctcacctctgtgaagctgtggcagggttgtctgtttaggggaaggacgtctcccaccctacaggcatctcagaagac

SEQ ID NO: 254521 - DNA, 797 bp, Homo sapiens
tgccctcacactgctcttgatttctacccttacctgggaagtctctacttgatgtctgtcttaggctaagaaaaagagaagagaaagggaatgagtattagcatctggattctggggctgcttcttggcctctgtgagaatccactgtttcacagcaatcacagcctagaaaactagactttatggagtaaacaataggtatcattctgacctgggcttcaccacaatcacccactgaacactcccaagagaaggttgttaccatttatttatgaaaataccaaactatgtgatacatactctattagaagtattatggaaaaatagagaatatgtctacctggccagagaatagaggatctggatcacaaaaaaagtacaaatatttaagcagagacttaggacaaatgggcattcaacaatttaggacacatgggcattctacaatttccagagtgaagtaaacattctaggcagataaatcacacatgtgctgtcttaggaatgtgagcttattttgaaagcatccctatcaaatacgtgctaaaacttgtgacaagttcccattcctagagtacttacaggatacacttaagtgactgaagatgcaagagaaatatatatttgtgtatggatatagcattttatcattaattgagagattataaagctaatgagcttttctttgcagagggagtatttgttaggatgaaatggggagagatgtttcaaacaccaagtttatcttataggttaagttcttacaatgaatccatgcacttaagtatttttcctct

SEQ ID NO: 254522 - DNA, 451 bp, Homo sapiens
atctcttttattctccattaaaagatattatttcctttataattcatttttattccttatttgtttagtgccttaagtctgtttctgtacagcttggagactgtaacttggaaaaatgtagatatattcattatatactatctcacttaaatgtgaattctgaagaagtttttctgagaaaataaattcgtcttgtttgagtgttccttctctgtctgctgtattctaccagggggacagaggaaagaagggcagagaaattctttcctggatttcatgaaatcactgaggccagagcaacagatcatttaacttttctttatcccgtgtatgtattactgaaaaaaatggtacataatagaatttgagtttatttttatctgacttcaggtacatagggacacttcctgtttaaaagaactctgcattgaattgtgcctttcataaagca

SEQ ID NO: 254523 - DNA, 414 bp, Homo sapiens
tctcatacttaaatgttttcagaatcacggaatacatctaatacaatctactcttaatgtctgtgttacgacttagatttcttaggagtatctattatactttgccttttgtcttctagatactattggatcaccttattctgatatttggcacttcgttgattggtagaaaaatcgttttggccaggcgcggtcgtcacgcctgtaatcccagcactttgggaggctgaggagggcggatcattaggtcaggagatcaagaccatcctggctaacacggtgaaaccccatctctactaaaaatacaaaaaattagccgagagtggtggtgggtgcctgtagtctcagctactcgggaggctgaggcaggagaatggcgtgaacctgggaggtggagcttgcagtgagctgaga

SEQ ID NO: 254524 - DNA, 308 bp, Homo sapiens
aataaattcccctttgaggctttgtggttaacgtaagttgggtttctgtcacttactgcccaaacgatcctggctgacacagacctgcttagcatcctatctacacagacctccaacacaaactcctcttgtagctgcatccctgcctttgaatccagatctgaattggttgtgagaatagaagaagctgaacagcctcttggttaatttccgccataaccagtccctgctttgtatcccattttcaataaccgaggccctgtctccttatcctggctcttagtccttgcagccccagtagggacagc

SEQ ID NO: 254525 - DNA, 423 bp, Homo sapiens
accttcccctgggtccctcctataacacgtgggaattctgggagacacaattcaagttgagacttggtggggacacagccaaaccatatcaaccctaaagacaaagtctgactatcaacaatccccggttcaaaagccttcagtagttttttaattaatttccaaaatctgaccatcagcaatccctggttcaaaagccttcagtggttttttaataaatttccttctccctaatcatcacctgtaagatcaagccccaactccttggaaagcatgttccaactgtgaggatctccttgacctaacttgaggaccctgtctcagccacttgccttagatgaggccaactgagtgaggctctgtatcctctgagactccatagtagctttaccccttatcaaaacaggctaggattctttgttt

SEQ ID NO: 254526 - DNA, 637 bp, Homo sapiens
aaccctatcttgaaaagattttcatattgctgttcttctctaaaattacctctttatttacttttctctgactttttactctttggcgcctcccattttcttcttattccgaattcatttgggatttggaatttaaatacatttcttgaggtgtgcactggaacaaacccattgtttgtattaggcagcatggttgccaccatactccctggctggaaactgcgatttagttgctggcagctcccaccccttttattgctggggaagaaggtgaatcctggctcctggtccatgggtccctggattccctttggtgtcagttccccagaatgatacaaaatcacatcttcattgggacatctgcttttcactccctttctcttcatacacaaagaggagaaaaaaggctgactttaggaggcaaaggtattcttgaggaaatcattttattctgacttctgtccttattgtcaagactatctgaaggttccttcagttttaacttcacagatctatcccaactagtccccattttaaagtcctgaagtataatggaatcatggtagaaaggaacttcaaaatccatgtttacttcaattctctcatctgtatgtgaaagctctgtgtaacctcccta

SEQ ID NO: 254527 - DNA, 409 bp, Homo sapiens
cagccttgtttaaactcgggttttcagtgcaggaggcaagtaggaaggaacagagttgagaaaaggtaaaaaatatacatatgccatacaacttgagattaaggaaagagaaaacatataaaagggaaggtaattttctgagatggaataaactgagttagatttattttaatttatttaattagacagcaagcatcctgcctcgccaacagagggcgcctacggcccagtacagctactgccctgataatcacagtttaggggcctcattcaatatgaaggggcctcattcaatatgaaacctaactgtgttcgatgtataacttggaagggctctgtgtttagtaaaactaagtagtcaataacatttcaaagcagtgcgttaccaaaggcgaagggatagattaaa

SEQ ID NO: 254528 - DNA, 297 bp, Homo sapiens
aatgctaaaatctataactgagctctaggtttaatatataaatcagagtgggaaaactaatggtgttaagaaacctggatttaattcacagatcagaagaggcattgatggaggaaaaataaaaagaagtcaggtttggttttcatgctagaaatgagttgatgatgaaatagttaacagagatgccccaacaagtggggcattaggggtggaagcattaacagaagtaggcataaagagaaaactgaacagtccaggcacagtggctcacgcctgtaatcccaacactttgggagg

SEQ ID NO: 254529 - DNA, 317 bp, Homo sapiens
ccagaattggtacctttgattgcagtctctgaccagcgccaggcaaggacattgaagttacaagagagcttgagggatgaatactggtaatgggagagacactggcctagggatcagaggtcccagctccatccctgcattgcctggtaactgctgcaatgcaagtggtttctgggcaacaaggcatccagcaagctggacaaagcccttagtcagatgtcaatcccagaagggtccatgaagaccattacttaagttttgtcatttaactgcgtttttgggatgaaaataaagtcacagtggtatctatcatctga

SEQ ID NO: 254530 - DNA, 982 bp, Homo sapiens
caggaaactaagagttaaaggtctgccctctggacactcagacttgcctgccccatacgacttaacaggcaaatcaggccaacgtaacttgcctaaagagagcttagcattgaaatcaggacaactcccttgcatagggagagttttgcattgaaatcagtcttcccataaagccagtaattaccccatactttgtatgtcttacaggattttcttactatggtctgactaaactcatttagggcatgaaaatggctttttaaaaatagataccaggtgtacatggtataagatttaaaagttgcaaaagtaatttcccagttaccctcctccaaggcaatcactagtatcaggtttttttttgttttcttaggaagccattaaatacacacaatcgcatataagcatagtatcccacactcatttaatatattttggagatggttctacatcagggcacagagttgtaagttgtccctttttctttttttttttttttctaagatagggtcttgttctgttgcccaggaacactcaaacgtgacaggcaaaatcagtaagctcagcctttctaatagacaaggcagacttgaaaaagcaagtccagccaggttgacccatctaccggctccttaaagatgtatcactcagggaacaggtgtttactggcccactaaactacatttagaacaacccaactgactaaggagagctgacagtgatcgtggagaccgcagttcaaaccccaggtttataaatgaggatcctgaggcctgagatgcctaaatgggcaactggcccccaggtctgacctaactgagcagaatcccaggggtgggtggttgtcacctggtcaacctaacacaaattagatttcaagctagactttcctactgcaatttctatcacttaaaaattcattaaatattaggaattactttggaaactgacccttagagaactgttgtgtgctattcaagtc

SEQ ID NO: 254531 - DNA, 932 bp, Homo sapiens
caggaaactaagagttaaaggtctgccctctggacactcagacttgcctgccccatacgacttaacaggcaaatcaggccaacgtaacttgcctaaagagagcttagcattgaaatcaggacaactcccttgcatagggagagttttgcattgaaatcagtcttcccataaagccagtaattaccccatactttgtatgtcttacaggattttcttactatggtctgactaaactcatttagggcatgaaaatggctttttaaaaatagataccaggtgtacatggtataagatttaaaagttgcaaaagtaatttcccagttaccctcctccaaggcaatcactagtatcaggtttttttttgttttcttaggaagccattaaatacacacaatcgcatataagcatagtatcccacactcatttaatatattttggagatggttctacatcagggcacagagttgtaagttgtccctttttctttttttttttttttctaagatagggtcttgttctgttgcccaggctggagtgcagtggcagaatcacagctcactgcagcctcaacctcctgggctcaagcaatcttcccacctcagcctcctgaatagctgagattacaggcatgtgccactatgcctggctaatattttacttttttttttttttttttgtacagacagggtctcactatgttgcccaggctggtctcaagcaatcctccggcttcagcctcccaaggtggatcgtaaggtcaggagttcaagaccagcctggccaacatggtgaaaccctgtctctactaaaaatacaaaaaattagccgggcgtggtagcgggagcctataatctcagctactccagaggctgaggcaagagaatcgcttgaacccaggaggcggaggttatggtgacccaagatcgctccaa

SEQ ID NO: 254532 - DNA, 1394 bp, Homo sapiens
tcccccccgccatgttcgcctaaccaaccaacctgttccaccccccccggttttggaccccccctctcccgttcttgcaccttacccattctcataactggtccgccccaacaagtttaacttttcgccccccccccacatttttttttttttttttttggaaaggtttccacccaggcccacgaggttaaagtgccccttcctgttttttttttcaaaaaagttcctttcctttgcgccaagcttgatccattgccaaaatcacacgtccctgcaacctcaaaccccctggggcaaaccaattttcccccccccgcctccctgatactggatttcacgcaatgcccccaacccggccaaaaatttaaccttttttttttttttttttgtacagacagggtctcactatgttgcccaggctggtctcaagcaatcctccggcttcagcctcccaaggtgctgggattacaggcgtgagccactgcacccagactttgcctcactatttttaatgactggacattatttcattacacagatgtactgaaacagtattacttaataacataattatttaatcagtcccccatctgacttttgtttctttttgccattacaaatattgctataatgaatatccttgtatataaatcatttcataaatgtgtgagggtatccctaagataaatacttaaaagtggagttgctgggtcaaagagtatatactgccaaatagccctacatagagactgtaccttttacactcgcaccagcagtgtgagcgtgcatttccccatgcctttcccaactcatgtgtccttcacaccttgtatcatattggcacagggtacccactcaataaatacacattaactgcttatacaaggcctcctacattaattccaggatcctcatgcctcaaccttctgagcagccggggccacaggtacgcccggtctccaaaaaaaaaaaaaaaacaaaaaaacaaaaacaactttcgtcgcgcgccggctcctcggcgcccctgagaaagacttttcttataaaccccttccggttggggccgcgcggggcccccagttaggcgacaggtcaaccacttttgcgcaatgagcggtgtctcccataaggggagaactccggggccagtagaaaatagggcgccagtggaagtttcctctctcacaccccaatattaaaaagacgcggccccgggggggggcaaactcgcgagcagcccgtttttctagagacacaaactctccaaagtagcgagagtgtctaagagagggacccatataacggggggcctcttacttccacaccgaggggagtgccccaaaggagaggaggccccgaatatttctaaatatttacccccccgcccgcgttgg

SEQ ID NO: 254533 - DNA, 381 bp, Homo sapiens
tggagttgctgggtcaaagagtatatactgccaaatagccctacatagagactgtaccttttacactcgcaccagcagtgtgagcgtgcatttccccatgcctttcccaactcatgtgtccttcacaccttgtatcatattggcacagggtacccactcaataaatacacattaactgcttatacaaggcctcctacattaattccaggatcatttcaaaattgggcccttcccactatctcttaacaataaaattgaggccaaagaaaggaataaaggccgggcgccgtggctcaagcctgtaatcccagcactttgggaggccgaggcaggtggatcgtaaggtcaggagttcaagaccagcctggccaacatggtgaa

SEQ ID NO: 254534 - DNA, 459 bp, Homo sapiens
taaaagttgaaataaaatgtttttagaatatgtattccacagggaacttagtagaggagggagctgtggttgcagagaagtagctgtggggaagaatgagtaagaaacacaccaagagcaagtaatttccctctggggatgcctaaattctgaaaagttatcagctaatactgacaaagtaaagcctgcatcacgaagaagaggatgaacaactgtatcaaggactttctaagagatgtacatctccacattcaaaatgtcctgtgcatgaagtgagcactcagccttggtgagtcacccacaaggaaggctaagaggaggtggtaggaggataaagcccaaattcctgggagcacccgggactgttttgtgatcctccactgtttttctcactggttgtagttggaggctctttgaattcctcccgtgacctagatgatataaatcagtgttttcaag

SEQ ID NO: 254535 - DNA, 299 bp, Homo sapiens
gatgatcagagttaaatattgaaccaaccaagagaataaggaggaaaaaaactgttttctcagcagagaaagacagtatcttcaatcaaatgatcaatccatggatcttgatgtatttatgctcatgtttatgtttatacaacactaaattgatctttttagtgtaaaattctggctttaaaaatgttttcatttggtattcacttgctattatgtatttaagtataatcttagttgcttccatggaatttcaattaaacaatataatcaccagacattaaaaaatcaaaataacctat

SEQ ID NO: 254536 - DNA, 395 bp, Homo sapiens
gtctcagctacttaggaggctgaggtgggagaattgcttgaacccgggaggcggaggttgcagtgagccgagattacgccactgcactccagcttggggcacagagcaagactgtctcaaaaaacaacaaaaagaacaacaacaacaaaaccttttattttgaagggaagaaaacgtgttcagtttgatagcacatttatgagtagagtgtagactgtcaggaatatttagctttttaaaaaagattattcctacagctgaggaaaaaaaaactttctcccactcttgatgtgaaaattactaggtgatttgcatgtgagaataattttactgtagcatctgagaagtggtctgaatgaagaggtgagcccagttagttaccaggcaacaggtgg

SEQ ID NO: 254537 - DNA, 211 bp, Homo sapiens
acccggccctcattttagcttaattacctctttaaagacctcctctccaaatacagccacattctgagatactgggaattaggccttcctatgaattttaggaggggtcagttcagcctgtaatacttgccagcacttggtaagatcaactgttgtgattccagcctttctattaggtgtgtaatggcatctccttaatttgcttctccct

SEQ ID NO: 254538 - DNA, 170 bp, Homo sapiens
ctggcaccctggcacgtgtcgcatcctctatgctggcaccctggcacgtgtcacaacctctgtttagtctagtcacaacctaggactgtaagccagtgttggcttcttttgatcacactttctgggagtgtgtgatgaacgaaaataaagaatttatcatagtgtctggt

SEQ ID NO: 254539 - DNA, 329 bp, Homo sapiens
tagacagagtcttgctctgtcgcccaggctgaagtgcagtggtgcgatcttggctcactgcaacctccgcctcctgggttcaagcaattctcctgcttcaaccttccgagtagctgggattacagggacacgccaccatacctggctactttttctatttttagtagagacagctgattcacctgcctcggcctcccaaagtgctggaattacaggcatcagccactgtgcccggcccacagttcttttctcagcccttcctggagaagcaaagagcctctcattttagttctagagtcatttaccagatgatcctcaaattctctttt

SEQ ID NO: 254540 - DNA, 214 bp, Homo sapiens
ctagacatacagtaagtacttaatggatatttgaatgattgaatatcttgaaatgttgaaatgtaaggtgtgcacagtgatcttcaacttaacaaacacttacgttctcctttataaaatgcatagtaaaccactaacgttagctgttttaataaaagttttcagttataagtttagtaaatattaataaatggatacacattcaaaatacttt

SEQ ID NO: 254541 - DNA, 345 bp, Homo sapiens
gttacatggcaaaagattttgtgtttttggcatagtgccctgtcatagactttttggaaaattaagcaaatcacatttaatagattcaaagttgttaactttggaatctgttcagtaggctgatatacaatcaacccttgaacaaaacagggtttaggggcaccaaccccctgtgcagtcaaaaatccatgtgtaacttttgactcccccaaaacttagctactgatagcctactgttgatcagaagccttacccataatataaacaattgattaatgcatattttgtatgttataatattaaatactgtattcttagaataaaataagctagagaaaacattta

SEQ ID NO: 254542 - DNA, 159 bp, Homo sapiens
cctttcttccccatcaactggctacattttcttttctgcctatcttggacgctttgtcccataactcctttgtgccgacttctctcatggttcttatccccccaccatcccaccctgaggccctttcagtgactcttgatggcaagtggctgttctcat

SEQ ID NO: 254543 - DNA, 403 bp, Homo sapiens
caattcacttaatctctttgatcttttccatcttattaaaaataatgatactaacaagaatcccatgctattgtgagactcaaaaacaaaatacgcatcatgaaagctgggtgaagcataattttaataatttatttgaatatgcatacatgatttcatcaaggtatttgcaaaaaaaaaaaaaaaagctacatgcactgacctcatgtttctaattttaaaagtttcttatgggtttaaatgcatcttccaaaattcctatgttaagtcccaattcccagtacctcaaatacctaagtatatttggagatagggtctttaaaaaaggttactgagttaaaatgaaacattgaaagtggggccctaatccaatatgattgatacccttataagaagagagaga

SEQ ID NO: 254544 - DNA, 521 bp, Homo sapiens
tgactgaagaactaaaaatacataaatgaattaagtaattataaacataaatttcctgtagctccaacatgactttgatctgagtaatagtgttgtgaaatagattactacatgattttcattgcttttatattatatatagtaattaatattcagaatagttgattaactttcttaagtgtcacataatttaaaaatgaaattgctgtttgccccagatatgtttttctgtgttctttttaaatttcagtgaaattttcttatactcccttcattaaatctattatctggtttctaaacctttacctatttaatgtctcttttcctttctttctaaaaagtaactggttaaactacagttttgtcatttatgaaattttttctgttattattgtagggatagtcaatattatcattttaaggatagttaaaacttattttgcaattaatacgtattttacagtacactaatatgcatatatgttgtattttattaaaatattaaaatgttttttaaacaa

SEQ ID NO: 254545 - DNA, 514 bp, Homo sapiens
tcaaagaaccagcacagaatttcctataaggctgttgcaatttttcccactctatgtctctaccatgtggggtggaggtggtattggaggactactaatttgtgcttttcatgcgaatacctaaaagatagcagtggattaggaggaagcagggcctagtaactgaagagtacagaaatataaaaatgactaacaggcaatactgaactgacacaaaatgcctaagaacaccataattactgcagcaataaagaaacaggaatggagcaattttcttaagaagagatggacatctctttttttgttttatgctggttctttaacactctaagattgaggaccatgaatatttccaggaattgattatacaagaagtaattagaacttagcacagatattttcttcaactgctgatagtcattagggtggaatattcactaattgaaaactatttttaaaagtgagtagaaaataaaatttcagaagaggagaaaaatggcataattttttaact

SEQ ID NO: 254546 - DNA, 276 bp, Homo sapiens
gatggggtggtttgggatgctggtctcaactttatgtctcatccttccgcgatagccttatgtttgaatttgactcagtcttcaagcctggatcaaacagcacctcactcgacagtcttttgtgctcttccgaatggagctgatggcttcctcccttcacacttggatctgagcactttcctgcccactctcagtgcagcagtgcacctgctggatggttttactgagtcacatttctgatgtgcctctcgggtgaacagatctatctttttccag

SEQ ID NO: 254547 - DNA, 442 bp, Homo sapiens
aaaaattcacccctgcttccaccagtagtagaatttgtagctagtgtgtctggaccagggtgatacaagcatcacaggagagtggagagctagtgttaaagacaagtccctaaaatgggcagaagcagtggcagatcttggcagttaagagcacgggttcccatgagttctggatttgaatcctggctgaccacttgtgagctctacaatctcaggcaaagccctcctgttcccagccccaagtcggttaaacccatgttaaatctataggttgaagacctggatcattcgaagcccagagccttgcacagcagcgatctgctccaacagagggtgatgtcatcatccgaggccacacaaataatgcatttctcaccatcaaaaagcttctgaagccatgttctcaaaggcaaaaaataaataaataaattaccaattaact

SEQ ID NO: 254548 - DNA, 414 bp, Homo sapiens
attttatgtcttaataaattcagggcttactttctttatttttttgatattgtttttctattctcaggtacactttgattcactttctggctggcaatatacagccagtagttttaaaaacaaatcgttgttgtttcatttcttgaatttttccatacatgaggtggtctacctattgtcattatacttacaggacaagtgggctgggtataatatcttgtgccacaatatctttttcttaaaactttaacgtgatttcccattgtcttctatcattgatttctgttataggagtttgggaaaagtatgatttttaacctgttttattccagtttgtttaaatgattttttcattgacattgaaattccatagttttaccaagtttggcattgatatttctgcatctttttttt

SEQ ID NO: 254549 - DNA, 389 bp, Homo sapiens
attcaccaagtccattaaagtaggctgagtatctagagtgcaaaataaagtcacaatttgtaagatattcagcttattgaaataatatgtacattccacatggatagttcaatcacttaaaagaagacatctaggccaggagtggtggctcacgcctgtaatcccagcactttgggaggccaaggtgggtggatcacctgaggttaggagtttgagaccagcccgaccaatatggtgaaaccccgtctctactaaaaatacaaaaattagccacgcgagttggtgcactcctgtagtcccagctactggggagagtgatacaggagaattgcttcaacctgggaggcagaggttgcggtgagccgagaacataccactgcactccagcc

SEQ ID NO: 254550 - DNA, 3421 bp, Homo sapiens
gcgatctgggctcactgcaagctctgcctcctgggttcacgccattctcccgcctcagcctcctgagtagctgggactagaggcacccgccaccatgcccagctaattttttgtatttttagtagagacagggtttcactctgttagccaggatggtctcgatctcctgacctcgtgatccacccgccttggcctcccaaagtgctgggattacaggcatgagccagcatgcctggcctacagctattcattttctaaggagagtccattgcagattctgcattgcatttggttatctctctttagtgtattgtagcatggaaaccccatgaaagtatgctctcaaattatggtgggtatcagaatcccctgtggaacttagtaaacctacagaagtgtagccctagtttataagcctgggcctctgttttttattatttctccaggttttgtgtctgtgataccaaccagagttagagagccactggtctagaacatttctcattttaaaaaaatgacattgaattttgagtagcccagaaatgttgttggctatgtgtttagatttctttctttatagtgtcatttagccttgttcttggttgtattttctttacaagggaaagtaagtccagaggctttcttaggtctagattaaacgttttggggaagaatactttgtaggttatttctatgtcatattgtactgtcagaaaacatttaagtacaggtccttgcattagtgaaactaaggatgatcatttgggtaagctggtaaccgccgtaagtccattgtaaagatttagtttgtagtgggtaagtaatctatggagagacgttgtcatctctgaaaagttatagtcacgtgtacttaagccctggattgaatacaaaatgaaaattgaaatagactattgagaaatgaatgccattaaagcgtcaacataattcaacttgtgtgatatggctgacactgtactcagtacaaaactggcaccctttggattgtatagggagccaagattgtccggaacctcttttttgttcagcatttatcaccagcacctataccatggctggtacatgagctgttgataaaaatttgaaaaaatattaaccctttaaatcaagctgtaaaacatgataccattaagccgggagcagtggcctcatgcctgtaatcccagcactttgggaggccaaggtgggcagatcacctgaggtcaggagtttgagaccaacttggccaacatggcaaaactccatctctcctaaaaataaaaaaattagctggacatggtggtgcattcctgtaatcccagctacttgggaggctgaggcaggagaatcactcgaaattggaaggtggaggtggcagtgagccaagatcgtgccactgcactccagcctgggcgacaaagtgagacttcatctcaaaaaaaccccaaaacaaaacatgataccgatgtggcatcatgaattagattaaattttttttaagattaagaataatcctttgtgattttattccattgtgttgaaaaatctataaagtgataatttatattgatagctttcttctttttatgaatataccctggtcagatgattattctttcaatagactacttaattctatcttttaccatttaattgcatctataatcataagtaaagttataattttccaagtatttttcaggtattgatattgcaatgatgttatacaacttataaaacaagattatataaaacttggctttcaaatcttatgttcctattttttatttccagtttcatcttttttctatccattctcttgaactttcttctttgaaatcagcagagtccctgggtattaacctagcacaactcctttctgggtcattgcacatcccggtagtatcattaagagttgtcagaaagatccctggcagcctttcggtgaaactctatcatcatgcaatcatggcagtactatgttggaagtcagagtccctttgcaaacataataaaacactttaatatatttgttaaagttacaaaccaagtatgtacaaatttaaaaatcacggccaggcacggtggctcacgcctgtaatccccaacttaaaatggtttgacttataattttcagctttataatagtacaaaagtgatatgctgctatagtttggatatttatcccctccaaatctcatattgaagtttgatcccaatgttggaggtggggcctaatgggaggtgtgtgggtcatgggagaagatccctcatgaataaattaatgtcctctctggattggggggtgaattatcactctgttagttcctatgagagctggttgtacaaaagagcctggcacctccttcctcaccctcttgcttcctctcttgccatgtgatgtctgcatacactgccccctttcatctgccatgagtggaagcagcctgaggcccttaccagaagcagatgttgcaccatgattcttgtaaatcctacagaacactgagccaaataaacctctttctttattaataacccaacctcagacattcctttatagcaacacaaaactaagacatactcagtcagagtatgctccttgacttaaaatggggctatatctagataaacccattgttaaattgaaaatattgtagaccataaatgcacatatggtgtatgatgttttcaatttatgatgggtttatttggacataactccccgtaagttgagaagcacctgtagtaattattattatttatgctcaaattgacataatgtggccagtaggaatccatttacattttttttttactacttatttttttcttttgatgttttaaaggaatattgttttcaggccgtaagaggatgtttaagactgaccctgtttgttggttcatgtcccccatgcctcttgtcctgagtcatggaatcaactcatgatttaataccctcttatcttagggagtcctggttccttttagaggaaaaaagaattagagaccaaaaaatctggctgctgtgagtgcacatggcagttacaggtatggaaaaaaagatgctgcttttgttagaattcttttaatagtttcagagttgaaaatgtcatcctaaggtcagaagttccctctgaattttctcaacttacatttctatgatctgctcttgtttgcatttggtattttattgaattatgttttatgtatggtgatagctgagaagtttatctccttttaaggcctggctgaaatgatacattaatctgcctcccatttttggagatattgctctgatttaaatttgtcatggtgtttctgagcagcgttgtaaagaaacttgttttagaatattcagtcatggatgttatcttgaatgttcatagactccccagaaaagaagaaaaagtagacacaa

SEQ ID NO: 254551 - DNA, 2073 bp, Homo sapiens
cagcctctggtttctatcattctattctttacctctgtgagatctttttttagctccagcctgggcgacaaagtgagacttcatctcaaaaaaaccccaaaacaaaacatgataccgatgtggcatcatgaattagattaaattttttttaagattaagaataatcctttgtgattttattccattgtgttgaaaaatctataaagtgataatttatattgatagctttcttctttttatgaatataccctggtcagatgattattctttcaatagactacttaattctatcttttaccatttaattgcatctataatcataagtaaagttataattttccaagtatttttcaggtattgatattgcaatgatgttatacaacttataaaacaagattatataaaacttggctttcaaatcttatgttcctattttttatttccagtttcatcttttttctatccattctcttgaactttcttctttgaaatcagcagagtccctgggtattaacctagcacaactcctttctgggtcattgcacatcccggtagtatcattaagagttgtcagaaagatccctggcagcctttcggtgaaactctatcatcatgcaatcatggcagtactatgttggaagtcagagtccctttgcaaacataataaaacactttaatatatttgttaaagttacaaaccaagtatgtacaaatttaaaaatcacggccaggcacggtggctcacgcctgtaatccccaacttaaaatggtttgacttataattttcagctttataatagtacaaaagtgatatgctgctatagtttggatatttatcccctccaaatctcatattgaagtttgatcccaatgttggaggtggggcctaatgggaggtgtgtgggtcatgggagaagatccctcatgaataaattaatgtcctctctggattggggggtgaattatcactctgttagttcctatgagagctggttgtacaaaagagcctggcacctccttcctcaccctcttgcttcctctcttgccatgtgatgtctgcatacactgccccctttcatctgccatgagtggaagcagcctgaggcccttaccagaagcagatgttgcaccatgattcttgtaaatcctacagaacactgagccaaataaacctctttctttattaataacccaacctcagacattcctttatagcaacacaaaactaagacatactcagtcagagtatgctccttgacttaaaatggggctatatctagataaacccattgttaaattgaaaatattgtagaccataaatgcacatatggtgtatgatgttttcaatttatgatgggtttatttggacataactccccgtaagttgagaagcacctgtagtaattattattatttatgctcaaattgacataatgtggccagtaggaatccatttacattttttttttactacttatttttttcttttgatgttttaaaggaatattgttttcaggccgtaagaggatgtttaagactgaccctgtttgttggttcatgtcccccatgcctcttgtcctgagtcatggaatcaactcatgatttaataccctcttatcttagggagtcctggttccttttagaggaaaaaagaattagagaccaaaaaatctggctgctgtgagtgcacatggcagttacaggtatggaaaaaaagatgctgcttttgttagaattcttttaatagtttcagagttgaaaatgtcatcctaaggtcagaagttccctctgaattttctcaacttacatttctatgatctgctcttgtttgcatttggtattttattgaattatgttttatgtatggtgatagctgagaagtttatctccttttaaggcctggctgaaatgatacattaatctgcctcccatttttggagatattgctctgatttaaatttgtcatggtgtttctgagcagcgttgtaaagaaacttgttttagaatattcagtcatggatgttatcttgaatgttcatagactccccagaaaagaagaaaaagtagacacaa

SEQ ID NO: 254552 - DNA, 438 bp, Homo sapiens
acaaagaatgagggacactccccaccgtttccccaccgtgaacatccccagcacctcagggcctgggctccatgtgtcagtgacctgcatgtggttgcattggcctgagcggagctggctgcatgcaaaccactggccaggaagaatcccactcctgctgctgctcctgcagctgcgccgggtcccgcgagcccccgcgtgcgcggcctgtgtaaacagtgcgtcatctcctgttgcacactttgggcctgcgggtcacgaccagggattatcaaattgacagagctcagctggcctctcactccacgtccgggcacattgcattttgttaattatcgtcttttgcttttgacgtaaagggtcggggtctgggtcagggtcactgtgtattttcctttccttctcattaaagttgcccagctctcagggcccccagtt

SEQ ID NO: 254553 - DNA, 611 bp, Homo sapiens
agaatctttcactttctaaaggttgagaagtgaaaaaaatgaatttcttaatattttaaacaatattctagaaaaaaagtttttcagttagcatgtgcattattcagagtttaaatgttggtatgtaaaaaccctagtctatcagatagattcttttgaataattatatcatcctatcacttaaaaaggatccctcttgggttctacattagccaatctagcaattgaggaaaaaatcaaagtgtgtagactctgtacctcaggaatttacaaccgggggcaaaaggctaagatttgtaaaacaggaagtaaaaacgcccatgcctggcatggtggctcacgcatgtaattccagcactttggggggcgctgaggtgggtggatcatttgagcccaggagttcaagaccagcctgagcaacatggtgaaactctgtctctacaaaacatataaaaattagccaggcatggtggcacacgcctgtagtcccagctacttgggtggctgaagtgagaggatcacttgaagcctgggaggcagaggttgcagtgagccaagatcacaccactggcactccagccagtgcgacagagcgagaccccatctcttta

SEQ ID NO: 254554 - DNA, 263 bp, Homo sapiens
atctactctttatctggaaggatgaaggaaggttcagaggctacccagatacatgtgttttgtatgtttacataaagagattcttaaataaaacaagcaaataaaaagactacctattaatactctttaagtgtgggggcaaattttcattattaggacactttaggaataatgataaacaaagggctgagttgtaatctatatacagtgatattctgagctttctaactgacaagtaaaaaatatatagacacatctatata

SEQ ID NO: 254555 - DNA, 387 bp, Homo sapiens
tttgctaaagttattaatacttgtggttaattcttccagagttcagagcatagaacagacatgccatttcaagaaggctgtagtcatgggataggttttgagaactgactgtgctaagctctcatttattttctgtgttttatactatcttgtcaactttgagctatccaagcattgattatcgattcagacttggagagttctttcaggagtcatgggaaaagcatcccatgtggacccgcccaaagccaacgtcaaactcttgccctagctgaggcttgtactccttttggtttctgctatggctctttctaggaagtcccaagccccatgcagtgcatttgacagggagaggctcaggagagaccaatagccccatccacactg

SEQ ID NO: 254556 - DNA, 393 bp, Homo sapiens
gaaaaggactgtgttatgtgggtaagatgtaaaagacaccagccttgccctctattgaagctccaaagccccctgtgaaactccagtggcattttcacagtgatatttgtaaaaagacaaaaacaggccgggtgcggtggttcatgcctgtaatcccagcactttgggaggccgaggtgggtggatcacctgacatcaggagttcaagaccagcctgaccaacatggaaaatccccgtctgtactaaaaatacagaattagccgggtgtagtggcacatgcctataatcccagctacttgggaggctgaggcaggagaatcacttgaacctgggaggtggaggttgtagtgagccaagattgtgccactgcccaagagcaaaactccatctca

SEQ ID NO: 254557 - DNA, 366 bp, Homo sapiens
ttaaagaaattccatatagcacttacgagacactcaattttgcgggagccatacaagtgttaattcatgtaatattcacagtcatcttaacggggtcagtcaccatcacgatccccgttttccagatgagaaaacaccaagcaacatcttacccgaagttgcacagaggctggggatgggatttgaactgggtggtgggctcccctcttctctgctgttaaccactgggctgtgctctgggccagccagctctgagcgcaagtgttagggacagggctggcggaggttaatgagggaaaatggccaggagttggcttcaggaagggaggcagtgggtgagggtggagccacagcaggctcccagag

SEQ ID NO: 254558 - DNA, 419 bp, Homo sapiens
attttcacaataaacacacactcacatacatgcacacacattcacatacccatgtgaggacacacgtgccctcacacactctcacaccttcacacgcttgcacaaacttacttgcaagctctcacaaactaacacatacgcacaccctcacacagtcacacactcatttgctctctcacactcgtgtgcacactcgtgcttgcacactcgcacaaacacactcgtgcacacttccacacacgcactcacacaaacacgtgctcagcaccctcagactcactcatgcacactcacagtcacacacttgtacgcaattatgtacacacacatgcacctattcacacgcttggataaacacacactcagcctcacactaacacactaaacacgctcacatacctgaggactaacctctgacc

SEQ ID NO: 254559 - DNA, 337 bp, Homo sapiens
gaaattgccttatgttctttcatgtatcttcatttccctccctccctattggtgttctgttgttacccatggaaggtctcaaaccatcccctacctggtttaaacatcttcaggtcaacaatacattataaagtgtattcaaataggaagagaggaagtcaagttgctgtttgcagacgacatgattttatatttacaaaaccccatcatctcagcccaaaaacttgtcgaattgataagcaacttcagcaaaatctcaggatacaaaatcaatgtgcaaaaacacaagtattcctttacactaacaataggcaagcagagagccaaatcatgaatg

SEQ ID NO: 254560 - DNA, 303 bp, Homo sapiens
caaacattcaatcaattgcaaagacatactagcaatttgatatgatctctttcaaaaaaaaatagaatagagagtgattctcaacgtattttctgatgtcagcattaccctgatgctaaaatcacacaaagacatataagaaagagatcttcagaccaatattcttcatgaacatagttacaaaaatcctcaacatagtattagcaaattgaatccagtaacaagtaaaaagaatataaatgacagcccaaacttactcaatacttgggaatcagttaatgtaacataccatattaacagact

SEQ ID NO: 254561 - DNA, 118 bp, Homo sapiens
ccagactcctcccagaacctgagatgtgagcacttggccctgagcctgttccagagaacttcaggactaggggcttcaaggttaaaggggctggggttctattgctgaggagctgttg

SEQ ID NO: 254562 - DNA, 241 bp, Homo sapiens
  misc_feature (66)..(66): n is a, c, g, or t
gtcttgaaatgggtcatgatgagcaaactattactcttgataagccagctctctagttcacagccnaaacattcacaggcgagtgtttcctagagcaagcacttaaattatttttgatcagtctcagcatggtctaacacagggataggaaaatgtatctgtcccagtatcgtttaacccagggccaaaaattatggtgattcacctcctgcatttacttttttttaatcagatagtgggg

SEQ ID NO: 254563 - DNA, 371 bp, Homo sapiens
gtgttagtcaggatcattgtgagtacagaacacaaaattcaacccaaagccataaacagaattgaaagacctctgtccatggaaagcctatgaacacattgaacacagagggacttcaggcatggttagatccagctgttcaagggactctcacttctgctttcctctttttttttttttttaatggagtttcactcttgttgcccaggctggagtgcagtggtgtgatctcagctcactgcaacctcccggtttcaagcgattctcctgcctcagcctcctgagtagctgggattacagccgctcgccaccacacctggctaactttttgtattagtagagacggggtttcaccatgttggcaggctggt

SEQ ID NO: 254564 - DNA, 419 bp, Homo sapiens
agcccggggctgacgtagccttttgttatacctcactggctctctatccttgctccacttagatggccaagattcttggtcttcccctgctgttgagacctagggcagtgtttcttaaccttaaaaggtggttgtgcaagctggagacccagggaaaaagcacctgtgattttgcgttctctttgaagcggttcaaggtttcttggaagcccatccacacacacaaggttaagaacctctggacttagtgcatttcatccccagaactcactgctcagatcagccccactagagccattttataatttgttgatttgtttatttctatccctttttgttatgaagaacatctggagaggcttacaagaagcatgcctgttgtaaaataattatgagtagcaaaatcagcaacaagggaa

SEQ ID NO: 254565 - DNA, 270 bp, Homo sapiens
aataagcattaaaaggcaaagaaaggacaggatgttaattgaaatttagaagcatctgagggttcctccaatgaaaaattgcaaactgtgggtcatcatttggattctacagtgtgattttaaaatactgtgtgttctaaaaggtattatatagcatatatttcctaattttggtgttttactgagtatttgataatggctattgagataatagtttataaaatagaaaagattgtggttttataagactttcataacattttatgaagc

SEQ ID NO: 254566 - DNA, 356 bp, Homo sapiens
caggaagcaaatggctggagcgtgcatctgctctgatgcctgtcgctgcgacctccagcaggcccctcatcccctctgagctggatcctgaatctgtgaaatgacactaggcacaccttctaccagagctgtgctgagaggacacgagccattcccatcacagtgccaggaagcctcggtgccagccaggatgctgatggaaaggattccgtctcttagaaatctcagtcctttaggccacgtgtgctgccttgtgcctgcaatcccagcactttgggaggccgaggtgggaggattgcttgaggccaggagtttgagaccagcctgggcaacatagtgagaccctgtctctacaa

SEQ ID NO: 254567 - DNA, 518 bp, Homo sapiens
aattaaatgggagacttacttccaatgatacctagaaatttctaaaagaactactgagaaaattgcctccattgaggatttaaactggggatatctgatgctttttctgaattgagaaatattgaggaggctttgtctctttcgcctccaactgctccttttcctcctgcccctgcacctgcatagtctcccttacctgagccctcctgtcctgccttgcctcttcttccatcaccatcacctgaggaaagtccccagggctctggccccttccctgaaacttctgttctggcagcccctttcaaggtaaaacccacaggaagaggggagcctactattgtgtatactgcttcaccataatgtgaattaagaatattgtaaaagacttcccttttctaaattgaaatacattttcctcttctctttctaaagcaggctctgctttagatttagaagtagattggaggagaatttagcaatgcacttaaaaggccaaataaatctgtcattgatatttt

SEQ ID NO: 254568 - DNA, 543 bp, Homo sapiens
aacatgcatatttaaattatgcatgcattgtagctgtatactgtgtgaccacatttacttaaaaaagaggaaaaaaggttacttgcttgagacaggaaactatcacctttgaaagcatattaagtagttggcttactttggaacacacagtagactgaaaatgtgaactaatactttaaaattgccgtataatgatgtcattgcaagccattcatctatccaatgggggaaaatgtggaggtctaggcttgtgttgtcacaaaatacaccttttagataatccttacctgtacagatttttataactgttgttatcataagagaatggctacatcattatcctgccttttctgggtgtttattttgttgtttttgaaagtggacaaaacctcaaagcacaattttgttctgatatatccagtttagtagtttatgctggttaaatgatcaaagtaattgcttaaatgtcttgtggaattagctgtcactttatagtttatgtattgtggtgggtaccttaataataaaaagatttttaatgta

SEQ ID NO: 254569 - DNA, 431 bp, Homo sapiens
cagtcatagtcatagcacactgctgcagccttgaattcctgggctcgagatgatgctgcctctgcttccccagtaatggatactacaggcatgtgccactgtatctggcctgggtttcctttctaggagtattttcataggttgattccttagttaagagttatttaatcagaagcctgccatcagctgtatcttgtgagataagaaaattgaatggtgtcttccaggttcatcttagtatgttctttctgcttggacagatagcaaggtattgattttcatatgagactgattttattactagcttgttttctctctcttaccttttcttctcctttactcatttcattttaaatttgtttaaagacacgggttaatatttgtcataaaatttcaggcattgcagcagtatatcagaagtggtagttccc

SEQ ID NO: 254570 - DNA, 533 bp, Homo sapiens
cagcctgggtgagagagtgaggccctgtcgcaaaaaaaaaaaaaaaaaaaaaaattatatatatatatatgcgccatatgccaaaatatataaagaacttttataattcaacaaaaaaagacaaacctagttcaaaaatgggcaaaggatttcaacagatatttctccaaagaagatatacaaatgaagtcattagccattagggaaatgtttatcaaaatcacaatgagatgccactttatgcccactgggctggctacaataaaaagtagaaaataagtgttgatgaggatgtggagaaactgaaatctttgtacattactggtaggaatataaaatggtgcagctgctgtgaaaaaagagtctggcagttcctcaaaaagttaaacatacaccaagtgacgcagcaattccgataccaggtatagaccatgagaaatgaatcatctatccacacagaaaactcatacatgaatatacagagcagcatagccaaaagtggaaacaacccaaattcctttcaaatgctgaca

SEQ ID NO: 254571 - DNA, 192 bp, Homo sapiens
  misc_feature (182)..(182): n is a, c, g, or t
  misc_feature (184)..(184): n is a, c, g, or t
  misc_feature (186)..(186): n is a, c, g, or t
  misc_feature (188)..(189): n is a, c, g, or t
  misc_feature (191)..(192): n is a, c, g, or t
caggcttaggaatttttaacagatatttatcctggaaaattcagttatgagaagacccacttgactgctaatttgatgacgaatctgcaagtgtttttacaaaggacttttctagttgatgataagaacataggtctttataggtactaagggctttcaattaaatggctcctccatctcancnanannann

SEQ ID NO: 254572 - DNA, 455 bp, Homo sapiens
ttttaattataaatattatctaactctctgctatggaagatgaggattttgcttttcatacttctccccctattctccttccccaacctgatcttacactgggacttctactcctatcatcacttaattgtataatttttttaaattcatatcgaatatataaatgtacatagataatattgtcttctatagcataccatgattacattttctttcttttataatatttttgtatctctggaagtagtaattgccttggttgtaatttgttcaacttcatttgtatcttctattaattgatcatcagaatcgtttgtcattttttattctccaaatcacagggagacttcttcgagttctacggccctcagtcaggactgactactgtccaaataacacagttgtcataacagaattgatcatattgggacttccctttgttttctcttgcattt

SEQ ID NO: 254573 - DNA, 337 bp, Homo sapiens
gatctaacccaggagcagacagagaagctgctgcagtttcagctatttcagatgggaaagaataaggacataggttttaaggagagctaatgcaggttgctgtttgaacaactggagaaggatgacatggacagagagaagggggaattaaaggagttatgcaggccagcagaggaagaaatgatcccttttctgcttgcacaggaggaagaaatttatgaccctcatccttttaaatgatagcctgaacgctgggctgtagaatcaaatttataagtcattttgaaaatctttcttttggcttcacctgactatattacctaaaggaaaaaaaaac

SEQ ID NO: 254574 - DNA, 409 bp, Homo sapiens
tggagtctcgctccgtcgcccaggctagagggcagtggtgcgatctcggctcactacaagctctgcctcccgggttcacgccattcttctgcctcagcctcccgagtagctgggactacaggcgcctgccaccacgcccggctaattttttgtattgttagtagagacagggtttcaccatgttagccaggatggtctcgatctcctgaccttgtgatccgcctgcctcagcctcccaaagtgctgagattacaggcgtgagccaccgcgcctggccaaatgttccctttttataaggacaatatgttatatggaggaacctgccccaacaccacccacattaactaattacatctgcaatgacatcatctccaactgaggtcccattctgcggcgctagggggtagga

SEQ ID NO: 254575 - DNA, 399 bp, Homo sapiens
acttatcggcacaagctcctctctgtcttctaaactcgaagctgaaaatgatgtggacccagtgttgctgcggtcaccacacacagagaggctgcctgagaacgaggctgagatgagagagaagagtaccaaatactgacggcacactgggatagcgccagggactggtccatgatagaagggagtaagttccactttttatgtaagccaatttgaggtgggttttttatcatctgaaaacctttcattatgatttcagtggactctgaaatcatgacgcctgagtttaaattgtggccccatgcttattaacagtggcactttgagtagattacttaatatctcaatgactcagcttcctcatctaataaatggataataatagtgccaacttcataa

SEQ ID NO: 254576 - DNA, 407 bp, Homo sapiens
caaatggaaaaaaatattatagcttaacatctgctttccctaggtaatgtgttaattaaagattgttttaatatggaatgatgtctagcctttgaaaaactttatcttacggtttatggtattgataaccttcagaaaaggaagactggttcaaattatgtcaattaatatgaaaaaagcccactcaatatgaagccccttgacttctaaaaacttgctttttagaaaatgttaaaaaaaattccaggttttgcaggataaatcctcgggggaatattgtgaggtgaggaatagtcgtggtcttgatgcaatgtaacttataattagaaagatgctgattttgctgtggagtcattgaatatcattatttcaaaataattttgaataaaatgagatttctaataacc

SEQ ID NO: 254577 - DNA, 614 bp, Homo sapiens
gatgattcaatgttttaccacaatgctttctaaaacagaagagtgtaaaaggatattcaaagtcaatttcctcagcgaggctttgcagaaaatgaggaaactagagaaacaaaaatggcaggacattctacgggtgattttaaatgttgctatgttttatgggaaaaaatactttaccttttaaagaatcacaaagaattgttggaaacccaaactctggaatgtttgcaaatttagttgagcttctatgtaattatgtctatataggtagccacgatgttgatgatttcttaaaaatctgtgccttatttgtgtgataaaatacacaatgaataattaatgctcataggaaaaccttataaagggaaaataaatcttggggacccaaaatcactaagctaaagggaaaagtcaagctgggaactgcttagggcaaacccgcctcccattgtatccaaagtcacccatctgctcacctagataaatgcatacctgattgcctcatttggagagggtaatcagcaatgcaaaagaatgaaatcatttgtctcttacctacctatgacctggaagccccctgtctggccttgtcacctttctggactgaaccaatg

SEQ ID NO: 254578 - DNA, 332 bp, Homo sapiens
ttgtcttggtatattattgtatgttgataaaattaatgcttaaatatacttaatattttatttcataaagtagacttttttaggagaccagggtgggtggatcacttgagatcaggagttcaagacaagcctggccgacatggcaaaacctggtctgtactaaaaaattcaaaaattagctgggtgtcgtggtgcacgcctgtaatgccagcaacttgggaggctgaggcatgagaattgtttgaacccgggaggcagaggttgcagtgaacagaaatcgtgccaccgcactccagcctgggcgacagagttagactcctcaaaaaaaaaaa

SEQ ID NO: 254579 - DNA, 512 bp, Homo sapiens
ttgctaaggtcatcccatgtcaaagtcttttccaccacacttgctcgcttcatgcagctgaacttatgacaccttcagctctgggtgcctgttacccacctagtttgtgaatactccctctctgtaccttcttactattgtatcttttagtaatttactgcctttttcttttcttattgaggttaggcaaggaaaaggagatgatcattagtcccctttcctacttgttagtatctctcatagaacacatattacatttgaagtcagttaacccatattgcattgctggattttcataataacccctctatcactgaacccctgctagcacatgggtgtgttatctcttcaggggctccgaggtcttgggcccataacattaacctctctgaacctttgttttctcatatacaaattgaggggtttgttttctgaggtcatttcctgaatctaggaatctatctaatgatttaatgggaaaagaatgctagaataaatggttgaacattatt

SEQ ID NO: 254580 - DNA, 379 bp, Homo sapiens
tcattctttctgtggcctcagaatccttcttacattgtaattattaccaatttattatgagtttcatgaagatgcaactgagaataatacctattccaacacaactataagtttattgagacaggtgtttacaaatctatcatgtagcacatcatgaaaacagggcagcagctcaaaaatgttgctgaatgagtgaattaattaattaattaataggtgttctgcaaagatctttttttttttttaaaaaaaaagacatttatccagcgtcacgatcagactattacatttagcaatcaacagcatggggtgcaaaaaaaaaaaatctacattaaaaccctttgttggaatgctttacactttccacagaacagaaact

SEQ ID NO: 254581 - DNA, 419 bp, Homo sapiens
cctaaaccccatctgtatgtagttgactgatgtgctggtaagcctttggtaactttgatgtttggttaaataactgtgtagtattgctttaagtctctcttttaatcattcaaaagctaaataattacatcagttctcttaagattttccaaagatgaattctatattagttgcatgagtggctcattttcttggaattttttgggggttaccaaatcttaataagtaataactggggaagctttaaaactgccttagttttctaactttttgtgtttgtgttcaaaaataattaagttgatggtaatacgttggaaagtgattaaaattttgtggaaaggtgatagcatttgatgtagtgagaaaacagttattaattatgcacagatgaggttgtcttttgtttgattaatggatgt

SEQ ID NO: 254582 - DNA, 298 bp, Homo sapiens
gcagtccatattcatccaattatgaatgggagtggctatcattttaaagaataacttaccaagcactctaagttgcttttaatgtaaattgagatggaggctgaaaagagaagtagtagaaattgtttcaaagttgaattattaacatctaaagacagttgtcacttaaaatatgggagtcaggcaagcagccttggaacttcaagatatgtgaccaactctcatctggcatttaattagggtagtgcttttttgtcatacaatttcatgtgaatagatacctgggcctgaattaaaa

SEQ ID NO: 254583 - DNA, 493 bp, Homo sapiens
agtatcccactctctaacaacacctctactttcttttcagttttttttttttcctagcataccaactatgaaactcctttacactgtgaaggttctcgaatccagtaatatcaaaactttttcttgttcatcatttatttcctaatcttctattcatgcaagttagaatgcttgaaggaaattatagtcactctcctgcatataatctcaaatttttccacctgcagtcttacttacttgggaaaatttcactatttgtaataaaactcataactttcacccctgcctaccaacccctaaagcagctaaacaggaatgcagaaaacaaatatcttataatggtactatgcctgtgcattgttctaattattttatatatgtgaattcatttagtcctatcaactaacctataaaatatttataattattatccagatccatctcaattaagaatgtaaatgcaaatgtacaaaataaaatacttgcactaaca

SEQ ID NO: 254584 - DNA, 1093 bp, Homo sapiens
gagatacttctttactgaagacatttgttcattgagaattggtaagtggattaagaaagaagacacttttagtcacttagcatattcatctaagaaacatctttcaaatactgaatatatttaatattctttatgaataagctttaacttctttgatgaatttaaattggagtttatccaagtaagtttttttaaaagcacctgcgaaattctgtttccaaaggaataagtcatacattaaatatgtgaaatatatttatgttggtaatcattttatatcagccaacaatgtagtactaccagatgcagtggtgacatcacactcaagggttttcaaccagagagaaacatgattcatatatttaagagattactgtagtgactaggggtagggtaatgggatcaaggcagagaggctgagagatcagctatagatgtatcagaggtggtcagcaagacagtagttgggtttgggcagaggtaaacagatttgaggtatgttttggaagtaaaaaaaatattggggttacttgctgctgggtatcatgtagaaggagagggagttaggatggtgattccactgactaaaatggagaaagctgagaagttcagagagcagaacaggtttgttgactgttgattggtagccatatgatagacacacagtgccaagtgctctgagtatatcttctcatttaattttcacaaaaggcttctgaggtgggtatattctcatattatagatgaggtagatgctaagccacattttctgggaagtatgcatatatcctcagtgaaattaaataacttgcccaagtaccagcttactgggaaatggcagagctgggatgaaactagccttttcaactctaaaacttcggctgttttttcaaagttcatgtatgaaaaagaaatacaagcaaattattcctgtaggagtaaggagtaatggtctaatttgttgcttatactaattagacttattctattggaacaccaacatgccagcatcagtttggctaaagtaaaaataaagctcccgtatttaaaattattctaaaaataatggaacaaaaataaaattcttttcata

SEQ ID NO: 254585 - DNA, 3883 bp, Homo sapiens
cttgagggtgcccttgagcaggagagaaaagcgagaatgaactgtgaaagggaactgcacaaactggagggcaatttaaagctgaatcgggaaagtatggagaacctggaaagcagccagcgacacctggcagaagagctgaggaaaaaagaattagaattgagtcagatgaattcaaaagtggagaatgagaaaggcctggtagctcagcttcagaagacggttaaagagcttcagactcaaataaaggatttgaaagagaaactagaagctgaaaggaccactcgagccaagatggaaagggagagagctgacctcacccaagacctggctgacttgaatgagaggctggaggaggtaggaggatccagtttggctcagctggaaataactaagaaacaggaaaccaaattccagaagctgcaccgagacatggaagaggccactctgcactttgagacaacttctgcatctttgaagaagagacatgcagacagcctggctgagctcgagggccaggtagaaaatctacagcaggtcaagcagaaactggaaaaagacaagagtgacttgcagctagaagtagatgacctcctgacccgtgttgagcagatgacaagagctaaggcaaatgctgagaaactctgtactctatatgaagagcgcttgcatgaagcaactgcaaagctagataaggtgactcagttggcaaatgacctggcagcacaaaagacaaagctgtggagtgagagtggcgagttcctacggaggcttgaagagaaggaggctctgataaaccaactttccagggaaaagagcaacttcactcggcagattgaagacctgagagggcagctggaaaaggagaccaaatcccagagtgccctggcccatgccctgcagaaggctcagcgtgactgtgaccttctacgagagcagtatgaggaagaacaagaggtcaaggctgagctgcaccggaccttatccaaagtcaatgctgaaatggtgcaatggagaatgaagtatgaaaacaatgtcatccagagaacagaagacttggaggatgccaagaaggaactggcaattagattgcaggaggcagccgaagccatgggggtggccaatgccagaaatgcctccttggagagagccaggcaccagctgcagctggagctcggggacgccctgtctgacctcgggaaggtccgctctgcagcagccaggctggaccagaagcagctgcagtctggcaaggcccttgccgactggaagcagaagcacgaggagtcccaggcgttgctggatgcctctcagaaggaagttcaggctctcagtacagagctcctcaagctcaagaacacctatgaggagagcatcgtgggccaggagacactcaggagggagaacaagaacctccaagaagagatttctaatctgacaaaccaggttagagaagggaccaagaacttaactgaaatggaaaaggtcaagaaactaattgaagaagagaagacagaagtccaggtgacactggaagaaacagagggagccctggaacgtaatgaaagcaagattcttcatttccagcttgaactcttggaagctaaagcagaacttgaaagaaagctttcagagaaagatgaagaaatagaaaattttaggaggaagcagcagtgtaccattgactccctgcagtctagtctggattctgaagctaagagcagaattgaggttacccggctgaagaagaagatggaagaggacctcaatgagatggaactccagcttagctgtgccaaccggcaggtgtcagaagcaaccaaatccctgggccagcttcagattcaaatcaaggaccttcaaatgcagctggatgacagcacacaactgaacagtgatctgaaggagcaggtggctgtggctgagcggcgcaactctcttcttcagtctgaactagaggatctaaggtccctgcaagagcagacagagcgtggccgcaggctgtcagaagaagagctcctggaagcaacagaaagaatcaatcttttctatacccagaacacaagcctcctcagccagaagaagaaactggaggctgatgttgcccggatgcagaaagaagctgaagaggtggtgcaggagtgtcaaaatgcagaagagaaggcccagaaggcagccattgaggcagcaaacttgtcagaagaactgaagaagaagcaagacaccattgcccacttggaaaggacaagagaaaatatggagcagccaattacagacttacagaaaaggctggctgaagctgaacagatggccctgatggggagtagaaagcaaatccagaaactagaatccagggttcgtgaactggaaggtgaactggagggtgaaatccgtcgcagtgcagaggcccagaggggagcccgcagacttgagcgatgcatcaaagagctgacctatcaggcagaggaagacaagaagaatctgagcaggatgcaaactcagatggataaacttcagctaaaagtgcaaaattacaagcagcaagtcgaggtggcggaaacacaagccaatcaatacctttccaagtataagaaacagcaacatgagttgaatgaagtgaaggaaagggcagaggtggcagaatctcaagtcaataaactcaaaattaaagcaagagagtttgggaaaaaggttcaagaagaatagcatcccctgctttgaaaggacaacagctggagaagtacaaggaaggtgctgtttcatggccaaaaacttaggttgcatggaaacatttttaaaaacatgtttaaattgcttttcacaccatataaacaaggcaattagaaaaataattaaagggaatatcattgcttccacagttaatggggattttttgatcctcaaatgcaagtaaactaccttctaatgcttcacatgacagattaaataaatggaagaaccttttcaattctgatgtttaaaaaatgaataaaacttgatcctttgtccatatttcctcttaatgggtaggactcatagaagatgtccttagaccagtcacgcttcatggggactagggcatgttggtgaatggtttttactaaagttaggcaactttggcttgattcacccctaaatctatgaatgtatattgtgagccagcagtggtagaatggaagtcataagatctcctcagcattgtgatataaatatagctatagttaggcaatttgaacatgtaggcaaaactctcctaatcaacacacatgtaggctatatgctggtacatgctttaaacatggaggtaaccccacacgagacattcagtgacaggtaatatgctggatttgtgcagtaccgatttggctcagctggaggaacatgtcccggaattcctctctctcatggttctggattggagtaggtcataaagaaatttgcattaatttgatcagcagctattttatactcataaggtcagtgtacagacccaagcatggtgacagcttgaaaatatgactccaggccaaaaaggggagctagaagagaccagagacagctccctggacccagagctcttccagctcctgccagcctcctccttcagctttgcaaagtactggccaggtgtgtgtgcagctccatggcaaccagcatcagcttttcctgagatcacacacagcattgcagtggaggccgtgagacagacatgggttctgtttgttcttatggacttcccttcatccttgctgcattcacagtcgacctacagtgacttcaggcccagaaccagatgcagagggaacagcctggcctagacttctccaccagcacccacaattgtgtaaggctgaagctctataataaatctttattctgtcat

SEQ ID NO: 254586 - DNA, 1785 bp, Homo sapiens
ttctactcctcgcccctagcagagagccccggttaatcggcagaggcaagaagtctcacacttgctcccctcccttcacgttgcacctctctgaggaggtacaggagggaagaatggctccagtggggagtaagaggtggggtcagatgtgctaggcacattcttgcctcagggcactggccttcccgttctcaagaaggccccttggagaaggtggcattggcgtcaaggagaaggcaggaaaagaggatatctgggttcgtgaactggaaggtgaactggagggtgaaatccgtcgcagtgcagaggcccagaggggagcccgcagacttgagcgatgcatcaaagagctgacctatcaggcagaggaagacaagaagaatctgagcaggatgcaaactcagatggataaacttcagctaaaagtgcaaaattacaagcagcaagtcgaggtggcggaaacacaagccaatcaatacctttccaagtataagaaacagcaacatgagttgaatgaagtgaaggaaagggcagaggtggcagaatctcaagtcaataaactcaaaattaaagcaagagagtttgggaaaaaggttcaagaagaatagcatcccctgctttgaaaggacaacagctggagaagtacaaggaaggtgctgtttcatggccaaaaacttaggttgcatggaaacatttttaaaaacatgtttaaattgcttttcacaccatataaacaaggcaattagaaaaataattaaagggaatatcattgcttccacagttaatggggattttttgatcctcaaatgcaagtaaactaccttctaatgcttcacatgacagattaaataaatggaagaaccttttcaattctgatgtttaaaaaatgaataaaacttgatcctttgtccatatttcctcttaatgggtaggactcatagaagatgtccttagaccagtcacgcttcatggggactagggcatgttggtgaatggtttttactaaagttaggcaactttggcttgattcacccctaaatctatgaatgtatattgtgagccagcagtggtagaatggaagtcataagatctcctcagcattgtgatataaatatagctatagttaggcaatttgaacatgtaggcaaaactctcctaatcaacacacatgtaggctatatgctggtacatgctttaaacatggaggtaaccccacacgagacattcagtgacaggtaatatgctggatttgtgcagtaccgatttggctcagctggaggaacatgtcccggaattcctctctctcatggttctggattggagtaggtcataaagaaatttgcattaatttgatcagcagctattttatactcataaggtcagtgtacagacccaagcatggtgacagcttgaaaatatgactccaggccaaaaaggggagctagaagagaccagagacagctccctggacccagagctcttccagctcctgccagcctcctccttcagctttgcaaagtactggccaggtgtgtgtgcagctccatggcaaccagcatcagcttttcctgagatcacacacagcattgcagtggaggccgtgagacagacatgggttctgtttgttcttatggacttcccttcatccttgctgcattcacagtcgacctacagtgacttcaggcccagaaccagatgcagagggaacagcctggcctagacttctccaccagcacccacaattgtgtaaggctgaagctctataataaatctttattctgtcat

SEQ ID NO: 254587 - DNA, 3533 bp, Homo sapiens
cttgagggtgcccttgagcaggagagaaaagcgagaatgaactgtgaaagggaactgcacaaactggagggcaatttaaagctgaatcgggaaagtatggagaacctggaaagcagccagcgacacctggcagaagagctgaggaaaaaagaattagaattgagtcagatgaattcaaaagtggagaatgagaaaggcctggtagctcagcttcagaagacggttaaagagcttcagactcaaataaaggatttgaaagagaaactagaagctgaaaggaccactcgagccaagatggaaagggagagagctgacctcacccaagacctggctgacttgaatgagaggctggaggaggtaggaggatccagtttggctcagctggaaataactaagaaacaggaaaccaaattccagaagctgcaccgagacatggaagaggccactctgcactttgagacaacttctgcatctttgaagaagagacatgcagacagcctggctgagctcgagggccaggtagaaaatctacagcaggtcaagcagaaactggaaaaagacaagagtgacttgcagctagaagtagatgacctcctgacccgtgttgagcagatgacaagagctaaggcaaatgctgagaaactctgtactctatatgaagagcgcttgcatgaagcaactgcaaagctagataaggtgactcagttggcaaatgacctggcagcacaaaagacaaagctgtggagtgagagtggcgagttcctacggaggcttgaagagaaggaggctctgataaaccaactttccagggaaaagagcaacttcactcggcagattgaagacctgagagggcagctggaaaaggagaccaaatcccagagtgccctggcccatgccctgcagaaggctcagcgtgactgtgaccttctacgagagcagtatgaggaagaacaagaggtcaaggctgagctgcaccggaccttatccaaagtcaatgctgaaatggtgcaatggagaatgaagtatgaaaacaatgtcatccagagaacagaagacttggaggatgccaaaagagatttctaatctgacaaaccaggttagagaagggaccaagaacttaactgaaatggaaaaggtcaagaaactaattgaagaagagaagacagaagtccaggtgacactggaagaaacagagggagccctggaacgtaatgaaagcaagattcttcatttccagcttgaactcttggaagctaaagcagaacttgaaagaaagctttcagagaaagatgaagaaatagaaaattttaggaggaagcagcagtgtaccattgactccctgcagtctagtctggattctgaagctaagagcagaattgaggttacccggctgaagaagaagatggaagaggacctcaatgagatggaactccagcttagctgtgccaaccggcaggtgtcagaagcaaccaaatccctgggccagcttcagattcaaatcaaggaccttcaaatgcagctggatgacagcacacaactgaacagtgatctgaaggagcaggtggctgtggctgagcggcgcaactctcttcttcagtctgaactagaggatctaaggtccctgcaagagcagacagagcgtggccgcaggctgtcagaagaagagctcctggaagcaacagaaagaatcaatcttttctatacccagaacacaagcctcctcagccagaagaagaaactggaggctgatgttgcccggatgcagaaagaagctgaagaggtggtgcaggagtgtcaaaatgcagaagagaaggcccagaaggcagccattgaggcagcaaacttgtcagaagaactgaagaagaagcaagacaccattgcccacttggaaaggacaagagaaaatatggagcagccaattacagacttacagaaaaggctggctgaagctgaacagatggccctgatggggagtagaaagcaaatccagaaactagaatccagggttcgtgaactggaaggtgaactggagggtgaaatccgtcgcagtgcagaggcccagaggggagcccgcagacttgagcgatgcatcaaagagctgacctatcaggcagaggaagacaagaagaatctgagcaggatgcaaactcagatggataaacttcagctaaaagtgcaaaattacaagcagcaagtcgaggtggcggaaacacaagccaatcaatacctttccaagtataagaaacagcaacatgagttgaatgaagtgaaggaaagggcagaggtggcagaatctcaagtcaataaactcaaaattaaagcaagagagtttgggaaaaaggttcaagaagaatagcatcccctgctttgaaaggacaacagctggagaagtacaaggaaggtgctgtttcatggccaaaaacttaggttgcatggaaacatttttaaaaacatgtttaaattgcttttcacaccatataaacaaggcaattagaaaaataattaaagggaatatcattgcttccacagttaatggggattttttgatcctcaaatgcaagtaaactaccttctaatgcttcacatgacagattaaataaatggaagaaccttttcaattctgatgtttaaaaaatgaataaaacttgatcctttgtccatatttcctcttaatgggtaggactcatagaagatgtccttagaccagtcacgcttcatggggactagggcatgttggtgaatggtttttactaaagttaggcaactttggcttgattcacccctaaatctatgaatgtatattgtgagccagcagtggtagaatggaagtcataagatctcctcagcattgtgatataaatatagctatagttaggcaatttgaacatgtaggcaaaactctcctaatcaacacacatgtaggctatatgctggtacatgctttaaacatggaggtaaccccacacgagacattcagtgacaggtaatatgctggatttgtgcagtaccgatttggctcagctggaggaacatgtcccggaattcctctctctcatggttctggattggagtaggtcataaagaaatttgcattaatttgatcagcagctattttatactcataaggtcagtgtacagacccaagcatggtgacagcttgaaaatatgactccaggccaaaaaggggagctagaagagaccagagacagctccctggacccagagctcttccagctcctgccagcctcctccttcagctttgcaaagtactggccaggtgtgtgtgcagctccatggcaaccagcatcagcttttcctgagatcacacacagcattgcagtggaggccgtgagacagacatgggttctgtttgttcttatggacttcccttcatccttgctgcattcacagtcgacctacagtgacttcaggcccagaaccagatgcagagggaacagcctggcctagacttctccaccagcacccacaattgtgtaaggctgaagctctataataaatctttattctgtcat

SEQ ID NO: 254588 - DNA, 606 bp, Homo sapiens
attttgtccatttttcttttcctcttgtttatgccagtctttgggaagcacaggcaagagtctggaaaggctacatgaagcagcattactaggttccagatattgtagcagtattttctaagagcttttcagattttaatttttcttattctgccattcaaaaaaaaatagtggtattcagaaggagaaatctcttttaaaaaattataaagagtggtaagtaacacatgggtgctggatttgaacagaccttgtcatcaaatgtcaattcctacacaggtttcataggttgctatgagggtaaaatatggaaaacgctaagcccagtgactagaactaatgaaaactattatcattagtagtaatgtactttggaaataaaaaatacaaacttccactcccataagctcaagggtattactaaaaatgattgcctggccagaattcctggcttaaacttgtaactttctgggggttgatacatccacccctgcattcttaagcccccaattgtgatagaaaagaggtgacacattctttccttttgctagactcatgtaaaagttgccataaaccacccatggcattttcagtggagtttcaatg

SEQ ID NO: 254589 - DNA, 4920 bp, Homo sapiens
cttaagtctttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagagggacttagcaactttctgaaaagcaattcaatttcagaagaattggagagatttacagctagtggcatagccaacttgaggtgcagtgaacaggcatttgattcagatgtcactgacagtagttcaggaggggagtctgatattgaagaggaagaactgaccagagctgatcccgagcagcgtcatgtacccctgagacgcaggtcagaatggaaatgggctgcagaccgggcagctattgtcagccgctggaactggcttcaggctcatgtttctgacttggaatatcgaattcgtcagcaaacagacatttacaaacagatacgtgctaataaggggttgatagttcttggggaggtacctcccccagagcatacaacagacttatttcttccacttagttctgaggtgaagacagatcatgggactgataaattgattgagtctgtttctcagccattggaaaaccatggtgcccctattattggtcatatttcagagtcactgtctaccaaatcatgtggagcactcagacctgtcaatggagttattaacactcttcagcctgtcttggcagaccacattccaggtgacagctctgatgctgaggaacaattacataagaagcaacgactgaatctcgtctcttcatcatctgatggcacctgtgtggcagcccggacacgtcctgtactgagctgtaagaagcggaggcttgttcgacccaacagcatcgttcctctttccaagaaggttcaccggaacagcacaatccgccctggctgtgatgtgaatccctcctgcgcactgtgtggttcaggcagcatcaacaccatgcctcccgaaattcactatgaagcccctctgttggaacgtctttcccagttggactcttgtgttcatcctgttctagcatttccagatgatgttcccacaagcctgcatttccagagcatgctgaaatctcagtggcagaacaagccttttgacaaaatcaaacctcccaaaaagttatcgcttaagcacagagcacccatgccgggcagtctgccagattcagctcgtaaggacaggcacaaattggtcagctccttcctaacaacagccaagctgtcccatcaccaaacccggcctgacaggacccacaggcagcacttagacgatgtgggggccgtgcccatggtggagcgagtgacagcgccaaaagcagagcgcttgctcaacccaccaccacccgtgcatgacccaaaccacagcaaaatgagattgcgagaccattcatctgagagaagtgaagtgttgaagcatcacacagacatgagcagttcgagctacttggcagccacccaccatcctccacacagtcccttggtgcgacagctctccacctcctcagattcccctgcacccgccagctctagctcacaggttacagccagcacatcgcagcagccagtaaggaggagaaggggagagagctcatttgatattaacaacattgtcatcccaatgtctgttgctgcaacaactcgcgtagagaaactgcaatacaaggaaatccttacgcccagctggcgggaggttgatcttcagtctctgaaggggagtcctgatgaggagaatgaagagattgaggacctatccgacgcagccttcgccgccctgcatgccaaatgtgaggagatggagagggcacggtggctgtggaccacgagtgtgccaccccagcggcggggcagcaggtcctacaggtcatcagacggccggacaaccccccagctgggcagtgccaacccctccaccccccagcctgcctcccctgatgtcagcagtagccactctttgtcagaatactcccatggtcagtcccctaggagccccattagcccggaactgcactcagcacccctcacccctgtggctcgggacactctgcgacacttagccagtgaggatacccgttgttccacaccagagctggggctggatgaacagtctgtccagccctgggagcggcggaccttccccctggcgcacagtccccaggcggagtgtgaggaccagctggatgcacaggagcgagcagcccgctgcactcgacgcacctcaggcagcaagactggccgggagacagaggcagcgcccacctcgcctcccattgtccccctcaagagtcggcatctggtggcagcagccacagctcagcgcccgactcacagatgagcgggagacagccatctaaacagactcactaactattggcattaaagcttcagaaatctctgcgtttgatattcaaacatcatatgccggaaattttcacagtttttagtgaacttaaggaatttagatcctactttggtatttttttttcttgttttaatttttgttttgtttttgtttccatgttttcttgtcacacacctgagcacttcctcccgttggcaaacagaagttcaggatgagaccctgctggcctggtcctggcacatcctctgcactgttgaatcactggacttactgatcttagatgaccaccccctccctcacacctgtgggcagggcagaacagcctggcgggctacagtttagcatggccttcttgagctagggtggaatggggcagggtgctctggactcttaccccctcccctcccatctgtggcttggctctgctgtggccctcctggctgggtccccttggtttttcgtgctggaacatccccaccagagcctctctgccataactgccagctgctctccccgagtgctcagctggcagaacacctttcctttctcacccagaacttaagagactgattttttgtttcatctgcatttggtcttctctgttttgactctttcactgcagtaacctggctgtggctgctcaggttcccctcctcatgccccttggtacccttccctgtctgctctcccatgccatgtacacacccacaacccgtccttccacttggaatatttttaccacctatcctgatctttgaaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgctt

SEQ ID NO: 254590 - DNA, 582 bp, Homo sapiens
cagaaaatagtacaaacccatctggctgcaacagtccagcagcatgaagatcaaagtcacgtagtagagccagagagaaatttgccctgggcctaatattcatgaagcctttccaattcagactcggtattattgccaagtcggtgtgtttgggagaaatcagaagccaacacactagaaaagttgcaagagattcctaggggaacccacaaattcagttccttgccagaaacctgctcctccagatgaatctagtgcatcagatgggctcagaagcacaggtggcgcaggcagacctctactgagaagaacaacagtggaaggcagatgaaactcacattttggagtctgagagccatgcgggcccaccccagttacgtctacccctggtcggtgaccagagaatcctttagcagcaacagcagtgatgtttatttcactggtatgtataaagcgactgattgaaaacaagctgtatgcccaacaacttggaactggttaaatgatttttggttcagccgcacagtggaatatcatgcggccattaagaataaataaaaaatcctatactttccatattca

SEQ ID NO: 254591 - DNA, 838 bp, Homo sapiens
cagaaaatagtacaaacccatctggctgcaacagtccagcagcatgaagatcaaagtcacgtagtagagccagagagaaatttgccctgggcctaatattcatgaagcctttccaattcagactcggtattattgccaagtcggtgtgtttgggagaaatcagaagccaacacactagaaaagttgcaagagattcctaggggaacccacaaattcagttccttgccagaaacctgctcctccagatgaatctagtgcatcagatgggctcagaagcacaggtggcgcaggcagacctctactgagaagaacaacagtggaaggcagatgaaactcacattttggagtctgagagccatgcgggcccaccccagttacgtctacccctggtcggtgaccagagaatcctttagcagcaacagcagtgatgtttatttcactggtatgtataaagcgactgattgaaaacaagctgtatgcccaacaacttggaactggttaaatgatttttggttcagccgcacagtggaatatcatgcggccattaagaataaataaaaaatcctatactttccatattcaactttagactgcaaacaactgaaaaaacaccttcataattaggcttcctcagattagaacgtgaagtcaaatcaacgtgtgtcagaaagttaacaacagctaactgtttgttgtggtgttctgagtaacttgtattatttttcagtttttttcccattcctaatgtgcaaatgtactatttttattgtaaaaaaaaatacatgtttgtaaagagcaataacataaatctctgcataggcaaattgaaaggaaatca

SEQ ID NO: 254592 - DNA, 437 bp, Homo sapiens
  misc_feature (9)..(9): n is a, c, g, or t
tactaaatncgcggccgcgtcgactctgatggtctgtgagagatcaaatgaggacaggtgtaattaagctctattattaacaataatgccttgtatttgtatagtgctttataatttacagagagcgttaacatccatcaatttatttgaccctcaaaacaaccctctttgtttacttatgcatatgtataagtaaaatatgtaatattacctccagttgaggaaaccaaaacttggctgggcgcggtgggtcacgcctgtaatcccagcactttgggaagcctaggcaggtggatcctgggacctcacttagaataactaagcacggtgctcgcttcggcagcacatatactaaaattggaacgatacagagaagattagcatggcccctgcgcaaggatgacacgcaaattcgtgaagcgttccatatttaaaaa

SEQ ID NO: 254593 - DNA, 442 bp, Homo sapiens
gacacaagaagatgtcttttatcttaataatgtagtacattctaataacatgcctctgatggtctgtgagagatcaaatgaggacaggtgtaattaagctctattattaacaataatgccttgtatttgtatagtgctttataatttacagagagcgttaacatccatcaatttatttgaccctcaaaacaaccctctttgtttacttatgcatatgtataagtaaaatatgtaatattacctccagttgaggaaaccaaaacttggctgggcgcggtgggtcacgcctgtaatcccagcactttgggaagcctaggcaggtggatcctgggacctcacttagaataactaagcacggtgctcgcttcggcagcacatatactaaaattggaacgatacagagaagattagcatggcccctgcgcaaggatgacacgcaaat

SEQ ID NO: 254594 - DNA, 723 bp, Homo sapiens
cctcccaggtgatgggaaagtggaagtgctctgtagcacttctctatatgctacctgctcatgccttttgtttcaggtgctgagctgggcagatgtcagcatgaatgcaaagtgccaagttggtactggggtatgctcagatatattctcatctttgtaccatccttgtttgaacttctaagtctcatctcttcctattctatttgcagccaaagtgatagtttagcttttcacctcctagtctaaaaatgcatgccaccaaaattttcaggcagttggaagccaagcaaagaagaaagcaaggatattcagaccaaggctgggggcccttgcacctctgaattaaaatgttagttccatgtggctctgttggctaatgttgaatatgaatgtgactctagcatgacagggtgaagaggttcagtatcagaaatctgagaagttgctaaaggaggccatgagttttctggaaatgcaatatgaataatcaggaatccccagataactgtgtaccatcataggaggtggaatgtaatgtaataaataatctttcaatcagatacatttagttatatcaagtcagcagatttgaaaaaggaccctagaggccaggcacagtgataaacctgtaatcccagcactttggtaggctgaggcaggaggattgcttgaggacaggagttcgagaccagccagggcaacatagtgagactctgtctccac

SEQ ID NO: 254595 - DNA, 491 bp, Homo sapiens
gtaaaccagctaagtaacaatgcctgcttgttagaaggcatatctggctctgggagccatttcgccaggcacttataaggcccatttaacattataggacagtacaggcttcctaacagcaagggcctggcacaaggccagtgtgcctgccttaaagttagcccaactctgctgggctgggcacacttactatgaacttggcagacagaccagcaggttggtcagacagctgctggatgaggcctgggagggagggaggagcagggtttcttccagtcagggcagaagaaataccagaagcaagaactggagcttcaactccaattgaagaaaaagcagcagctagaacagaggcatgttcaggaactgaaggactcagctggggcagaagtgtcaaagatataaagcaatgttgtaaatactgactacagctggaattaaagagcaacgcttctttgtatgcagtaaaacaacaatgcactaaattcctt

SEQ ID NO: 254596 - DNA, 387 bp, Homo sapiens
gactgaagaaagatttgaatatgttgaaagcgtggtgtaccaaattctaatagataaaatgggtttttcagatgcaccaaatgctattaaaattgaatttgctcagaggataggacaccagagagactgcccaaatgcaaagcctcgacccatacttgtgtactttgaaacccctcaacaaagggattctgtcttaaaaaagtcatataaactcaaaggaacaggcattggaatctcaacagatattctaactcatgacatcagagaaagaaaagagaaagggataccatcctcccagacatatgagagcatggctataaagttgtctactccagagccatctgacctcaatagaaacagttacgctgtgctttccaagtcagagct

SEQ ID NO: 254597 - DNA, 391 bp, Homo sapiens
tcagttttactgaaaataaactcttcataggtcataaatttttagaaccggccataataaactaaatatctgtgtacaagtcccaaagcaaagatcgctgcaccggaagcctctagcagtgcttcaaacatgcttgctgctaatacttagaactgccgttatcagagacagagatgggagatgagaaagaaacagattgggagactagaaactgaagaatgccaaggagagaatccagtatgacaaaactgtcatcaatctaccatctgtgtagagtttgggggtttcagagacaacatcataggtcaacttgcttttcaaatgtctgaaattgtgcccccacatgtgtgaattgtggctagacagcatgaatcacggagtgcaatacaaa

SEQ ID NO: 254598 - DNA, 680 bp, Homo sapiens
ccgcacatagaggttaaggaaaggagctataaaaaaacatagtgttggggactgaggtgttctgaataccagagggcttggaatgctgcagctgtatcttagaaatttaaaggacagctccgaggggaaatagaacaaagctatgttcatgatgaatagcattaggaacagcagacacataacaggagagaagcaaagagaaattcaggcaggagtgtgtcatcatacctgtgaataggtcttggtttgtttcaatgctaaagtgaacaagaaatccaggagattgcactttgcagaattagaaattgcagtcggcactatcattgcactttgtgtagaaagtatttcatagtagagtctgtggatggaagggaaggaactgtgttcaaaccgtgttccatcatgtcctcgctgcaagaacttaggcttgttaacgtttctgactcttggtttctgcggtattcaagagaagctgtagccatagataatttatttgcataaatttaaagattatttttcaaagaaagctgtggatcctcggtgtgctttttatgtggtagatatttcttcaatgctggcaccactgagccgggggcttcgggagaaaggcaacagatcctggctctctggctcccagcagggctttctgtacgagggagggtggtgcccaggacccaccc

SEQ ID NO: 254599 - DNA, 375 bp, Homo sapiens
tgattttaagttgaagctagtgcacatttaccattcttaaaatcctagggcccttaagaattgtgctaaattagctgggcacagtgactcatgcctgtcatcccaatgctttaggagaccaaggcagtaggaactctcgggccaggagctcaagatgagcctggcaatgtggtgcaatcccatacaaaatttatctacaaaaaatttaaaaattagccaagcatggtggcatgtgcctgtagttctagcttctcaagaggctgagacaggaggatcacttgagctcaggggttcaaggcttcagtgagccatgattgcaccagtgcactccagcctgggcgacagagcaagactttgtctcttcaacagaaacga

SEQ ID NO: 254600 - DNA, 689 bp, Homo sapiens
ggcacagctagctaatcagagcttaacggagggactttctaatgactagagctgtcaaagctgggctgatggtcactatggacagtggtgggagcttctgtcctgggaggtgccctcagagatgggatatgctattactcaataagtctaccaacggttcctgcctcattagaactcagccagtgcaggagttagacatccatcagactcctgcatgcccagaatgtgtcaagcttgccctgctggactttttactatgggtactctgtttttcttcctagatgtcaacatttagaaatcatagtgttaccagatggtccttgctcctggagctcccaagatggtggtgggccgcttccacaatggcggtgggccgtttccaagatggtggcaagcctcctgatctctgacctggggttcttggcctcacggattccaaggaatggaatcttggtccatgcagtgagtgttatagctctattagaagctgtgggtcacagaagagaaccgtggaacccagtgactgtgttcagctcaattaggacgaacctgcgcacttagcagtgcaggaacaatgggcttttagctcaatcaggaccagcatgtgtgcctcgctggatcaggagcacagcggacaccctgctggatccagagggattgaagtcagtggcaggtctgcgatggcggca

SEQ ID NO: 254601 - DNA, 445 bp, Homo sapiens
tactcgggaggctaaggtgggaggatcgctggagcccaggaatttgaggctgcagtgagctgtgattacaccgttgcactccagcctgggtcacagatcaagaccctgtctcttaaaaataaaagttggagacaagagctggctcacctgaaaggagggattagtaggtaggagggtggatggaggatggatggatgtgtgggtggataggaagatggtattaagttggtgcaaaagtctttgatattactcttaatggctttaataaaaagcttgaaggaagaatgattggttggatagacagagataaatgcatactggaaacaaagataaagataaaacacaagttataccaggccagcaactctattttgttcactgcctttagtcccagcctggcacatagtaggcactcaataaagcctgatttgtagcaaatgcttat

SEQ ID NO: 254602 - DNA, 507 bp, Homo sapiens
aactgtagtcctcaggttgtacattagatctctgggcatatcttacatatctgcaactttataccctttgacctataatctccctattttccccccaacctgtaatcaccattttattatgtttctatgtatttggcttaaaaaaaaaaaaccccacatatgagattatgccatgtgtctttctatgtccacctaatttccttggcataatgtcttccagattcatccatgccaaaagtggtaggatctccctttttaaggcaggataacattcaattgtgtgtataaccctccatttctttatttattcatctgttgatgggacacttgggttgtcttctgtatctttgctattgtgaataaaagcagcaagagtaaaagcaacgtgccacataacaagggagtcttcattagacaatcagctttttcagcagaaagtttgcaggccaggagagatgggtggtgtatttaaagtgctgaaagaattaaaaaacaaaactgaaatta

SEQ ID NO: 254603 - DNA, 631 bp, Homo sapiens
ccactatataaatatatgactgaaaggaacatatgaaatagggataattcttagagagtgggattagaaagagaagtaacaatatggaaatttttctttcataatactttatttttttccagtgaacacatattacttttattttttttttaaacctgaaaaatatcagggcaatataagtggttgttaaaaaacatcaacttttgaagttagatttgaggtcaaaatcaagttctaccatgtactagttttataactttgggtaagtcacttaacattgctgagtctgtgttctcatatgtagaatagggaaaatgaaagtacttattttggccggtcgcggaggctcatgcctgtaatcccagcactttgggaggccaaggcgggtggatcacaaggtcaggagttcaagaccagcctgaccaacatggtgaaactccacctctactaaaaatacaaaaattagcagggtgtggtggcatgcacctgtaatcccagctactcgggaggccagggcaggagaattgcttgaatccaggaggtgaagcttgcagtgagccaagattgcaccactgcactccagcctgggcgacagagggagactccatctcaaaaaaaaaaaaaagtactt

SEQ ID NO: 254604 - DNA, 295 bp, Homo sapiens
gaaaactttaagaggtattatgagtgagctataacctcctctttaataagaagagtcagtaactgttgtctaaagtggttaagttgagaagtaaaagtataagcatataatatagtgttatggatcagaatatctaaagagaaattaaaagaaatttctctttgaagtagaggtaaagagggttggagcgggagacttgcttctcatcacaccttcttcaaaactatgaactgttatcatgtgcatgcattattaatactttagttttaaaaattaaattaattatttcaacaaa

SEQ ID NO: 254605 - DNA, 517 bp, Homo sapiens
aattcccaccactgagaccactgttagtcttcagggggctgcagccatcgcccccaactcctcggaggagcaacgcgcgacaaaatggctggcagccatcttgcggcactacaaaagatgcgcatgcgccagatccagtgagccattcactacgcagactccgacaccaaaccgtatttattgctgcccatagaagataacattcacagccgcttgaccatttaggttacaggaaaaggaaataaatgaggaagtgaaaggaaattttcctcataaaatttttcgaggcgaaaaaagaatggcaagatgtgacctcattttcgccagctatgatacaatcttaaaattgcataatacattacagttttcaagagtcttacgtaactattatatgaaccttatacgaaccattttatcgcaggtatctatgtaaatcctctgagctaatttaaaggctcctgtgttcccactaaacatatacagttttaattcttttaacgtctcctcactgcggcca

SEQ ID NO: 254606 - DNA, 250 bp, Homo sapiens
aggaacctgaagaaatttgagacgagagaacagaagggatttagctagaactggaggggcaggtagagggaacagcaaatagaacaatcctggctgctgattttataaaatgaaacattttatcacagtcctaagagaagcctacatgtctgcttctcagttttaattgtgacatgtgctttagttacctggaaaatcactgccttcttaaaattatattttaaaaagatgccaccaccatctctaccaa

SEQ ID NO: 254607 - DNA, 406 bp, Homo sapiens
cagcatcgatcctgctgcacagagaaatctgtgaacttgggagagggagagtgcagtgggtgggggactttgcattgaactcagtgctgtcctgttacagtggagacctgtcaggattcatcacctgctaactaaagactccctgggtcctgaataaccaacaatgatacccaggtaatatgccatgggctttgggctcttagatacgttggcttcaggtgtgacccagcacattcccagctgtggtggctgtggtgaaagactccttctgtttgagaaaagcagggggaaaattaagggaactcttgcatgtttgatttttcaaatggattcctgcctgtgtgtgaccactcttttctctcaaaaactcatcatgggaacactgcaataaaaccaaagaaccagg

SEQ ID NO: 254608 - DNA, 546 bp, Homo sapiens
acaaatggacttaacagatatatacagaacaactgcaaaatatacattctattcaacagtgcatggaactttctccaagatagaccatatgataggccataaaatgagccttagtgaatttaagaaaattgaattatatcaagcactctgtcagaccacagtggaataaaactggaaatcaactccaaatggaatcttcaaaaccatgcaaatacatggaaattaaataacctgctcctgaatgagcattgtgtcaaaaatgaaatcaagatggaaattatacaattatttgaactgaacaacaataatgacacaacttatcaaaacctctgggatacagcaaaggtggtgctaagaggaaagttcatagccctaaatgcctacatcaaaaagactgaaagagcaaaaaagacaatctacagtcacacctcagggatctagaaacaagaacaaaccaaacccaaacccagcagaagaaaggaaataatcaagatcagagcagaactaaatgaaattgaaacaaaaaaaaaccatacaaaaaaataa

SEQ ID NO: 254609 - DNA, 554 bp, Homo sapiens
gagataaacctggatttagttcaaaattttataaatgtcttaatcttctttgcattgccagcactgagcaaatcctgcatggtgtactagttgtcttagtccattcagactgctgcaacaaaatactatagcctgagtagtttataaacaacagaaatgtatttatcatagttctggaggctgggaagttcaagatcaatgcactggcaaagactgtgtctggtgaggccctgtttcctgcttcatggatagccatcattttgccatgtcctcacatggctgaagggaataacaagttctctagagtctcttatataaaggcactaattctattcatgaggtctctactcccatgacctaattacctcccaaaggccccacctcctaatagcatcaccttgggtgttagaattccaacatataaattttggggggacacaaactttcagactataacactagcagtattttattattgtggttgcttttaatggaaacatgacacctttgataataaaaggttcagtgtgcagttttgaaattttgtgagcaga

SEQ ID NO: 254610 - DNA, 346 bp, Homo sapiens
gacctggattatggctggcattcaataaatagtagctgttaattgatagctaagctagaactctgaagtctaccatggcaacttcttaagtggtctgagaacccagttgtgttctgtggcaaaacacagcttagggatccatacccagccctcctgtcagctgttcaccttccagttcttcagagacatgtgtggcagtgactttggccacatagctggctgtgccctttaaaggcattccttgacacagatatgtggactggtgacgttgctctccagccaggtgttcttcccagcaggctggcctggctgtctcctgcatgcctgtacttgtttgtctccctgc

SEQ ID NO: 254611 - DNA, 366 bp, Homo sapiens
caatcaagatgtagaacatttccatcacccaaaaaatgttctcttataccactttgcagtcagtcctcaccccaagtctgggccatagacaacggctgatatgattattttcactgtagagtagatctgtctttttaaaaattttatataaataaactaatgcaatatgtactcttttatgtcttctttctgagattcatatacatcatgacactccttgggtgtttactcaagagaaatgaaaatatatatccacccaaagatctgtacacagatgttcatagcggtattatttaggatgaccaaaaagtagaaacaacctaaatgtccattagcagttgaatgaataaacaaagtgtgattcat

SEQ ID NO: 254612 - DNA, 236 bp, Homo sapiens
ggagagactgaggctcagagaggtgaggtctgaacttggagctctggactccaaaacccagtttcttttcatggtaccaggctgccaggaggagaaaggatggagcttagattcaagtcttgcaacattcttcttagtccagtattggcttattttgttttatatttttttgagacggagtcttgctctgttacccaggctggagtgcagtggcgtgatttctgctcactgcaacc

SEQ ID NO: 254613 - DNA, 387 bp, Homo sapiens
aggtgtctgagtatctttttgggtttggggctcagtggattccatcaccattatccctccttttcctctttgaaacagaattttctttctgaaaaaccttccggccgggtgcggtggctcacgcctgtaatcccagcactttgggaggctgaggcgggcagcggataacctgaggtcgggagttcgagactagcctgaccaacttggagaaaccccgtctctgctaaaaatacaaaattagccgggcgtggtggcgcattcctgtaatcccagttactcgggaggctgaggcaggagaatcgcttgaacctgggaggcggaggttgcggtgagccgagatcgcgccattgcactccagcctgggcaacaaaaccgaaactccatctc

SEQ ID NO: 254614 - DNA, 395 bp, Homo sapiens
taggggtcccagcagcgctcaaagaagacaaatgtcccgaatgtagtgatggggccagaaacaccaagccttctgaagaggaaagaagtgtatgtaaaatgaacagaatgagtcatgggcagaatttccccacttttagaaatcaaactaaatgtttctgactacagtacagagttctagaccataatccaggagtgttaagaaatgaccctccctaccttaaacacctctgtggtttcaggagcttgttcaagcttaccctagatataaaacacagggaagcccagtccgggggtcacctcttcagctccctgctctccttccctcagtgaataaagcagttggttagatcggcaatctcactgagaattccagtggactagtagtagtatcca

SEQ ID NO: 254615 - DNA, 444 bp, Homo sapiens
ccaagtttccaagaagggaagatggagtggagggcgcccaccctatctccagtggacatcccctgggctactcctctcctgatgagaaaatgctcacttcagccaagtgcagaatggtcccctttgttttcgtgggtatcagtggagaatgagatccttcatatggaatctccctgtgttgctcaggctgatctcgaactcctgagcccaagcatgcatcagcctctcagtagctgtgattacaggcattgagtcaccactcctgagaaataacaggactttggtgctattctccaagctgaaagccatcctcttcggccctgaggacacagctttttctgccataactcactgtctccactggctcaattagccaattagtggcattgtagagggctgagatgttactttttagtttccaataaaattctcaagttggtttca

SEQ ID NO: 254616 - DNA, 828 bp, Homo sapiens
ccaagtttccaagaagggaagatggagtggagggcgcccaccctatctccagtggacatcccctgggctactcctctcctgatgagaaaatgctcacttcagccaagtgcagaatggtcccctttgttttcgtgggtatcagtggagaatgagatccttcatatggaatctccctgtgttgctcaggctgatctcgaactcctgagcccaagcatgcatcagcctctcagtagctgtgattacaggcattgagtcaccactcctgagaaataacaggactttggtgctattctccaagctgaaagccatcctcttcggccctgaggacacagctttttctgccataactcactgtctccactggctcaattagccaattagtggcattgtagagggctgagatgttactttttagtttccaataaaattctcaagttggtttcaattctccttataatgatgataaagtcaaagctcagaggaactgaacgatggccccttaaaatttatattttgaagccctaactcccaatgtgaatgtatttggagattggccctctttaaagaggtaattatggttaaatcaggttacaagggtggggcttaaggcaataagactggtgtgctgaaaaaacggggaagaggctggccgcagtgcctcatggctgtaatctcagcactttgggaatctaaggcaggggtttgagaccagactgggcaacatggtgaaaccctgtctctacaaaaaatttaaaaattagtgtaggggggtgccaggcgtggtggctcatgcctgtaatcccagcactttgggaatccaaggcgggt

SEQ ID NO: 254617 - DNA, 810 bp, Homo sapiens
agacatcagtactggaagttatgccttgccttcttcccagcagaaaagtagaaaagtacaaaaaatctgctcctctgggttgaaacccgggcgccaccaagatgccagcttaccactcttctctcatggatcctgacactgaactcattggaaacatggcactgttacctatcagaagtcaattcaaaggacctgcccccagagagacaaaagatacagatactgtggatgaagccatctattagttcaaggccaatgtcttcttcaaaaactatgaagttaagaatgaagctgacaggaccttgatatacgtatctctgtctacgtttctgagtgtctgaaggaactccagaagtgcaattccaaaagccaaggtgagaaagaaatgtatacactgggaatcactaactttcccattcctggagaacctggttttccacttaatgcaatgtatcccaaacctgcaaacaaacaggaagatgaagtgatgagggcctatttacaacatctaaggcaagagactgggctgagactttgtgagaaagttttcgaccctcagaatgataaacgctgcaagtggtggacttgttttgtgaagagacagttcatgctagagtctttcaagacctggacagtgaaaggagtacgggcagccaccatctccagagccctgggcagcattttccagcaagatatacgaatcttttgcctttatttcataaagttttatacagaagagagaagaccatgtctttacttgaaaaactcttgatcaagaatttgggtgggagaaaagaaagtgggttatca

SEQ ID NO: 254618 - DNA, 146 bp, Homo sapiens
tcccttccttgtacccaactactagcaaaaaggcttggagcatccgggaatggccttgatactgaagtcagcaggcaaaatctactactgcctgagcaccaggccaaggggccaaaaatggtctggagattaccctcttgttacct

SEQ ID NO: 254619 - DNA, 518 bp, Homo sapiens
aactgaacaagaaatcgtgactaagccactgttatataagggttctctgttatttgcagctggtctgaatcataacttaccccatgtttctcaaattaaacaaactgccagttaagtctccatcaagaagttgttgctggtgagcagcacctgattatgatcctctattcacttcaaggccataaaactttggttcctccaacccatctatcttaacaccatcacaggaaggtaaacgtccccaagctaagaaagctgcattctgtacctgtgttggcagcttgagaaaaatcacaggaagtggccagttaaaaatagaactcactgcttggtgctcttctaatctgtgaccctctcccacgtccatggtacttgcccttcgggttctacggctgtctgtaccagcgcttcctagatgtgcgttcttttttccctgatgacagctggctcacctggcacctcagctcatcctgtcacagacttctgttctaataatggatatggacatgtttttatga

SEQ ID NO: 254620 - DNA, 471 bp, Homo sapiens
gatgaaatttgcatatgcactagattagagcgcagcgttgcatcaatatcatgtttcctgattttgattattgcattgtgtgtatatgagagaacgtcttaggaattacacacttgagtacttaggtgtaaaggagactgatgttgaatgttgaagacaacattcattttctcagggttccaaaataaatacgcatcaagagacagaatgaagattataaaacaaacggggcaaaatgtagtcaggtgaatctggatataggataaaaaaattccttatataatttttgcaacttttcaataagctagaaatcataataaaaagttaccaaaaatcactaacaaaattaatatcataaaacatgttattagagttgtcgacgaaaaaaatctaacttttgtcagatacagtgagttctgcttcaaagctttagtttttgacctctttgttcttcattctcaagatcagctt

SEQ ID NO: 254621 - DNA, 416 bp, Homo sapiens
gcctcaacaatggtattaggtgtttgtcacgcttactcctttcttggctctctttcctctgtttggtttatgttcagtatgaacagttacagaatagatgctgagaggcccctgttgtcctcaatttttggcagagagcatgatgggaaagtaaaatacaccttttccagcaggtcaagcaaaagtccctaggagcactgtgactggtctggcttgggtcatgtgctcatccctggaccagtaaacaccccggggatgatataatctggccaggattgaggccacagtgcagatgcaggtcacacctcctgagccactgagactaacacaagttattttagagaaggggttgagtgggtctccaaagcatattggccaccatggccttcatgaccctggctgtgtccctgctccct

SEQ ID NO: 254622 - DNA, 569 bp, Homo sapiens
ttaaatacagccttttcatcttaaaaattacattaagtttctggaattctgatatacccaattccaagtaagcatgctttgagctgaattgagcctttaggagttggaatatttgggacctagtccccaaccaagtcttcaggacttctcaaataattaattcaggccatacaagagatttggtgaatgatacagagcagtagaagtcccataaatgggggaaagagaagacataggggttacaggagaggagagaagggtattgttagggaagtacatgaagtcataaagtagcacttactgaagacctgggattttctaattaagcccaagcaattctcctgaattcagttcaatttatgggttcgtatgctaaagaaaaaaaatatcaattcatcttgatactattttgatcattatttccacaggaaagatttccaacattcttattcagattgaatttcatagtaaaatacctacttcaaaattaatgcccatatgatttttgagtaatttttactacttatacttaaggaatatttttatattgttttcattgaaatggaagt

SEQ ID NO: 254623 - DNA, 659 bp, Homo sapiens
ataaacaatagaaatttatttattacagttctggaggctggcaagttcaagatcaaggtgccagaagatttggtgtttggtgagaacccactttctggttcctagaaataacaatttctccctgagtcctcacatagtagtggggatgaagaagttctttgggatctcttttataagggcactaatcccttttataagggctccaccttaatgatctagtcacttcccagacgccccacttccaaataccatcacattggggattaggtttcaacatacaaattttaggaggacacagacattcagactgtagcaatcccttgtgcccatttgtttttcctttaggatggtcattttctgctgctatggcccagtttgtgccttcaaggactgactgtgtaaaaaagagcccagaaactctttgaactgacttacagtagcttcttcagcagtcagctgtaacgatggctggagcacctggtacctgagtgagggccaagaatgggctctgcatgtgccctccctcaacaattgcccaccacccattctcacacaaatgcagtgggggatgaacctgtagggatgggtaatcagcctgaaaggaacaattttgcatatgtgtaaaatctgaaaaaataaattattattcatgggaaaca

SEQ ID NO: 254624 - DNA, 432 bp, Homo sapiens
ttaaatacagccttttcatcttaaaaattacattaagtttctggaattctgatatacccaattccaattctggaggctggcaagttcaagatcaaggtgccagaagatttggtgtttggatggtcattttctgctgctatggcccagtttgtgccttcaaggactgactgtgtaaaaaagagcccagaaactctttgaactgacttacagtagcttcttcagcagtcagctgtaacgatggctggagcacctggtacctgagtgagggccaagaatgggctctgcatgtgccctccctcaacaattgcccaccacccattctcacacaaatgcagtgggggatgaacctgtagggatgggtaatcagcctgaaaggaacaattttgcatatgtgtaaaatctgaaaaaataaattattattcatgggaaaca

SEQ ID NO: 254625 - DNA, 852 bp, Homo sapiens
gaaaattataagaaattcaagttccagtatccatcaagtgtactggaacatacccaagttcattgatttataaatatactatatatgataatgctttggctctgtgtccccacccaaatctcatcttgaattgtactcccataattctcatgtgttgtaggagtgaccccctgggagataatctgaatcatgggggcagtttcccacatgctgttcttgtggtagtaagtctcacgagatctgatggttttatcaggggtttccgcttttgcatccttctcattttctcttgtcactgccatgcaagaagtgtctttcacctttcgccatgattctgaagccttcccagccatgtggaagtgtaagtccaattaaacttcttttttttttcccagtctcaggtacgtctttatcagcagcgtgaaaaaggactaatacaatatactatatagtttatggctgtttttcatactacaatggcagagttgagtactttaggcctgcaaaacctaaaacaaataccacctgccctttacagaaaatgtttgccaacccttagtttaggatctattatttatctctgccctccagtgaccctgccatctaatcatttggcctcttaactctctctttaccctgagcaaatccgtaaaataaaaggtatacctttccccaagtactattaaagaaaagaagaggagaggggaaaagggaaaaaggggaaaagaaagtgaggaaagggagaggatgcaaaagaaaaagaaggaaagaaaggaatttccctgatgagatcccttagtaataccttatcagctgttcataatcaaaattcctagaagaggaacaacagct

SEQ ID NO: 254626 - DNA, 363 bp, Homo sapiens
taagaaaatgatccatttgtgaaaataattcccacaacactgaactctttgcctcaagtgttatataaaagtcaactcactggtcaacaagaaaaaaagtcagatacaactaccaatcagcctttctgatttgttgaaattaatttcagaattggattttctaagtggggtcgtctgccgaaaagacatgctaaaaacctaaaatctaattcgtgttaaaattagctgaaaatctgaagcattgtttataggcttgacgctctttcttctcccacccccaccccaacacatacaaacgtttcccaccaatccttgaactgcaaaaaacagcttggtaaaaatcggcatcatagcaaagatgca

SEQ ID NO: 254627 - DNA, 478 bp, Homo sapiens
agtaaggacactttgctcaggcatgtactattttgcatagaaaaatactaaccaaattcctcaagggtgaggaaggttaataatttgaaactggacctgctggggttcctgatgctgttgagttcactgcctaccagatcactaaccttgccttttcagttaagtgttgctgtacggacagaaggtggagaaaccacccctgcaggttgcctgctgcctgatggtcccagctctccatcccaggtatttgtttggtgatgaaaagctgagctcatgaagaagtggaaagtgctggaagaaagaattaacacatccttcctagggaggccaaatgttagatcaatcatgtcttccagccactacagtgattgcagggaatgagatgttaatttatgcccagtgccatcaggagcctgggaagtgagttctatgatctgtctgattcttcagccaatgtagctgcctctgctccctctga

SEQ ID NO: 254628 - DNA, 2976 bp, Homo sapiens
  misc_feature (28)..(28): n is a, c, g, or t
  misc_feature (149)..(149): n is a, c, g, or t
  misc_feature (181)..(181): n is a, c, g, or t
gcttcccagtgagtttctttcaaaaacntccacccatgtctccgctgaactaaagagaaaggaatttgtccagagcatcaggaaagcagccagaggaagtccccagggaccaggcgtggggccctaagccacactgcagctgcagggangagagtgagcccagcttgtgctgctgcggggnggggaggactcctgaggggacaagggggaatcagggagcagagagactaagggggagggggaggaggagactcagggacagagggtgaggctcagtgggagagaaaggggagacagggtatgggggtaaccaggaggcagagaaagtggagaagagcggagggagttgagggggaggcaggaaccaaggtgtagccaagggcaggtgagggaggagggactctgagcctgggccaggggagtcagaaggccggagccctgaagggccccacagccctccccggccctgctgtctccatacaattctgtggccaaggagtgaaccttgcatgatttcagccaccccacccagacaccccccaccctggaacaaaggggaagtggccccatgggcctgcctgcttccagctcagggctgggcttggtcaccaggcaggcacttgttgtagcaacagtccctggggacccatcctggggaacaggactgctagcagtaaagatgggggagccagggcccccatcccctccagcccccaaggctgccccaggcctcattgacagcttctctgagatgaacaactaccggcgggccatgcagaagatggcagaggacatcctgtctctgcggagacaggccagcatcctggaaggagagaaccgcatactgaggagccgcctggcccagcaggaggaggaagaggggcagggcaaagccaatgaggcccagaacacggtgtccatgaagcagaaactgctgctgagtgagctggatatgaagaaactgagggacagggtgcagcatttgcagaatgagctgattcgaaagaatgatcgagagaaggagctgctccttctgtatcaggcccagcagccacaggccgctctgctgaagcagtaccagggcaagctgcagaagatgaaggcgctggaggagactgtgcggcaccaagagaaggtgatcgagaagatggagcgggtgctggaggacaggctgcaggacaggagcaagccccctcctctgaacaggcagcagggaaagccctacacgggcttccctatgctctcagcctctggccttcccttgggttctatgggagagaacctgccggttgaactttactcggtgctgctggcagaaaacgcgaagctgcggacggagctggataagaaccgccaccagcaggcccccatcattctgcagcaacaggccctgccggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctatgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcaaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcatgcaccccgctttgcacaccacagagtgccctcacccactccatggacctcaagcagccctcagagctggagcccctgctgcccagctcagactttaagctcaacaagcccttgagcccccagaaggagaccgctaactttcagcagacctgagccccagagcaggcctccttccctgtgtgctggggagtctcatcaccgccccctaaaaatgacgttattaaatgttgtagctctgtgagcattttcctctttcctggagcagggcagcctgggggccctgcttcctcctcctagacctcactctgggcctgggcctgggtcttctgctgcagccttacagcctcccgcctgccccaggagccagcatctttggaaagccaagggccacagtggacccaggagggtggagagaagaggccttccaaagcaggggccagggagacgggccccttccagacccggagaagaagcaaggccaccagagaccagctctgttgggaaatacgagggaggcttgtccttttcatctgccccaaaacatctatcatgtctgatattccttct

SEQ ID NO: 254629 - DNA, 935 bp, Homo sapiens
  misc_feature (28)..(28): n is a, c, g, or t
  misc_feature (149)..(149): n is a, c, g, or t
  misc_feature (181)..(181): n is a, c, g, or t
  misc_feature (930)..(931): n is a, c, g, or t
gcttcccagtgagtttctttcaaaaacntccacccatgtctccgctgaactaaagagaaaggaatttgtccagagcatcaggaaagcagccagaggaagtccccagggaccaggcgtggggccctaagccacactgcagctgcagggangagagtgagcccagcttgtgctgctgcggggnggggaggactcctgaggggacaagggggaatcagggagcagagagactaagggggagggggaggaggagactcagggacagagggtgaggctcagtgggagagaaaggggagacagggtatgggggtaaccaggaggcagagaaagtggagaagagcggagggagttgagggggaggcaggaaccaaggtgtagccaagggcaggtgagggaggagggactctgagcctgggccaggggagtcagaaggccggagccctgaagggccccacagccctccccggccctgctgtctccatacaattctgtggccaaggagtgaaccttgcatgatttcagccaccccacccagacaccccccaccctggaacaaaggggaagtggccccatgggcctgcctgcttccagctcagggctgggcttggtcaccaggcaggcacttgttgtagcaacagtccctggggacccatcctggggaacaggactgctagcagtaaagatgggggagccagggcccccatcccctccagcccccaaggctgccccaggcctcattgacagcttctctgtaagtcgccccctcgcccactggttctgggaagatgggttggctcgcctagcagcaggtgtgttggggtgtgttgcccagcaaccagtagaggtgttcccagagcctcttaagtgggaggcagggtggagaggaccagggctttggcccttagatgcccgtggtcacaggaatcttttgcnnggcc

SEQ ID NO: 254630 - DNA, 879 bp, Homo sapiens
tatgttgttgaaatgtccatctgtgtcttggtcaggctgcctgactgtttggccccctcaccctcaccccgccacccctgaggtctcgggaaggtgtcaagcccacatggcccagagctttgctttcttcctggacagcaggctcaggccctggttgtcctggccatcagggattagccctgctgcccatggtcctccaattgtccctctctgtgtctgcagttagaggactcagctcgacgctggggacgagagaagcaggatctggccacacggctgcaggagcaagaaaaaggtttcaggcacccctcgaactccatcatcatagaacagcctagtgccctcacccactccatggacctcaagcagccctcagagctggagcccctgctgcccagctcagactttaagctcaacaagcccttgagcccccagaaggagaccgctaactttcagcagacctgagccccagagcaggcctccttccctgtgtgctggggagtctcatcaccgccccctaaaaatgacgttattaaatgttgtagctctgtgagcattttcctctttcctggagcagggcagcctgggggccctgcttcctcctcctagacctcactctgggcctgggcctgggtcttctgctgcagccttacagcctcccgcctgccccaggagccagcatctttggaaagccaagggccacagtggacccaggagggtggagagaagaggccttccaaagcaggggccagggagacgggccccttccagacccggagaagaagcaaggccaccagagaccagctctgttgggaaatacgagggaggcttgtccttttcatctgccccaaaacatctatcatgtctgatattccttct

SEQ ID NO: 254631 - DNA, 1635 bp, Homo sapiens
acaagagacgcatggcccaggccactcagagtgcacagagaccctgcccgcacaggatctcctctctggtacttcagacaagttcaacctcctggccaagctggaacacgctcagagccggatcctgtccctggaaagccagttagaggactcagctcgacgctggggacgagagaagcaggatctggccacacggctgcaggagcaagaaaaaggtttcaggcacccctcgaactccatcatcatagaacagcctgtgagtgacccccctggagtagctcccaggggttcaggtggtggagcaggaagccaccgcacccccaaagtcactgggccctgagaaaagccattgtggagccaactccagggctgggggtcaggagtcctaggctcccattcctgctccattaccaaccgaaggctcggtcttaattcccccacctgtctaaggggaacagaaaacccctgccaaaactaccctttcccccatggggtgctatgaaactcaaggagatgactgtggatgaggggtccatgcaggcatctccaggatgccctgacactgtgctttaggactggctgcgctcatgggcagagtagcttgtggccctacccccctgaatccatagagcctaagattctcaaattagcacacccttctcagatggccacgatgtaggctccactttgccaacttcccgagaacaaacaggcctgctcacaactgcccctcaagttcaaccccgggaccgcccagccccgcaaagcaaagaccctgacttctcctgctcttgagccagctgtgctttgcccgtggccagaagctcagcagcggctcctgggaaaggcctggaaaggatgagggaacaggcaaggaacaaaggcaacctttgcacactcacctgagccctggggacccttggagaaattaggtgtcacctgctgtggcaaaatgggtttagaaatctttgccaggtcatggcccactggattctggatactctgaggcctggtttgtcaggcaatatgcccttgagcaggtcaccccctgggaatggggggtactcatgcaccccgctttgcacaccacagagtgccctcacccactccatggacctcaagcagccctcagagctggagcccctgctgcccagctcagactttaagctcaacaagcccttgagcccccagaaggagaccgctaactttcagcagacctgagccccagagcaggcctccttccctgtgtgctggggagtctcatcaccgccccctaaaaatgacgttattaaatgttgtagctctgtgagcattttcctctttcctggagcagggcagcctgggggccctgcttcctcctcctagacctcactctgggcctgggcctgggtcttctgctgcagccttacagcctcccgcctgccccaggagccagcatctttggaaagccaagggccacagtggacccaggagggtggagagaagaggccttccaaagcaggggccagggagacgggccccttccagacccggagaagaagcaaggccaccagagaccagctctgttgggaaatacgagggaggcttgtccttttcatctgccccaaaacatctatcatgtctgatattccttct

SEQ ID NO: 254632 - DNA, 424 bp, Homo sapiens
cccaaagtactgggattacaggcatgaaccatcgagtctggcccaccctgcggtatcctcttgatgagaagaaatttctaccagacattggtgctgagctaagctctgtggcctttcctggcatgctgatattctcttatcctatgactactgtatcttttgtaactgatcatgtttcccactttgttcatgagaaagctcagaaccaaacttgttcagggactttgagcataagtttccaggtacaagaattttccctggctttatttgatttttctacccgtgttttccctccgctctatccccttactatttttatcccactatattgtgtgcattttgctaagctacctcaaatccttttttgaaacacaaaggagcataaataaatcaataaatagatcctgtgtttgtaaatatggca

SEQ ID NO: 254633 - DNA, 758 bp, Homo sapiens
gacacatacacacacacacacacacacacacacacacacacacacacacgaagagagagagagaatttagagcactgatcttttctctcttagactaattattttaacattattttcagccactttattaattgtggggttaagggtaggatagatctaatgcccatttcacatgtgttgcaacatcagagattatggttttcattaaaaacatcagagctaaattccttttcaaaaaagacattgttactgttagtaccttggggaatgttgtagtcttatgaatgctgatacgtttatttgagccaattgaatattatctctaatataaactataatttactgtgtgattcctcttcctgttttacctatatatactcaaagtgaatgattgtgtttagtgaacatttctttaggtaataaaaattaatttcatttaagaaagaagtacaaaatagttattagagcaaactttggtatttgtaattttgaagttacatacttttgaaataaacttgggctttcatgccatgttgggtttgaggaagatagcaaatgtataaattgagctctctagtcataaccttgctatatgtattcctgctcattaaaatactttgcgccagcaaaaatgatttccaacatatgtgttttggatgtaattaagtaactgtataaaactaagtatgttttttctcctttccccagtgactggaaaactttcatacttttaaggtaataataaaataataatcttt

SEQ ID NO: 254634 - DNA, 280 bp, Homo sapiens
tttaaggtgctccagctacaaatgcattttttcatcatttgtcatccacaaaacagtgaccagacagaacacatccagaagatatttgaaagacaccttcagagccctctccccagaagtagagtggtgaaaaatgacagacggtgatggagtaagaaaatctcaccctgcagcacttacattatgaccttataatattttggtttgtgtttaattatcttcttatgccaataatcttatgcatcttatgttatttcagataataaacttagacaaaaga

SEQ ID NO: 254635 - DNA, 213 bp, Homo sapiens
aattttattgataattacatattaaacattccttgtttacttcagccagatgaacaaggtcaacattaacagttacatgtggcatagtgccacggttattacttgagactgtcactatgacagttactgctgttactacttgagaccgtcattatgagactgagtgaagggggacaaatgtagaaatgaaaaattaagacaaaagaaactttt

SEQ ID NO: 254636 - DNA, 1555 bp, Homo sapiens
cggcgatggccccactcggatacttcttactcctctgcagcctgaagcaggctctgggcagctacccgatctggtggtcgctggctgttgggccacagtattcctccctgggctcgcagcccatcctgtgtgccagcatcccgggcctggtccccaagcagctccgcttctgcaggaactacgtggagatcatgcccagcgtggccgagggcatcaagattggcatccaggagtgccagcaccagttccgcggccgccggtggaactgcaccaccgtccacgacagcctggccatcttcgggcccgtgctggacaaagctaccagggagtcggcctttgtccacgccattgcctcagccggtgtggcctttgcagtgacacgctcatgtgcagaaggcacggccgccatctgtggctgcagcagccgccaccagggctcaccaggcaagggctggaagtggggtggctgtagcgaggacatcgagtttggtgggatggtgtctcgggagttcgccgacgcccgggagaaccggccagatgcccgctcagccatgaaccgccacaacaacgaggctgggcgccaggccatcgccagccacatgcacctcaagtgcaagtgccacgggctgtcgggcagctgcgaggtgaagacatgctggtggtcgcaacccgacttccgcgccatcggtgacttcctcaaggacaagtacgacagcgcctcggagatggtggtggagaagcaccgggagtcccgcggctgggtggagaccctgcggccgcgctacacctacttcaaggtgcccacggagcgcgacctggtctactacgaggcctcgcccaacttctgcgagcccaaccctgagacgggctccttcggcacgcgcgaccgcacctgcaacgtcagctcgcacggcatcgacggctgcgacctgctgtgctgcggccgcggccacaacgcgcgagcggagcggcgccgggagaagtgccgctgcgtgttccactggtgctgctacgtcagctgccaggagtgcacgcgcgtctacgacgtgcacacctgcaagtaggcaccggccgcggctccccctggacggggcgggccctgcctgagggtgggcttttccctgggtggagcaggactcccacctaaacggggcagtactcctccctgggggcgggactcctccctgggggtggggctcctacctgggggcagaactcctacctgaaggcagggctcctccctggagctagtgtctcctctctggtggctgggctgctcctgaatgaggcggagctccaggatggggaggggctctgcgttggcttctccctggggacggggctcccctggacagaggcggggctacagattgggcggggcttctcttgggtgggacagggcttctcctgcgggggcgaggcccctcccagtaagggcgtggctctgggtgggcggggcactaggtaggcttctacctgcaggcggggctcctcctgaaggaggcggggctctaggatggggcacggctctggggtaggctgctccctgagggcg

SEQ ID NO: 254637 - DNA, 350 bp, Homo sapiens
agattattgttgatatgttaagatttttctcctgatttttaaagccatattttatcatctgtctcttattaaatatccctgatgccacaaggtctgctcacctgcatacctcttttggtgtatgcccccacctctttttggtcatcttaatcttaattgttgaagtgctttcctttgtgaaatatttcatcctgaaaaatcttgtcttctttccaaagcccttaattgtgcgagtttaagtgaaggaaatagttctttttcaagaaaaaaatatttattttttaaatgaaatcccacattttagtagataatatgaatcacattattgtgaaaaatgttatgcatgaaaa

SEQ ID NO: 254638 - DNA, 439 bp, Homo sapiens
taactgaattgctgttactaaggcaggtactcatcctactctgaaaacggagacggccctgcaggagacccaggaggtggggctgtagcctcccatgcagaggtctcttgctccctcagctggtggagggtgacagccgaatgtgaagaaacccagtcaaccacttcaggagagggagaacaatttttgctgctgtaaagcaggaaacccattgtccaattttagattggcatgagagtgttatagtagaaaagaggctgcttacatcgaagtaaatgcaccttgagcataaattgtaaaaataagaaaatgtaactgctaatttctcctgagagggttccaactagtctttaacacaatacttgtaaataacagtgggatagattccagggctctaatgtgtagttggtcatgcaattaaagcactccgtttctcata

SEQ ID NO: 254639 - DNA, 311 bp, Homo sapiens
caggagtgaagcagagatacatattttttattaaaaggggccaagaaaggatccatgaaaagaatagaatgccagccgggtgcagtggctcactcctgtaatcccagcactttgggaggccgatgcaggtggatcacctgagaccagcctggccaacatggtgaaaccccatggtggcgggcgcctataataccagctactcaggaggctgaggcagaagaatcgcttcaatctgggaggcagaggttgcagtgagctgagattgtgcccctgccctccaacctgggtgacaagagtgagactccatctta

SEQ ID NO: 254640 - DNA, 600 bp, Homo sapiens
gaaatggaatccagtagaaatgatgccaaagatgatcttggtaatttaaatgtgcctgattcatctctccctgctgaaaatgaagcaactggccctggctttattcctccacctcttgctccagtcagaggaccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctatccaccgaggggtttacctccttaccttcatccgagacctggattttaccccaaccccacattctgaaggtagaagcgagttcccttcaggattgattccgccttcaaaggagcctgctactggacatccagaaccacagcaagaaacctgacaatattgttgctttcttcaaaagtaattttgactgatctcattttcagtttaagtaactgctgttacttaagtgattgcacttttctcaaattgaagtttaatggaataatagttctcaggatagtatttcgtaaataaagatggtttgaatatgaa

SEQ ID NO: 254641 - DNA, 323 bp, Homo sapiens
gcaccctggagactaattaagcattctttagaatgtttaaccattctaagttaaacaatagaagtactatagtagtcatgataaaaggaaacctaataccaataaatgccctgagtttttctaaatgcagaataacataggaccaggcatggtggctcatacctgtaatcccagcactttgggaggccaaggcaggtggcttacttgagcccaggtgtttgagaccagcctgggcaacacggcaaaacctcatctctataaaaaataaaaaatattagctgggcgtggtggtgcacacctgtagtcccagctactcaggaggc

SEQ ID NO: 254642 - DNA, 376 bp, Homo sapiens
ggagggcgggggggctgcgacagccgcgccggccccagcccggcctgaaactttggcagcggatccccgggctcggggctgccgggggccgggggcaggggaaggaagccctcgcccttgaccttgatccccggatgtgggcgagcctaagggccaaagtcggcgccccgctcacctgtgcccgccgcgcgtctgggctgggaggcgtgggggatgggctcgcgctggctgccctgccgggagctgtggaagggctggccaggagggaggaagaggtattttttcctcctttctagttaccattttgcagctcggctatggaagaaatccagggcttgaggcagcacgatttaaagctgcagtgcttacaccccat

SEQ ID NO: 254643 - DNA, 200 bp, Homo sapiens
tatttctccagctcgttcgcctgagcaaagacagtggcttctgatagcagcagcttctcctggagatcttgatagcgttgtttgcattgtgacagctgggagcgcaggtgctgggtggaccctggtgggctaaacgctgattgggcccagtgtcacaaggctgggactggttctccaactgtgaaaggggccaagacaag

SEQ ID NO: 254644 - DNA, 444 bp, Homo sapiens
ctctgaatatattggttgacctctacgcatcagtttacttcaatatagtgagacctggccaggcgtggtggctcatgcctgtaatcctagaactttgggaggtcaaggtgggtgaatcacttaaagccagaagttcgagaccaccctggccaacatggtgaaatcccatctttactaaaaatacaaaaattagctggggatggtggcacgcacctgtaatcacagctactcaggagactgaggcaggagaatcgcttgaatctaggaggtggtggttgcagtgagccgagatcacaccactgcactccagcctgggcgacacagccagactttgtctcaaaaaaaaaacaaaaacaaaaacaacaacaaaaaatgcatatatatatatatatatatataaatagatatagtgatatagtgataccccatctctgcaaaaaattt

SEQ ID NO: 254645 - DNA, 708 bp, Homo sapiens
ctcctgcttctctttcttctgtctctgtcttttctacctatctcattcaacaatatggaacaagagttaggttctgtgaatatgcaaagttgaatcagaagctgttcctccccataaagctcacagtctaatcctagaaacttagaatagaaactggccattcatgaggttaagtgctatgaggtaaggcatgtgctttgtgcatagagttggaggtgaggttagggaagtagtctagtgggatgatgcttgacttgggttttgaagaatgaataataatttcctcaacgcatgggatacggtagctgaattgtagggaatacgtactgatctattggtttttttttttttttttttttttttcttaaccccaggtaatggtctgatggtaagttctgattttctcaatagttattatttgtacaattttaactggcagctccttatatctggaaatacagaggcatgtgactatagcaagaaagcccattggcatcatattaaatgagtgcatttagacctgggcttcacatatgattatccagtgagtgaaaattttacagaaatggctttctcaacacatagcttgtcattgttttcatcattattggaaaatttgacataatttgtaatctgagaaagaaaaccaaaatttagcttgataatcagcatcaagctgcaataattgtctaaaaatccccagaattt

SEQ ID NO: 254646 - DNA, 570 bp, Homo sapiens
tcattattttgtatgtggatgtccagttgttccagtaccatttcttggaaaaaaaaaactaggctttctccagttgcctttgctcctttgtcaaaatcagttgactgtatttgtatgggtctatttctgggctctctcttccattccagtgatcttttttgtctattctttcaccaatagaatcattcctaggtatccttgggcaattggttccaggaccccgcaaggtaccaaaatccacagatgctcaagttcctgatataaaacggcagagaatttgcctataacctatgcccatcctcctatgagtttaaatcatctctagattacttataattcctagtacaatgtaaaagctatgtaacagttgctatgctgtttatttttttattgttgtattattgtttttcaaatatttttgatccatggctggttgcatccacggatgcagaagctgtgggtatggagggctggctatatacttaacactgctgacctgtacacttaaaaacatttaagacagcacattttatgtgtattttatcaaaattaaaagaattttttttaatc

SEQ ID NO: 254647 - DNA, 434 bp, Homo sapiens
ggggttatgagcaggcaacactgcctgctcagtaggagctgacaatcaactaggatagccccaatttcctgttgcaatatttaactcacttttgtgtttacatttgataaacacaagtttagagattcaagaattagaacatctcttgtctcactccagctacaaatattgattaaaatgggaaagattgtttattgtaaattgcatttatcttcatgatgtgggaacaatgtaggttttcaatgaatgcttctttgtgtgtgaaagatatgtgaataaaccaatttcaatttttttttaatttttaattattaattttaaattgacaataataattgcataatatttatgtggtacaatgatgtcttaatgtatgtgtgcattgtggaatgagcagaccaggctaattaacatattcatcacctcacaagctt

SEQ ID NO: 254648 - DNA, 480 bp, Homo sapiens
ccaagagttctgaccacagcctgaacacgtctttttcttgctcacaggctttcatcactttgaattaccttcatcatgactctttatagtggctgtacaataacctgtggaagaggtgggctgtaatgtgcttagctcagacacttcccccgctgtcagcttttcccttattgtaagtaagctgttgtgagcaccttcacatgcattgcctttccctgttttttttttctgtcttactccgtctcaaagaaaaaaaaaaaagaagaaattcaactgaaatttagtcaagaatgaggacaagagagacaagtgcaggctgacagagactaaagctgcacacccaccagaactccccctgctccccacccatggcaggacagggcacacccctgtcctgctggggacactggcagccaagaccacagaaagtgaaagccagcacctcctgctgcaggaatcctgcttggaaagaagtgagtt

SEQ ID NO: 254649 - DNA, 642 bp, Homo sapiens
attaagatccagataaatggaaagacatccatgttcatggattggaagactgaatattggtaagatggcaatgctgcccaaattagtctacatattcaacaattcctatcaaaatcctagctgtattttttgcagaaattgacaaactggtaaaattggtagggaaacgcaggggacccagaatagccaaaaaaccttggaaaagaacaaagttggaagacgtaccaatttcaaaaagtgctaccaagctacaataagacagtgtaggcatatggatagacatatcgatcagaggaatggaactgaacatccagaaataaacccatacatttctggtcaacttgttttcaacaaggatgccaataccatcaatagagaaggagtggtcttttcaacaaacggtgctgggacaactaactggtagctacgtgcacagcaaaaggatccctaccttcctaccacattacaaattctaactcaaaatggatcatagacctcaatataagagtttaaactcttagaagaaaacagaagtaaatctttgtgatgttgggcttaggaatggtttcttagacataataccaaaagcacaagcaacaaaggcaaacagtagataaatgggacttcatcaaaattaacttt

SEQ ID NO: 254650 - DNA, 432 bp, Homo sapiens
aatgcagagtgtgttttatttgaaaggttttctttccagaagaaagattctatggatgtgcagttgcttctagaaaaacagaaatggagtcccagtagaatagcagaatttctgaatgggcatccatgccagtaagcaacatgtaaaacaacatcacaggacctaatgtcataggctttatatcttcaaggatagctgccttgatgcatcaacttgattttatcaagaacatgaacaatgattattctgaaaggaaaacaccaaactcatggaaaataaaaatgcaagaatttgaacattactgccttttcttgcaagatatactttgcccaaatgattatgcagctcagtcaatatttgagaacacctggttgttctgataaggaatatattttccccatcattatgtgtcctttcacagattggggttca

SEQ ID NO: 254651 - DNA, 506 bp, Homo sapiens
atttgtagttaaaagtcttccctaatgctacataatctcttccagaaaacagaacaagaagaaatactcctctactcatgaggccacatttccttgattccaaaatgaaatactgttctaaaaaggaaaactataggccactattccttaagaatacatgtatacacaaaaatcttcaaaaaaaattaggaaatcagatgtatcagtgatatataaaaataatactatttctcagaaaattgaaactagaattactatttgagccaactctcaggaaaaaaaaaaaaaaaaaaagctagagaggcagcaatgctgttctgataatccccagatttttccaagtatatatgttcccagggatattgtccagattccatatgtaagcgtttatacacctgatttagaaagaaacataaattttccttttcattaaggaagcagatcctccacaaacagatcttgaggggagaggggaggaaaaagacctaccacctctagtttgtttg

SEQ ID NO: 254652 - DNA, 1416 bp, Homo sapiens
tgcctgtgatcccagcactttgggaggccagtgcagaaggattgcttgagcccaggagtttgaaactagcctgggcaacatagcaagagaccctgtctctatttaaaagattttatatatatatatgatcatatataatatatataagatatatatgatcatatatataatatatatatatatgatcatatatatcttatatatatatatgcagtttggaattctatttgtcttgccttatttgctttttaaaaatttctaccttagttttttcctggtttactttgagtgtttttttgtagtcggaggagattgttggtgcggctgggtgtaggtatgaggcagaggaggaagagtaatttattccatctactgagcctttcatttactttctgttttagcagtagagtgggatgtcggaagcttttgttgggtgagagtcaatctgtcagggtaaatcttaaaaagctggatttgtggtttagttactagttactgtgtctccagtggagacaaagattagtttttaagatttagccttaatggatgattcacaaattgcaatgcagagtattgaagttaagtccaaggtcaagcacacaagtgggtaaaactgaacatatgaaatgggtgtgtggctggcacccacctctgacctttactgaaataaatgaggaagacggtgctgtaagtggaatgccacggaccaggagttaagaccagagtcctctgctaggccctgcatctgaagtctgcagagcatggcttttcattggctcagtgaggagttgagtcctggttcagaaaaagttaccgaggtctgtaaaagtcagtaggataccggaacaagaaagagtgggagagtgtacagttcccagcgaacattgccagtggaggctaattttcaccagtgaagggcgattttgatagaaaagcacagtgtctcaactacttgtggtttttgattctgaaagaggaggctttggcaggagcaataatacacgtggcctaccacctgtttggctttttccccacaggttgcaagctgcagggagggccttgctaattctagtacctccatccccgaatcgtctaaatgtattttacccaggacctgtcatggtttatctgagtgaccagtttcctttcctctcttgcttatttatcatgttcatatttatatttttcataatggggcctatttatatattttgaagtagttctagtgattttaagatccagcaaaacttcaaggtcatctggattttggtgttctatttaagttttctaacttgatacagtctttttttttttttttgtattttgtatgtttttctacaaaatgtgagagagttaagcatgtataattacatatgactgctgttttcactttgaaattttaaatcctgcttggga

SEQ ID NO: 254653 - DNA, 392 bp, Homo sapiens
gattttattttatatataagaaaagtataggtaaaaagtgtttttactgtattaaaaatatatataaattgcatcagctaaaccattaacaaatattcctggcattttgtaatattcaaatgctacattaaattagtagactatttcaactttaaatgattttaaattgaatattatgaaattacatggcactatgtatcatggtaaggtaggatttcttggttttgataactttagggatcatttgcaattcagattttaacatgaaatgatgtgagaagcaaagcttccttttttaattgtcatttctcccctttctaaatgtcatatgtcatattgtaacattcattcattaccacatttttaagaatttgttttgataccattattaa

SEQ ID NO: 254654 - DNA, 713 bp, Homo sapiens
aaaaaaaaaaaaaaaaaaaaaaagagaaaaaagaaaaaaacaagaaatatcttgccttaggtaattatttgggttattcagagaaatgaatttaggaacaacattcaaataaaaagctggaccctggtttcctagacataggatatcagggaaactaccttttctctttctctgggtattttctaggatatagccctgtatttctgtgctggagggtaaaaagatgtgcaaaagagctctgtgggtggttgggccccttggggccaaatgtatttctgtgtaggagtaagactgacagaattaactgtgcaagcacttactaatttgctgtaagtgaacctgtacccatggcatcatttataatccagagctccttgaacagaagcaactcagaagaaaagttcctaaaaactaaggcaaggaatttttgtgtgcccaattactgtggcatattatgctttcttatagcagtggttgggagaagcaagaattcagctattctcaagcataggacttagcttttacttggcattattgagattggttaaaaactattttatggggaccaaatgtgaattgcatagattgggcctcaggtcacatagagacaaattcagtatattcaccagtcattctttttttttttcattcaccagtaaactaacctgtgcttcttcacatagtgtctcagggttcttttcaaagtagagagt

SEQ ID NO: 254655 - DNA, 539 bp, Homo sapiens
aagcgtttttgagagggtatatttaaaggtataggtatatattactagtgtgtaaaataaactttatgagacagtactagattattttccagtgtattgttcctatttatgttctcaccagtagtgcgtaggagttcttgctgtttcagatccccaccagcacttggctaggtatttaatttcttaatttttaacaatttggtgtgtagtatattctctggtcttcctttgtcttaccctgattattaatgaggtcttacatcttttttccccccacatttatggccatggatgtttctcttttgtgaaattctgttaaatgcctatttgtgttttttgcttgataaaatgtgagcttattatttaactgattttgtagttttaaaaaattgctgggggcggtggcttgcgtctgtaatctcagctttttgggaggctgaaggaggaggattgcttgtggggcccaggagtttgaggctgcagtgagctatgatcgttccattgcactctagcttggtgacagagcaagactttgtctg

SEQ ID NO: 254656 - DNA, 239 bp, Homo sapiens
ctgatgccagatccctgctctgggggcgctcatctgtggcctcaagagatgtatggcttctgtgcctagtgcagagttgggattgattgctcagtttaaatggaaaattgttccaaaagcagcagctgcctctccagccctgaatgagaagaatgtatctttctctgagtccaaaaatatatatatatatatattatgtagcacatactatgttcagggcatcctttgaggggaaggtt

SEQ ID NO: 254657 - DNA, 582 bp, Homo sapiens
ctcagagaagatgtcaatcctaattattttcatctctacccctgcctcaacgtgcatcccaatttcatttctatgcctagacttttttgcaagatttaataaaaatggaattttactcctttctacattattccccgcctccccacaaaaaatagctgtggccctcaactagtactaccaattgtgtccaagatgcttgttatcctagagtgacttattgattacaaagtcactttctgatgtttattattattatttataaataggagcaatatggtaatcttgagttgaagaaaattgttgctgctgtttggacgacaccagggatgaggattgacagggaagaaccacactcaccctagatgcctcagatgccagtctccatgaagccactcatgaaaactctccctcctcgacatgctcagaggggctttaggggccagtgaccagtggcttcttatccagcaggacagatgcagccacatgttcacaaacaatacagagtaggaggtagtccacgtccaagaggaaggactcacaacaaatggagaggccttacagggaaagggcacagcacatggc

SEQ ID NO: 254658 - DNA, 489 bp, Homo sapiens
agtgagttcgggaagccagtgcccgaatgctcaaccttgctgtatcagggagggccggagaggggagctcaagaagaggacgtcctatcgaggtggcagggattttctgaaggagggcgtattttgctgggtgtcatggcacgtgcgtgtggttccggctacttgggaggctgaggtgggagaatcacttgagcccaggaggagaagactgcagtaaactatgattgcattattgcattccagcctggacaacagcaagatcttgtctcaaaaaataaataaaaatttagaaataaagttttattggcacacagccatgctcattcatttgcacattgtctatggctgcttttgcacaagaatagcagtgttgaatagcaatcgaggctgtatggcctgcaaagccgaaaatattaactatctggtcctttaagaaaaagtttgcctgagcccaggactgcgagaccagcctgggcaacacagtgagac

SEQ ID NO: 254659 - DNA, 357 bp, Homo sapiens
  misc_feature (25)..(25): n is a, c, g, or t
  misc_feature (33)..(33): n is a, c, g, or t
  misc_feature (35)..(35): n is a, c, g, or t
  misc_feature (62)..(62): n is a, c, g, or t
tcaaatcccccgggaaggtgcaacnacatgtgnantaagtccatgtcttcccctccatcccncaaaaatctctgggtgcgagggaagcagggaagaaataagtggcaaatgttggcttgggaacggcctcgccctgagtaacaggaagaaaggcgttggctggcctccctggagccctcttctcagctgcactgccagtggctgagcaggctggccggaccgtgcactttactttatcagcaggtatttactaggtgccaattatgtgtcaagcttggtgctaggtgctgggtgcagggggtagagttaaaggacacaattccttctcttaggaagtttccttgaaggaagttgagt

SEQ ID NO: 254660 - DNA, 275 bp, Homo sapiens
tacaaaatgaaatagcctttttcatcctgtgtccttaagtgactatgtggaaccatgtccctgccaacctggaatgaacatgcagcagagagagaagtcaatgtttttttgtgtccactgaaatttgggggttgctttattactgcagcataccctggcctatcctgaataatatagtagtcaaagaggaacaattttttttctctttacattttgtgtccatattagagattactatttcaaaaactgaaagataaaaccttgaaaatcaactg

SEQ ID NO: 254661 - DNA, 356 bp, Homo sapiens
tactgctatgttaagcaactatgaaattttttaaactttttcatcagagtaccagtgctccaaatggtcactttgatcagcgttctttagtttaaaagagtgcagtgatcaaaattagatccccatacttgaataaacttgaccacttatttaatgagaatgtgatttataaattgttatgtgctgcataaatatggtttatgttaatgagtttatgcctgatgtccattgaggtgtataaaaacatttctttagctttctaggttatattttttgctcattccagtataaattttacttaaaaaattaaatcctgggattctagcaataaattacttacccaatagtaagggcat

SEQ ID NO: 254662 - DNA, 445 bp, Homo sapiens
ttccaaaaactgacctgactgtcccaggatgccacaacatgccagctgaggagtggcgtttgtctccaggatacccgaaggggtattgtgcactgaactggtggcctcacatccactcccctgcctctgcaggcagtgggttagtccagaacccccatgcggggtctccaagaggaacatcagcagagctgaaggcaaaaatctgaagagatgcagaggatgtgggtcctcccagagatggagggggccacagggttttatctgggagccccgggacaggagtcccaagtttcttcgtgcataacttgattcacaggccactgtctgaatttattaggactcattcagtttctacagtagaaactgatttaaagcgatttaagcagaaatgggaatttgttggctcagggtaatgctagctgctctaataaacaaatacaaacaa

SEQ ID NO: 254663 - DNA, 222 bp, Homo sapiens
aaaccatcattctcagcaaactatcgcaaggacaaaagccaaacaccgcatgttctcactcaaagaagagaaccatcttaaaaccatgaggtgacatccatgaggacaaagacttcctgcttgttcttgagccactgagggtacctctgagttgctgtaccacccagaaaatgctatccctgaacttcttgttgactgagacaaataaaccccttatttaaa

SEQ ID NO: 254664 - DNA, 111 bp, Homo sapiens
gaggcagtgtcttactttatctcccaggctggagtgctggagtgcaatcacggccccctacaaccttgaactcctgggcttgaatgatcctcccccttcagcctcttgagc

SEQ ID NO: 254665 - DNA, 393 bp, Homo sapiens
aacactcaaccctagacgctgccgtggggtcagagcccatgctcccaacgacctgcccgtctgcatgctcctcccctaggggtttgagctgctgcagcagagcgccaaagaagcaagccacacgccatcacacgccctgccagggggataagggaacttttcctgtttcaactgggacctcgcccaggatcccggaagggattccagcatttgtcccagcatgttttatgcagaaagaagtgatcaaggaaagtgtccaagacatggtaagccaaatgtagaatgaggcagtcatagtgagaggattgtccactctgttatgcatgattgagagtcatatttattcctaaactacattcttttattattactgttaacttttctctgaagtcc

SEQ ID NO: 254666 - DNA, 422 bp, Homo sapiens
caaaacttcaagaaacagataattttcatttgatatataccattccagagtacaaaattggaatgtatccaaccaattttactaggccagcataaccttcatccccaaacaggcaaggacaacaccaaaagagaaaattataagctgtcttcccataaggatacaggtgcatatttgggaggccaaggcgggtggatcagctgacgtcaggagttcaagaccagcttgacccaacgtggtgaaacctcgtctccactaaaacacaaaaatgggctggacatggtggtgggtgcctgtaatcccagctactccggaggctgaggcaggagaattccttgaatcgggaggcggaggttgcagtgagccgagattgtgccattgcactccagcctgggcaacaagagtgaaactccatcttaaaa

SEQ ID NO: 254667 - DNA, 706 bp, Homo sapiens
aagataacaacggatttcttgtccaaaacagaagacaatgaagcaacatctttaaagtaatgaaacaaatgctttaaaaatatgcttcacaaaaacaagccatgggccagatatggccttataggcagtagtttgccacctccggaatagagtgtcaatttcttcagatggctataaactattaaaatcttcaccatcctatttgttttaaataaaaacaaaagcacaatttttaaaatacattaccaagtttttgatattttagtttaagagccattatgacttcctttgagacttttatctgttaacaccaatgcaaggaactgttttgaattagtgttttcctcatcaaatgaaacggtttgcactgtcctgctttaaatttagcttgcgtctgcctaccttactccattctgttatactgggtgttgtctatgacaacaaatgtggtgtcaaagcactaagtacactacttagctatttccaattgctttgaagttgctacatgctgagatcaatcattggattttcatgacagatgaaatatttttaatgtaaataaaattcaatcttaagtgatttagtgtggcagtccccaaccttttggacaccagggacaggttctgtggaaaacaatttttccatggacccggggtggggatggttttgggatgaaactgtttcacctcaaatcatcaggcattag

SEQ ID NO: 254668 - DNA, 187 bp, Homo sapiens
tttttgccttcctttggattattttatttcatattctccttctgttatcttgttagttttacatactcttattcttttacaaaataccgtagaaactgaaacatgtacccctgatttattaatttctaatataaatcagtgcctccaccattttcactttcaagacaattcaaggacttcagaatac

SEQ ID NO: 254669 - DNA, 448 bp, Homo sapiens
aggcctggggtatatttctgttggacacatctgtccttcggatggaggagttacctccaaatggaaaggcagcaagtgcctggactcagctggagctggagtcttccctgtgttcttggattgaaatcttttgagactgattttatttaatctttgtagtagaggagactctgggccaggtgcagtggctcattcctataatcgcagcactttgggaggccaaggagggtggaccacttgagcccaggcattcaagaccagcctgggcaacatggcaaaaccccatctctacaaaaaattagctgggcgtggtggcgcacatttatagtcccagctactcaggaggcggaggtgggaggattacttgagcctaggaggtcgaggctgcagtgagccatgatcacaccactgctctccagcctggacaacagagtgagaccttgtctca

SEQ ID NO: 254670 - DNA, 5954 bp, Homo sapiens
gcggccgccctctaccctcaatccccactggagattcctcaccccgggaccgtccgcgcgggcgtggtcgggctccgcgcctcgcgcagcggggtggcacaggcggccagggagggcccacgcacccggcgcgagctagaagcctccggtcggcctgcagtgcccaagtcccatggcgagggcagcccgagtggccgtcgcggctgtaggtccgcatgccgggcaccgcaccaggcgtctagcaggtaggggcagggaaggtagggctgcgctggcggccggtgcccagttaccggcgatcggggacgctcggagacacctggtctcccggaagcgcccttcggaaatgggattcgacccggcttgcgggcggcgggtgtttagaagaagaggctgcgggcaagcagtgccccctctctggttccccggactcctcttagccccctcgtggcctgatgggcggccgggacggaggtgggctgtaagcccgccggcacccaccgtgtcctgtggaaggcttggagacctgagccaggctctactcggttagatgcgagtgagacaggcgacggagttcgtctttaagcctcccttgcctcagcaaggagagggagcgttttccttattttaatgaccgcctttccctcccttggggtcccagttcaccctgaacctttccacagccttaaaagcccgctctccctagcggagtgctgcggcagttcttcagaagacacggggccaaatgaaacttacttaaagtggttatcgcgtttcaggctgatttgttcctagtaactacgttttggaaagcagctgtggactctcaaggacaggcaggaacgaagacctccttagggtccgagtgtcgcttcccacagttagattacccatgaatttccttgattctgtaggtctcaagaatctcatgagcccccaaccacctccacctttctctctgaatctctctcctgtctctgaaattcttcgcaaaaataatctgtcctcaaggaatattgaaagcgtcatcaatgtcttgaaggaaattactgtatctgagaaccgaaactagtatttgatgtttcactttcaaatacatttttttttaataaaaaggatacctttaagtaaaacactaccactgctatttacgtttaagtagatttttaattcatattaagcagtagtgtgctttttggaaagatgatggactgggactcataatccctgggttttgtttctatttgtagtttcttgagtaagtcagcactttccctggttaagaaatgacctcatctgtaaaatgaacctgacttctaaggtcttgttcggctctcacgtctttacttcagttaaatattgacataatacatgtttgttgaatgaatgactgaatgaataaatcttattgctctaggaactatgtgcttttaacctttggaaatacatagaaacaaatgcctcctttgctaggaaagggagcttaattgtgctcccactgcatcagactgcttccatctaatgatgcaattgcaatacagggtgggaggccatccacagggctgtccctctgcctcagagctcatctcaagtttgcccttctctatggagaaggaaaatttgagtctccagaaggaaagtattttgctaaacgccaagcaagaattagagggtaagggggcttctgatgcctggtccaaggctcttagaagaagaagaaggagaaagggagaaagctcaagaaaataatgcacagatcaccagctacaggtggccctagtgcctaagtttataaactacccccgcccttcccggagagaaaggagcttgtataaagggaacaatcctagaacctaggcttaacaaggaaggagaaggggagaagcaagggtcattctgttctcaagtggtttgttgtatctgtgtgtttatctattccacatttggccaggcagtgggactccgggaaagcaagctgaagtgttttgtgggacaggcacatcatttggtcaactccttttccctggttgattccctccttttcctgacccatctcccccttcctaccagaggcaaccaaggcctttccaggcaacagcagacattatttaccccttgcgaattgattccacaatggaagactcttgggtccaaggagctgtaagataattaaggagaaaacagataatgaaggcaaaaatccaacacctggccattagcaatgctctggaaaggctatttaaacccgcattggatatcagagctgggagggcccatacagtctacctacctgccttttgcagatggacacaggaagatccagaagctagtggcacatctagcaacagagccagatcagaacccaggtaagctcggtctcaggccaggattccttttccatctcctctctttctcaggagccagtcttcctgcaccagcttcctcttttctcctagctcccctgcccctgcagcctggagggctcaaccacccttcctttggctcccactcccagctgaggctcagcctggcagtgcttttctgacacccacttcttttctccttcctccaggcaagaagtgcacgtttaaacctcattatctggctaagtataaacctcagggagaaaaggggtttgtttttgtttttctcagtctataagctaacattgagctgactttcagagtccaggcaaatatgtttggtgggtcaccacccagaaaggaattctcttagcactgaatcagggctctgtatgtaaagtataaatcccctaagagaactcctcaccctcctacacagacacattggtgcatgcacacacaccccactctctgcacagagagcatctgagctaggagctggcaagtggggcaccagtcctgtagcaaagaggcacaccacacacacacacacacacacacacacacactctctctctctctctctctcactcacacacacacacacacacacacacacacgcttctcccttgcttgggaatctgggagaagaaccccccacccccacccctgccctccataggcattgtgtaggtgagagaaagagggaggagtgagagagaacacacagaggggcccaaggaggtgccaggccattagcagggcccctccttgagaaacccctctgcaggagcttctcctgccgccagccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtgtgagtaacccccacctcgcactgtctttcccatctctatctctcctctacacctgccgccagccccctgattcctgattttcccaccccctttttgcgctttttttttttttcctaaagcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtgcaagcatgtgtgttcccggggcgcgtgtgtgggtggcctcgggatgggggaatagggagcggagaaaagaaaccgctttggaaaatgcaatgatttcattctgccgtgttgctaaccccctcattctccctcgctcccactccgcctccttgctttaccatttttaatcgggcttccttgtttctttcttccctgcacccgcttcttccccctgcccccacctaaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcagggg

SEQ ID NO: 254671 - DNA, 382 bp, Homo sapiens
acctgttttgaccccttatctttggaatgctgattaacatgaagcaataattactattaatatattagtctttcaatattgctgagactattcataagactgaaaaccctttaaaaagctcccacgacggccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcgacaga

SEQ ID NO: 254672 - DNA, 424 bp, Homo sapiens
taggaaaagaactgggtagtgaggtttctggttttcctccaagatggagaagagtggagggctggggagcatgagtcacaatgaagttgaactatcaacagaccacccagaaacaaaacctcccatatattaatgaaaaataaaaaaagcaaacagcaattgataaacaaatgtatttaagttataccaagggcaagattgctctgtcaaaaagcatttgataatcagttaattggtgagtgtctgctatgcagaattagaggcagttatttttttgtttgtttgtttttgttttagattatttcttgctcaaaactcactcaggttcctgggctataatacttgagccagacagagcagctttgatctcactggcagtttgtttagaagcctgagatctggagtggctttctaaaatcttcag

SEQ ID NO: 254673 - DNA, 249 bp, Homo sapiens
gcccccgaatgtgcacgctgcttgtgcctctgctgcctgcatgacagcctcgccgtcacgtagcgctggaccgcaggtgttctgcaccagaccctctttcagagaggaaatgcaattagggctgtacagttggcagacttcatctccatttcggccttgggagagggatcaaagggcagcaggcagggctgtgtgtgcatgtgcatgtacatgtgaatgactgtgtgtcttgggttaacccctgcgggc

SEQ ID NO: 254674 - DNA, 414 bp, Homo sapiens
cattttcatcagcatactcaatctcctaacttaatttttttttctactgcccccacttccaccactggctactactccatttctttactcctcaccatggccaaagtcctccagagttatccactgcctataactcacctattcctaaaatccattccaatcaggatgtctccatcccacagctgaaactttcttgtccaggtcaccaacgacctctactctgctaagtacaattgtcaattctcagaccttatgtaattttcagatccaatccattagccaattctcttggttttcagttggatttttaaaagaatcatatttttgttactattattttgggatttttaaaaatttaactctttaatccatctagaacttactttacactttgtcctaacaatatgtatttta

SEQ ID NO: 254675 - DNA, 457 bp, Homo sapiens
ctggagcgcaatggtgcagtcttggctcactgcaatctccgcctcctaggttcaagtgattctcctgcctcggcctcccgagtagctgggactacaggcatgcaccaccatgcctaatttttatatttttagtagagacggggtttcaccacgttcgccaggctagtctcgaactcctgaccccaggtgatctgcctgcctcggctgggattacaggcgtgagccactgcgcccagctgtgttttgcttttgtaaaccctgacgagcgcctccacgcagaggggccatttgttcccttccagactccctttgaggacttctaggctggccgcccaggggcagttaagcgacaccctcaggacagctgctgggctaaggcccaactcccccgaatcccgggatctgctcctcctcttcctgccttccttaccctgatacatttccccaccccgccctg

SEQ ID NO: 254676 - DNA, 384 bp, Homo sapiens
acaaacagctaacatgacgcagcataagacaaagaaagggcccttcctaggtcgaagaaacatgggcccaggctaagggaaagccagttcaaaaggcagcagacaatgccaagaaacattagcaaagtggccgggagcggtggctcaggcttgtaatcccagcactttgagaggctgaggcgggctgatcacgaggtcaagagattgagaccatcctggccaacatggtgaaaccctgtctctactaaaaatacaaaaattacctgggcgtggtggcgcccgcctatagtcccagctacttgggaggctgaggcaggagaatcacttgaacccgggaggcagaggttgcagtgagccaattgagccgagatcgcgctactgcac

SEQ ID NO: 254677 - DNA, 587 bp, Homo sapiens
  misc_feature (426)..(426): n is a, c, g, or t
aaagataaagagagagagaaagaaaaagaaagagaaagaaagaaagaaaggaaagaaagaaaggcaagcaagcaagctacataccttcctcacaatttgcccacttggaaattccttgtgggctcaagatctttaccctaaaatggttctgttgaattttatcctgacagtgtaaattgatagcttatctaaacagttgcaggacaaaggacaaaaccgaaagtcatccctctgctcacttaagacaaatgcacatctgaatgcttcacctgatgtaaaagtgtgattcactgagctacatgaaagcatgagtgactattattcctctacccaccacccccccaaccccccctccctgccaacatgtaaattgtgtattcagtgaaaggctgatcaaacacaaaaaagaatgaaacaatttgtctnttatctacccacaactttaaaagatgtattcctttttccccaatatccaccctttccctttaaatattgaagccctcaaaataatctttggagaaaggcacagacatgtttgcttggtgtacatatttaaccttggcaaaataaacattctaaattcattg

SEQ ID NO: 254678 - DNA, 455 bp, Homo sapiens
ctatatgaattcagtgctattatgtcattttatagatgaggaaatggaaacaagcttcatttgcttacctgcagagaaatgactctcagtaagtggtggaagtggactcatgtgtgtctgtctcaaaatcctactttcttgccacaccacactcctacctgaaaatttttgatgagccataaaaaaagggatgaggccgggtgcggtggctcacgcctgtaataccagcactttgggagaccgaagtgggcagatcacgaggttaggagatcgagaccatcctggctaacacggtgaaaccccgtctctactaaaaatacaaaaaattagccgggggtggtggcaggtgcctgtagtcccagctactcaggagactgaggcaggagaatggggtgaacccgagaggcggagcttgcagttagccgagatcgcgccgctgcactccaggctggatg

SEQ ID NO: 254679 - DNA, 279 bp, Homo sapiens
ctgcaacaaaccaggttgatttattacattttctagttagattttgttgactgttcagttattctagtcatgaataaatttttatcatttttccccataacatatgttgaagcagaagtctcatctgctagaagcaacatttaaagtgcttgcataacaatattgttgatacagaagattttttgtatccaaacaaagaagttaactactgtgcttcatttatcttcatctgtctgaagtaccaagaaaagagatgtggaaaaataatgataggtaagc

SEQ ID NO: 254680 - DNA, 342 bp, Homo sapiens
gtctcgaactcctgacctcgggtgatcgcccgcctaggcctcccaaagtgctgggattgcaggtgtgagccaccacactgggcatctacatcattcttaatggctgcataatgttccaccaaatggatgttttgcaattttaacccttgttggtgaacatttaggccatttgcaatttatgtgccttaggcttggtctgcattttgtattatctccttaaaactggtttctagcagaaatgccttgcttgcttctttcattttatagcaaggttaagaaaacaagtgccaaataaggagagaggaagaaagttataaaaataagtcaaatcaagaacagttg

SEQ ID NO: 254681 - DNA, 440 bp, Homo sapiens
cagagatcatgtttttcagggggcaatagcagatgaataaagaacctgtgtaatttagggaggtgtcacatatagcatgctatttcaacaatgtcctggcaactaaaaacggtgtggtggtgaaggtgtctaagaaggtatatagcagaacaaatgacacataaagctgttttgggtccccccccgttaagggaatgtaaaggatctttcttacttacactgtacaaagcagaagagactttgcaaactggacacaacgcagcaaaaattcgacagtggttattgttgggtcagagaattacaaggctgtttgttgatatacttcatgcttttttagtgttttcaagtttcttgtaactaacatgaattactattacataattattttgaagatgcttccgttttgaaatatgatatattaaattttccagtatataaaa

SEQ ID NO: 254682 - DNA, 219 bp, Homo sapiens
aaaatttccaaaataagatataagaatggagattaaacacattaaaaggttcttagtaccattattcatctgggcaatgcaaactaaaagtacaatgagataccacaaccctcacatgctagaatttcaaaagttaaaaaatgtaaacaaggcaaggatgctcactctcactacacttattcaacgtagtactgaaattccttgccatggcaataaggt

SEQ ID NO: 254683 - DNA, 454 bp, Homo sapiens
aaacaatcttcactaattgagacataaacatgtccaaagcctcatctacattttgtaactttccctgcatagctggggcactttgttggataaacatcgtattagctaactttaaattttctgaggcttctgagtcaatatccatttattgtctgaaagcttcaaagacttgttctaaaaattccaaaggcacactcattaggcttctgcttgatctcctggaccttactgaggccgctttccttgggcactcccttgcagaggctggccaaaatgcagttttgatagtgttcgaggttagatctatctccagtgtttatattccatcccaggacagaggtgggaactgcaatctgagcagctgcccttactggattactgggagagtcagtgtgaataagatcagccttttccttagctttttctaaaaccattctttgcttctctgaactca

SEQ ID NO: 254684 - DNA, 707 bp, Homo sapiens
ccaaacccttgggccctcagggctgctcatctgccgccggctgccctacggcctgggtcccgaagcctgcgccttgggcgatgccgaagctaaacatgcccatgggcgccccgcctctctacaggtcttgcactgccctgcacctgcgcccctaggccacctcagtccaggcgaagccctgagccgggaccagcctttggtcagaatgctgctcatgacgcggctcgggcccagcaggcagtccgggagcaccggggcaggtgcaaattccacgttggaaaagtttggctgcaccatgcttgcgaagctgcagctgaacgcgcccaccagggcataagcgcgaaggagggatcgtaggtgtcaacccccgcgggccgcggcggcctcggggggacacctgcacgccagccgaagagcgcaaagccagagagtgcactggtccaccacagagcgcagcaccgtgccagggcgcagagcccacgcacgcccggtcggcgtcgcagcaccaggagcacaggctacccgggccactagcctccaggaacacgcagtctcggcgcccgggacgctctggggcaaagtggggcaccgtgtggagaccactccagcgaccctggggcggcggtcgtccaaacgcgtggccacaggccttgcttctcgcttgcagacaactgaggccagccagcagcgcgacaggatgggcggcc

SEQ ID NO: 254685 - DNA, 390 bp, Homo sapiens
cagaagaggaatgctggaaaaatctggtttatgaaaacagaaatcaaaccaagttactaaccaacctccccgtcccctccaggcacacaaaaacatttgcctttgtactctgccaatgcttgatttaattataatacacactcaagtggctgtaaaaaaacccaacagaacagaaaccatttaacatctgaatagtgatttatgaacagatttcctctgacaaatggggccagctattcttaaggcttgccaaatagctgttagatgtctaaatttttgtatgtgcctgcgtttgtatgtggttacactgtaaagtaatgacagactgaggctttgatttcagaacttcagatgtatcaaaaatacagatttttaatatttgattttaaa

SEQ ID NO: 254686 - DNA, 472 bp, Homo sapiens
gcttggggcatggtgccctgaccctcggctcacgtctgcccagatccttacagctgatggaaccctttgctccaagagacgaggttggcacaccgtggtctcaataaatgtttgtcgagtaaacagatgaagatgtccttcgatcttcacaacagttttgagaagcaaaatgaaaaaggactctcccttgacccaatagaaagggaagtttggactcacctcaaggtgctgtcactagccatgtgttccagagcagcaacataacttctcaaagcctctgtcacttcatctgtaaagcaggactttgtcactattgctaggttataggactatcctgaagagctgctgagacaacatacgggggaaacatttctataaattattttttgatgagggaattgaggtttataggggttaagtgacttgcccacagtcaatcagtaaattgtgaagccaaaacttaaactcggga

SEQ ID NO: 254687 - DNA, 363 bp, Homo sapiens
  misc_feature (59)..(59): n is a, c, g, or t
  misc_feature (128)..(128): n is a, c, g, or t
  misc_feature (188)..(188): n is a, c, g, or t
aacacctcaagctttgtgaaccaggcccaagactttgaattgtgttttaggtacctaantggcaagccactcgaaggtattaaacatcatctatttttcttattaaaaagatacttttgggtgagtcntagaggaaagggttataatgggacaaagttataggaaggacatccattaggaaattgcantagaatttaggcaagagttactggtagagaaatggacgcatttggaaagttttgtttgttagttccagtcaacatgatttgttggtggattggatgttggcagtgaggaaacaagaagactcaaggatgacttgtatacctttgaccagagcaactaagtgggtagtgtatgggc

SEQ ID NO: 254688 - DNA, 358 bp, Homo sapiens
gtgttcactaccctaataagacctcagcttccctcgggaggggacataacaatataggaagagtgaaccacacacctatcaaggggcacaagaaactttaatagtggaggaaagtttggactcggaaactcaagaacaatatttggcatgtcaaggagaatatcatgtatgtccttagcataatgtgcttgattttactactctctcaccctgaagccccttcatttgtctggactgctaaaaactagagaaactggctcacgcctgtcatcccagcactttgggaggccgaggcaggcggatcacctgaggtcaggagtttgagaccagcctgaccaacatggtgaaacccctacta

SEQ ID NO: 254689 - DNA, 430 bp, Homo sapiens
tcttcacatggcggcagcaagtagaagtacagagcaacagggggaaaagccccttataaaaacatcagatctcaggagaactcactatcatgagaaccatgagaaaagcatgagggtaactgccccatgattaaattattagtacctcccaccaagtccctcccattacacatagagattatgggaattacaattcaagaccagatttgggtgggacacagccaaaccatatcactgccgttattcagagattccttggaaacgagaattcatgagtctcctatcagccagtatagacagtaaaatcatgctttcaggactttcttagactcttttttgaatcagcatttattcgaatgcacatgaatacattcctcagtaggactaactttattctctttggaggttgtttttatgccctggttaaaaa

SEQ ID NO: 254690 - DNA, 4675 bp, Homo sapiens
  misc_feature (1)..(1): n is a, c, g, or t
  misc_feature (10)..(11): n is a, c, g, or t
  misc_feature (49)..(49): n is a, c, g, or t
  misc_feature (290)..(290): n is a, c, g, or t
  misc_feature (296)..(297): n is a, c, g, or t
  misc_feature (1223)..(1223): n is a, c, g, or t
  misc_feature (3129)..(3129): n is a, c, g, or t
  misc_feature (3229)..(3230): n is a, c, g, or t
  misc_feature (3537)..(3538): n is a, c, g, or t
  misc_feature (3999)..(3999): n is a, c, g, or t
  misc_feature (4479)..(4479): n is a, c, g, or t
ncgagccctnngcagcgcggcggagagccctcaaggcgagcagcgcgcncgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgcnagccgnngcggcgcccaccttaccgagtcggtggcggcgccggacagcggcgcctcgagtcccgcagcggccgagcccggggagaagcgggcgcccgccgccgagccgtctcctgcagcggcccccgccggtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacgtggaacattctgtattcatctgctatttgtgatgctccgggtgtttcaactagaaccttcagacccaatgttatggagaaaaactttaaagaattttgaggttgagagtttgttccagaaatatcacagtaggcgtagctcaaggatcaaagctccatctcgtaacaccatccagaagtttgtttcacgcatgtcaaattctcatacattgtcatcatctagtacttctacntctagttcagaaaacagcataaaggatgaagaggaacagatgtgtcctatttgcttgttgggcatgcttgatgaagaaagtcttacagtgtgtgaagacggctgcaggaacaagctgcaccaccactgcatgtcaatttgggcagaagagtgtagaagaaatagagaacctttaatatgtcccctttgtagatctaagtggagatctcatgatttctacagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttaaaaacattgagagccatgctggtatatactccttgccacagtttagcggaaagaatcaaacttcagagacttctccagccagttgtagacaccatcctagtcaaatgtgcagatgccaatagccgcacaagtcagctgtccatatcaacactgttggaactgtgcaaaggccaagcaggagagttggcagttggcagagaaatactaaaagctggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagttccactcacttcaccaggatgcgtcgccgtttgatggctattgcagatgaggtggaaattgccgaagccatccagttgggcgtagaagacactttggatggtcaacaggacagcttcttgcaggcatctgttcccaacaactatctggaaaccacagagaacagttcccctgagtgcacagtccatttagagaaaactggaaaaggattatgtgctacaaaattgagtgccagttcagaggacatttctgagagactggccagcatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctngacctaccccaggtaatacaagtaaacagggagatccctcaaaaaatagcatgacacttgatctgaacagtagttccaaatgtgatgacagctttggctnnagcagcaatagtagtaatgctgttataccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggnngccctccccatagttcctcagctgcaggttgaaaatggagaagatatcatcattattcaacaggatacaccagagactctaccaggacataccaaagcaaaacaaccgtatagagaagacactgaatggctgaaaggtcaacagataggccttggagcattttcttcttgttatcaggctcaagatgtgggaactggaactttaatggctaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggnctttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatncagatcaactacgtagaaacaggatgctcaacaagagaaaaaaaacttgtggggaaccacattgatatctacggccatgatgccactgaacagctatgaacgaggccagtggggaacccttacctaagtatgtgattgacaaatcatgatctgtacctaagctcagtatgcaaaagcccaaactagtgcagaaact

SEQ ID NO: 254691 - DNA, 539 bp, Homo sapiens
tagacttcatatattatatctatcataatatatatcacatattatataattagagtctaagtcagatttttaatcagaagatccagaattagaaaggtgagaattctgattaggattgaacagataaagaaggtgtattagtctgttttcacactgttataaagaaccacctaagactgagcaatttatgaaggaaagagatttaattgactcgtatttccgcatggtgtggaggcctcaggaaacttacaatcatggtggaaggcaaaagggaagcaggcaccttcttcacaggaatgcaggaaagacagaaagggaagggcaagtgccacactttttaaaccacagatctcatgagaactcactgactattacgagaacatcgtgggggaaaccactcccatgattcagtcacctccctcccagtccctccctcgacatgtggggattacaattcaagatgagttttgtttggggagacagagccaaaccatatcagagggggtatctgggaatcaataagagaagaaataaacagc

SEQ ID NO: 254692 - DNA, 1076 bp, Homo sapiens
ttttttcttgcagaatgcagtgggccagccggctcgcggacttgaaaccaggctgttgcgagcccagagctccggctgggcagcagcgctctgcgcagcctcgcgctcatctggctccggggtgagtgcagagcagggtgagggtagaagaagtaggatcctcaatacaagctcattaaagagagggaaggagggaggaggcaagaaccccctatactggaaaacaaacaacccaaggaaattgacgtggtccgagcccattttcaaagtaaggaagtataatggagatttcgctactcttctgtatgggaaggactgatggcagctagaactttagtttgtggtatgaagtgctttaaaagaaacacttggatgaaaaggaaattccttgaatgttaattgtgactgtaaacgtgttaaaactagccaaagaggacgcactggtgtcggtctctgcctttcttacatctttgataaaacccataggcaccaaaatcctggctgtttacatttctgcagatttgggaattacccatctgctaaatcatttgtcttttattttctttcaaaggctaaactgtatcgaagtctaaccctgtatttcctcctagtaaacacaatagatgttaaaagggaattcttttcccaaaataaccttttattattacaaaagccaaacataatcatttgagatataaaatcctggcaaacataatcgtggttaaaatttaatctgggccctttgggatctgtcccttcaaaggcaggtgagttgccctttaattcgtattgccacttcattgactcaatcactgttatttcagaaaaaaataaaaggaagtagcagaattcaagttacgcaaaacaaaacttgctgtctaacaagcactctttgaaagcaaagatgttttagtgttcagcttttaaattgagctatgtgattaaaaccaaccatgaccttaacggattttacccaaactcgtctaacttcagtatgttttgtcagagattaatcagttacttgttcaaacttaaattgagatagtgtaaatatcagggtttcctagataaggaca

SEQ ID NO: 254693 - DNA, 623 bp, Homo sapiens
agcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagccgtaggtttgaaagatgtatggttccagccgggcgccgtggctctaccctgtaatcccagcactttggaaggccgaggcgggcggatcacgaggtcaggatatcgagaccatcctggctaacacggtgaaaccccatctctactaaaaatac

SEQ ID NO: 254694 - DNA, 690 bp, Homo sapiens
  misc_feature (587)..(587): n is a, c, g, or t
agcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaaggtaggaaaagagtctgacataaatacacaatcgaagacacctctatcactcccaaattaaaaatattcttatctcaaactactttccatggctatttttccaaaatatgtgagctgncatttggctgataaataaaaatatattaatgataaatattgtgcaatttcttttatccaaggacaatttaaccaattggattctcttattctctgatactaat

SEQ ID NO: 254695 - DNA, 892 bp, Homo sapiens
  misc_feature (753)..(753): n is a, c, g, or t
  misc_feature (756)..(756): n is a, c, g, or t
agcgggagggggctccgggcgccgcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatntangcaatgtgtcaacacttttgggagctacatctgcaagtgtcataaatgcttcgatctcatgtatattggaggcaaatatcaatgtcatgacatagacgaatgctcactcggtcagtatcagtgcagcagctttgct

SEQ ID NO: 254696 - DNA, 454 bp, Homo sapiens
ggatgcttatcctttaagcaccccatcatactgttagtagtgacgacatcacggaacttgtcacacaggaggactgaaagacagggactctcaggggccagaaaacatgagagtgaaagagagattccgaaaaacatcgagatttgtgaaaatgctattatgtgttagatagaatgcagggtactttccataagtcaacttggttatttctcagaggaattccaggaaataggattttacacatgtgggaaacaggctgagagaggttatttaatttgccaaaggtcacacagctggtattagagaccgaatattaaagtaggcgtttcttaccccaaaatccactctctgcaccaagaggccactcagaaaatataaaaataagcaaatcaaataaattgactacgtaagtttgaaggcttcaagaaaatgtaaatacttccacccagaaaaa

SEQ ID NO: 254697 - DNA, 316 bp, Homo sapiens
tgtgctgtccatagtcactggaagcagtgaacacatcctactctgcttctgattctcaacttactgtttttgaagcacatgaacaggccaggcacggtggctcacgtctgtaatcccagcactttgggaggctgaagtgggcggatcatttgaggtcaggagtttgagatcagcctggccagcatggcgaaaccccatctctactaaaaatacaaaaattagctgggcgtggtggcacatgcctgtaatctcagctactcgggaggctgaggcaggagaattgcttgaacctgggaggcagaggttgcagtgagcc

SEQ ID NO: 254698 - DNA, 222 bp, Homo sapiens
cactattaagagaatgaaaaggtagtccacagagcaagaaaacaaaattttcaaatcacatatatgataatggcagtaagaatcttagcccatttcaggccgggcgcagtggctcacgcctataatcccagcactttgggaggccggggtgggcagatcataaggtcaggagatcgagaccatcctgactaacacggtgaaatcccgtctctactaaaaata

SEQ ID NO: 254699 - DNA, 433 bp, Homo sapiens
atgttctgatatcaatgtcactgaaaaaattttcttcagtaattaaatgattcactgtttcaactatttatttctacaaatatttattaaatagttactatctaatttttcttaccccaaaagaggaaaaagaaaaggaaggcccatttaacagaccaaaaaaattataaacaccattatttattgactacttcttctaagccaaatacctaaaaggtaggtagacttatttttactactctacagattaaaactgatgttcataactgatgttcaccaagtcacaaggctgaagtgatccgctcagagctgtccaatctcaatgtctatgttctgaacaactcctcctctcatgatgtcaatttttttttaaaaggagggccagaacataaatacacaagaaaatgaaacatggctaggactttctaagagc

SEQ ID NO: 254700 - DNA, 422 bp, Homo sapiens
aatgatgttcatcatgtaatttgagcctctagtttgtttatgctagaccaactttatccatactccaaacaaattatctcttataattaccagcccgaagataaatctctaaatgtttttctgatgatagtgctatggttggcaggtgttaaaagtgcctcccagggacaaagattgaagacgagcttgttcccacaaatcctcgaggcgaggatgttgagctttctatcctgccatgtgcaaaggagccttgtatggtgccctgctaatgaaatctaataggcaaaggtcgtacatctttacaaagaaaaatgcaaagttggttgtgtgataaatgggctccatggggctcagtggacgcgatttagtgaaaaaacccgtgtttaaacagtcagctcggttgctcgctaatgtttacgcct

SEQ ID NO: 254701 - DNA, 464 bp, Homo sapiens
ggaatctcaggccttagcccagctgtactaaattagaagctgcatttttcaggagattcccatccccaggcgccccccgtgattcctgtgcatattgaagtttgagaggcctggatttacgccactccctcccatgagcttggaacgtatgaatcagtgctcccttgagccactgataaactgagctctggacctgcaaaactggtccccatccaggtaatgctaacctgggacaccagccctcccctccaccagagcaactggctgcctccactttgacatcttttctttctgactgcaacagactctccttccagtatcaaagagtgagccaagcaacagacaggacttgtttatcgtaaggcgaaggcagccatgccttggattcatcaaaagtttgtgaaacgaggtttataaaatcatcatattatttgtgcatggaataaaatggccatgtgggtgaa

SEQ ID NO: 254702 - DNA, 513 bp, Homo sapiens
  misc_feature (503)..(504): n is a, c, g, or t
gtgagagggagtagttacttatgaatgcttgagaaaatggtgctgtccttagctgcaatacggaacccaggatgggaacaggtgaatagagttcatggagaagagctgggcaggaggcagacaattatttagaactttcagttttgtctagtaatgactggtttatcttttaccagtttatgataagctatgagcaggatctttttgtcaggcaattagaaagatgtataggttctttcttataatgcaaatactttttttctttcttttcttccttcttcttcttttttctcttcttcctcttcctctttttcttcttcctcttcttttttttttgaggcatagtctcactctgttgcccaggctagagtgcagcggtgtgatcttggctcactgcagcctctgcctcccaggagaatcacttaaactttggaggcagaggttgcagtgagctgaggtcgcacattgcattccagcctgggcaacaagagcaaaactccatnncaaaaaaat

SEQ ID NO: 254703 - DNA, 432 bp, Homo sapiens
ggctggtcgtgaacacctgggctcaagtgatctgcccgtcttggcttcccaaagcactgcgattacaggcgtgagccacttcacccagccttgttccattctttttaacaggtctacaatagtctgtgaattaggacaacgtgacttatttagctaatctgttattgatgctcatttaggctggacaaattctttcaaaggtagctcagcccaaactcattagcaattagagaaatgcaaatcaaaataacaaggaggtgtcattttacagctatcctattgactaacattagaaaggtgggtaatggccggcgcggtggctcatgcctgtaatcccagcactttgggaggctgaggcgggcagatcacgaggtccgaagatcgagaccatcctggctaacacagtgaaaccctgtctctactaaaaataca

SEQ ID NO: 254704 - DNA, 431 bp, Homo sapiens
caggactgtaggggtctcttgggacttattcagaaatgccttattttgctttcaaaattttataataataattgctaacattagttgagtgctatcagtttgccagcattttgcccattttacagtatgaggagtctaaaactcatggctaataataagtttggggtctgagatctgatcacagcagattccaggatcccctgtccactgtgaacacctgggctgaacccccatgagtacagttgctgggcatcatgattttgcacactgtactgcatgttccacatttggcagtgaaggctgattaaaaatagctgggctaatgaacggtctcagactactgcttggggcggtctgtagggctggctctcatggctgtgccccagaactctaagccaaatattaaaaataataatctcttttttggcagg

SEQ ID NO: 254705 - DNA, 249 bp, Homo sapiens
ctgttggtatgtgtacaacatgcatgtccagcactgtagcccttgctcatccacccagcctttaagttcctgttgcactgacatgcagttctgtaaaagttatttcatatgagtaaattttgtaatcccagctactcgggaggctgaggcaggagaatcctttgaacctggcagacggaggttgcggtgagccgaaatcacccattgccctccagcctgggcaacaagagcgagattctgtctcaaaaa

SEQ ID NO: 254706 - DNA, 336 bp, Homo sapiens
gatagtgtttaattctgtcacccaggctggagtgcaattgcatcatcatagctcactgcagcctcgaacccctgggctgaagggatcttcccactataggtacacgtcactatgcccagctaatttttttttttttttattgagacggagtttcttgtcacccaggctggaagtgagactccatctcaaaaaaaaaaaacaaaaaactcctacagagatccttattcagagaattgttagggatcttagtactgatctgtacaggatacactgcctgccctgacgtggagttacaactgaacctattcccctaagaatactagtgagaagaaccaa

SEQ ID NO: 254707 - DNA, 467 bp, Homo sapiens
gttgatggacacatggctgtttttaggtgtggacaattataagtaaagctgctataaacattcttgggcagatcattttgtggatatatattttcgtttctcataggtaaatgcttaggattggaataattgggtcatagagtatgtgtatgtttagttttattagatactgctagaccttttcccaaagtggttgtaccattttacacacagagcatttgatccacatccttgtcaacatttagtgtcaatttttcaaattttagtcattctggtggatgtgtggttgtatctcattgtgctatccagtttatttttaactcttgtcttctttcgtttccttgccctacttacatttcagtcttgccaaaacaagctatttacatatacattaataccctgtgcactttttattgttcatattgttcccatgagaggtaataataaatttgttttaaaatcatgaa

SEQ ID NO: 254708 - DNA, 438 bp, Homo sapiens
ctttgattttggatattactgaaaggttagcttgttttagactttattcttgaatgtatatatgtggtctaaatgtctgaattagaaggcatggaatggatggattatttaaaaaataatccttccttgctttagacggaagccttaaattctttctcttttggatcttcaatgctctttaatcacctaggtagctccaaaatctcatagtccacagttagggtagtgataggccatttgggcagctggtagttattgtaagacaatgtagaactatcagtttacactcttgacccatagaagtaattctgaggtccttgaagatccctgagactattggatgaggttcagggttcgtgcaagaggactgttagactgtgaggtcatccagattctgtctaagatcttgaaacttgaagctgaccttggccagcttgt

SEQ ID NO: 254709 - DNA, 498 bp, Homo sapiens
cattaaatatttgtagaacctactttttcctaacatcattgcttgccattttatgagttgttttctgcacatcaaagaaaggcaagatgtagtacaaatgctgatgtcaaatgtcagcattttaatccttaaagtcatctcttgattggtgtgttctttctttatttatttttaataaaaaattgtatttgcttagaagcattcagaatgtcaacaaaatggctacaactttttcttttttttttttttttttgcaattacagagtggtattcacttaacaacagtcattttatataagctgcatcagagacaactgaagatgaaaaaactaccatccccatatataactaatttgtgccatgcactaacaagaacctgcttttaatttccatgccagtttacaatccccatactgtactaggcaaggttggtggctattgaaaataccaccaggacagggatatctaaagacacatttggtagtgtgttaactatac

SEQ ID NO: 254710 - DNA, 1187 bp, Homo sapiens
attccacaaatagagaaaaagagtaagaagataaagtccattcccttctttggggaactggggaaggactgataagcaaacaaagaattaacagagtgatacagtaaaataaaatacagagattatattttcatgtttttcccatgttcactcttttcctctcagtagtttggaaactttgtgaaagtggagatgcagtgcattttacatggttcattgcatctagcattttttttttttttttttgagatagagtcccactcttgcccaggctggagcgcaagtggcgcgatctcggctcactgcaacttccgcctcccggtttcaagcagttctccagcatcagcctcccgagtagctgggactacaggcacgtgctaccacgcccggctaattttttgtatttttagtagagatggggtttcaccatgttagccaggatggtctccatctcctgacctcgtgatcagcccacctcagcctcccaaagtgctgggattacaggcgtgagccaccgcacccagcccatctagcataatgttttgcatagttgtcagcagataaatattgaatgacaaaactcagatggaggaaaaagaacaaaataacctagttctcagaaagatttaatgagcaaatgggaaaatgtcaaaaagatttgcaatgccattcctaaataactatttccccttttagtcattagaaaacgtctaaacactttcaacattaaatctttcacttgcattttaacagagcactacttaattttgggttaccttttatatactttgtacattttaaggtgattatactggagatagaagggggttagactctagatgtgtgttgtccaatacagtaacttttagccaccagtggctattgagcacttgaaatgtggctagtctgaattgagatctataaatataaaattcacactggattttgaagactcagtatggaaagaaaaatgttaaaatatctcaatttttttcatattgattgcatgttgaaatatttttgacattgtgttaaaatatattgaaaaattaattatcctcattttgccattgtttaatgtggctactagtaaatctaaaattacataggacagcatgtctcgacttcctgaggaatatctgaaagcatataaaatatctgtaaaaattaaacatgttaatactttc

SEQ ID NO: 254711 - DNA, 428 bp, Homo sapiens
aaactttaccctgaaacatttctgttgaattcatcctggcaatgtaaactgatagctgatcttaacaggtgcaggacagaaaatcattcctctgctcacctgagagaaatgcttatctgattgcttcctcagacctactgtgtatgtaaaaatgaagattcactgagccagactagattgtgaattcactgaaaggctgatcaaggactcaaaagaatgcaagcttttgtctcttatctacctatgacctggaagcccccctcttcgagttgtcctgtgttactggatggaaccaaagtatatcttacatatattaattgatgtctcaggtctccctaaaatgcacaaaagcaagctgtaccccagccaccttggggacgtgtcgtcaggacctgttggcaaaataaacttttaaattgcttgagacc

SEQ ID NO: 254712 - DNA, 318 bp, Homo sapiens
gctagaacttaaagtataattaaaaaaaaaaaagtctgttggtgaaggttgaagataacgaggcagtgggctgactggtgaaaactaaatcatcttttgtccttcaaagtcttgggccaggaacagtggctcacacctgtgcacggtggctcctagcactttgggaggccgaagtgggtggattgcttgagtctaggagtttgagaccagcctgggcaacatggcaaaacccatctctactaaaaatacaaaaaatcagccaggcttggtggcgtgtgcctgtagtcccagctactcaggaggctgaggtggaagaat

SEQ ID NO: 254713 - DNA, 5808 bp, Homo sapiens
gcgcgcgcgagggcgttgggcgccgccgcgaggcggggaagcgcggggccgcggcggtgcgggttctagggcggcggccgtcgccgtcgcagcagcgccccgagcggggagggccgaggaggcccgacgagctggggatggagagtaccgggcccctcactgcctcagagcgcgtgtgcggctctgggcgcgcacagtgacggtgacggcacccctggcccggcagcgccgaggccgcttcgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccgtggtcttccgggggcggcaccgccagaaaactgattgggaggtagctattaaaagtattaataaaaagaacttgtcaaaatcacaaatactgcttggaaaggaaattaaaatcttaaaggaacttcagcatgaaaatattgtagcactctatgatgttcaggaattacccaactctgtctttttggtgatggagtattgcaatggtggagacctcgcagattatttgcaagcgaaagggactctcagtgaagacacgatcagagtgtttctgcatcagattgctgctgccatgcgaatcctgcacagcaaaggaatcatccacagagatctcaaaccacagaacatcttgctgtcctatgccaatcgcagaaaatcaagtgtcagtggtattcgcatcaaaatagcggattttggttttgctcgttacctacatagtaacatgatggctgcaacactgtgtggatccccgatgtacatggctcctgaggttattatgtctcaacattatgatgctaaggctgacttgtggagcataggaacagtgatataccaatgcctagttggaaaaccaccttttcaggccaatagtcctcaagacttaaggatgttttatgaaaaaaacaggagcttaatgcctagtattcccagagaaacatcaccttatttggctaatctccttttgggtttgcttcagagaaaccaaaaagatagaatggactttgaagcgttttttagccatccttttcttgagcaaggtccagtaaaaaaatcttgcccagttccagtgcccatgtattctggttctgtctctggaagctcctgtggcagctctccatcttgtcgttttgcttctccaccatcccttccagatatgcagcatattcaggaagaaaacttatcttccccaccattgggtcctcccaactatctacaagtttccaaagattctgccagtactagtagcaagaactcttcttgtgacacggatgactttgttttggtgccacacaacatctcgtcagaccactcatgtgatatgccaatggggactgctggcagacgtgcttcaaatgaattcttggtgtgtggagggcagtgtcagcctactgtgtcacctcacagcgaaacagcaccaattccagttcctactcaaataaggaattatcagcgcatagagcagaatcttacatctactgccagctcaggcacaaatgtacatggttctccaagatctgcagtggtacgaaggtccaacaccagccccatgggcttcctccggccgggatcatgctccccagtaccagcagacacagcacagacagttggacgaaggctctccactgggtcttctaggccttactcaccttcccctttggttggtaccattcctgagcaattcagtcagtgctgctgtgggcatcctcagggccatgactccaggagtagaaactcctcaggttctccagtgccacaagctcagtccccacagtctctcttatcgggtgctagactgcagagcgcccccaccctcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcagatctgtcagtaccgggaagttatcagatcaacaaggaaagactcctatatgtcgacatcagggcagcacagacagtttaaatacagaacgaccaatggatatagctccggcaggagcctgtggtggtgttctggcacctcctgcaggtacagcagcaagttccaaggctgtcctcttcactgtagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggcgggtggagcagctggtgttgtacatgaaagcagcacagctgcttgcggcttctctgcatcttgccaaagcccagatcaagtccgggaaactgagcccatccacagctgtgaaacaagttgtcaagaatctgaacgaacgatataaattctgcatcaccatgcgcaagaaacttacagaaaagctgaatcgattcttctctgacaaacagaggtttattgatgaaatcaacagtgtgactgcagagaaactcatctataattgtgctgtagaaatggttcagtctgcagccctggatgagatgtttcagcagaccgaagatattgtttatcgctatcataaggcagcccttcttttggaaggcctaagtaggattctacaggaccctgcagatattgaaaatgtgcataaatataaatgtagtattgagagaagactgtcggcgctctgccatagcaccgcaaccgtgtgagcagcaggctcatcccgtggaccggtggtgggaacgtgaggtgatgcctttgggattacagcttgagttctgtcaccccatccccaggaaactgtagcttcttaactggtgactaccaaagaacaagcagtgatttgaaaaaggaaaaacaatccaaaaactacatatttgtaggaaatctgccttattggagaaaatcaccctttccctttttctttgtagaagcaggagcaagagtgtttggctcccagtttggacttggtgaataaatgtaccttagaactaggataatcggtacagttattcttaaagataattaaaaatgaaacaaagtgagtgctcgtcactgggttcatcagagcagtgtgtgaaattccatgtgtttgctgaggtgtaaaggtaaatgtattcacccctcatccaggcagtttgatatttggagtaagtttgtttaaatctgagcatgcatctttaaacagctcaggaagaaatagcttaagaagaagtgaaacatggatcttggaagaaattttgaaatcttcaatttgatcctaatatggatacatgttaatcttccaaaatctttcatattgcactaatttattaaaacaactgtgtattggattttgtaatttaactaaggcacaatggacttgtttaaaatattttacttgattgtatacatagaccctttccagaattcacatgtaatctccagtgaacttttaagtggttaaaacttgtattcatgtgaacctttgcacatttttttttttttacttctttatctacacctacagattttctcagtaatgtttttgttagcttttggttccattttttattgtgcatgcagaatgtacattgatgcctgtgaccttaggtttattaaaggctaggtttatttgggcagtattagaaacaaaatcatggatcaagagatactcttgataatttgaatagggccaaaacaaagttggtgacctaaaggcttgttagtgatgtggagttcctacatgcagtgagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattatttggtttcttttacttacctgcttgaatacttgaataaaccattcaccaattttaatccttttattttaatccttttacataaaataatctgaactctttgacaaattgcacagagctctttggcattaatctaattttaatgtactgataaaaacaaacatggttgtcctttactttgacaaagtaatgtaatttttaccttatttatctgtatgaaattccagtagttaatttgaacatttatttatatgacgtttgtatttttaggtctttaatacagtgtttctacctctcatttgtaactgcatgcattattcttgaaactaggtaaaactcactgaattgttgtgtaatagcctttttattattgcctgtacaaatgtatattaaggtaaaataaaactgacaaagtgtttctagggtgtagctgggtacatattaagtggcttgttgagccaggtacttccttagtgagtttagagacttggccatgaatatcctttgtcctgccccaggatttagatcttggctactgtcatgcaggcttccaggaacatagactgttttacctccacaaccctatttgttattagtgatactttattttatataatattttttattcacagtgaaatttcattcatgttctttcagttatcacctgtgttatctcagttgtaggtttattctatcctctcctcttcctctcccatttcttttttaacacaggatgaaacaggttcagagaggggaagtgattggcctaaagtcaggaactaggcaagtggtcaagccatgctttgtgactttcaagttaattcttcttgttcttgtatattaaaggtcttggggtagatggtgtgtgtgaaacagtgaagtctcaacagcagaaaagaacaaaatgtaaattcatgaataatggttctggttatacttccattatcaaggctaattaagagattttgccttgagtatagcaataataaacaaatgctttatgtttccctg

SEQ ID NO: 254714 - DNA, 1448 bp, Homo sapiens
tttgagaaatctgatatctcttcatagtcttcaattattaaagttaaaaaaataaataaatgtgaatccaaattcctcattcccttcatgctctccttcacaacccaatcctgttgatggaatatgcagatggtatttgattttgtgtgcttaaatatttacgtgactccttttgtaccagcgaaagggactctcagtgaagacacgatcagagtgtttctgcatcagattgctgctgccatgcgaatcctgcacagcaaaggaatcatccacagagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattatttggtttcttttacttacctgcttgaatacttgaataaaccattcaccaattttaatccttttattttaatccttttacataaaataatctgaactctttgacaaattgcacagagctctttggcattaatctaattttaatgtactgataaaaacaaacatggttgtcctttactttgacaaagtaatgtaatttttaccttatttatctgtatgaaattccagtagttaatttgaacatttatttatatgacgtttgtatttttaggtctttaatacagtgtttctacctctcatttgtaactgcatgcattattcttgaaactaggtaaaactcactgaattgttgtgtaatagcctttttattattgcctgtacaaatgtatattaaggtaaaataaaactgacaaagtgtttctagggtgtagctgggtacatattaagtggcttgttgagccaggtacttccttagtgagtttagagacttggccatgaatatcctttgtcctgccccaggatttagatcttggctactgtcatgcaggcttccaggaacatagactgttttacctccacaaccctatttgttattagtgatactttattttatataatattttttattcacagtgaaatttcattcatgttctttcagttatcacctgtgttatctcagttgtaggtttattctatcctctcctcttcctctcccatttcttttttaacacaggatgaaacaggttcagagaggggaagtgattggcctaaagtcaggaactaggcaagtggtcaagccatgctttgtgactttcaagttaattcttcttgttcttgtatattaaaggtcttggggtagatggtgtgtgtgaaacagtgaagtctcaacagcagaaaagaacaaaatgtaaattcatgaataatggttctggttatacttccattatcaaggctaattaagagattttgccttgagtatagcaataataaacaaatgctttatgtttccctg

SEQ ID NO: 254715 - DNA, 5386 bp, Homo sapiens
gcgcgcgcgagggcgttgggcgccgccgcgaggcggggaagcgcggggccgcggcggtgcgggttctagggcgcggccatggaggtggtgggtgacttcgagtacagcaagagggatctcgtgggacacggggccttcgccgtggtcttccgggggcggcaccgccagaaaactgattgggaggtagctattaaaagtattaataaaaagaacttgtcaaaatcacaaatactgcttggaaaggaaattaaaatcttaaaggaacttcagcatgaaaatattgtagcactctatgatgttcaggaattacccaactctgtctttttggtgatggagtattgcaatggtggagacctcgcagattatttgcaagcgaaagggactctcagtgaagacacgatcagagtgtttctgcatcagattgctgctgccatgcgaatcctgcacagcaaaggaatcatccacagagatctcaaaccacagaacatcttgctgtcctatgccaatcgcagaaaatcaagtgtcagtggtattcgcatcaaaatagcggattttggttttgctcgttacctacatagtaacatgatggctgcaacactgtgtggatccccgatgtacatggctcctgaggttattatgtctcaacattatgatgctaaggctgacttgtggagcataggaacagtgatataccaatgcctagttggaaaaccaccttttcaggccaatagtcctcaagacttaaggatgttttatgaaaaaaacaggagcttaatgcctagtattcccagagaaacatcaccttatttggctaatctccttttgggtttgcttcagagaaaccaaaaagatagaatggactttgaagcgttttttagccatccttttcttgagcaaggtccagtaaaaaaatcttgcccagttccagtgcccatgtattctggttctgtctctggaagctcctgtggcagctctccatcttgtcgttttgcttctccaccatcccttccagatatgcagcatattcaggaagaaaacttatcttccccaccattgggtcctcccaactatctacaagtttccaaagattctgccagtactagtagcaagaactcttcttgtgacacggatgactttgttttggtgccacacaacatctcgtcagaccactcatgtgatatgccaatggggactgctggcagacgtgcttcaaatgaattcttggtgtgtggagggcagtgtcagcctactgtgtcacctcacagcgaaacagcaccaattccagttcctactcaaataaggaattatcagcgcatagagcagaatcttacatctactgccagctcaggcacaaatgtacatggttctccaagatctgcagtggtacgaaggtccaacaccagccccatgggcttcctccggccgggatcatgctccccagtaccagcagacacagcacagacagttggacgaaggctctccactgggtcttctaggccttactcaccttcccctttggttggtaccattcctgagcaattcagtcagtgctgctgtgggcatcctcagggccatgactccaggagtagaaactcctcaggttctccagtgccacaagctcagtccccacagtctctcttatcgggtgctagactgcagagcgcccccaccctcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcagatctgtcagtaccgggaagttatcagatcaacaaggaaagactcctatatgtcgacatcagggcagcacagacagtttaaatacagaacgaccaatggatatagctccggcaggagcctgtggtggtgttctggcacctcctgcaggtacagcagcaagttccaaggctgtcctcttcactgtagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggcgggtggagcagctggtgttgtacatgaaagcagcacagctgcttgcggcttctctgcatcttgccaaagcccagatcaagtccgggaaactgagcccatccacagctgtgaaacaagttgtcaagaatctgaacgaacgatataaattctgcatcaccatgcgcaagaaacttacagaaaagctgaatcgattcttctctgacaaacagaggtttattgatgaaatcaacagtgtgactgcagagaaactcatctataattgtgctgtagaaatggttcagtctgcagccctggatgagatgtttcagcagaccgaagatattgtttatcgctatcataaggcagcccttcttttggaaggcctaagtaggattctacaggaccctgcagatattgaaaatgtgcataaatataaatgtagtattgagagaagactgtcggcgctctgccatagcaccgcaaccgtgtgagcagcaggctcatcccgtggaccggtggtgggaacgtgaggtgatgcctttgggattacagcttgagttctgtcaccccatccccaggaaactgtagcttcttaactggtgactaccaaagaacaagcagtgatttgaaaaaggaaaaacaatccaaaaactacatatttgtaggaaatctgccttattggagaaaatcaccctttccctttttctttgtagaagcaggagcaagagtgtttggctcccagtttggacttggtgaataaatgtaccttagaactaggataatcggtacagttattcttaaagataattaaaaatgaaacaaagtgagtgctcgtcactgggttcatcagagcagtgtgtgaaattccatgtgtttgctgaggtgtaaaggtaaatgtattcacccctcatccaggcagtttgatatttggagtaagtttgtttaaatctgagcatgcatctttaaacagctcaggaagaaatagcttaagaagaagtgaaacatggatcttggaagaaattttgaaatcttcaatttgatcctaatatggatacatgttaatcttccaaaatctttcatattgcactaatttattaaaacaactgtgtattggattttgtaatttaactaaggcacaatggacttgtttaaaatattttacttgattgtatacatagaccctttccagaattcacatgtaatctccagtgaacttttaagtggttaaaacttgtattcatgtgaacctttgcacatttttttttttttacttctttatctacacctacagattttctcagtaatgtttttgttagcttttggttccattttttattgtgcatgcagaatgtacattgatgcctgtgaccttaggtttattaaaggctaggtttatttgggcagtattagaaacaaaatcatggatcaagagatactcttgataatttgaatagggccaaaacaaagttggtgacctaaaggcttgttagtgatgtggagttcctacatgcagtgagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattatttggtttcttttacttacctgcttgaatacttgaataaaccattcaccaattttaatccttttattttaatccttttacataaaataatctgaactctttgacaaattgcacagagctctttggcattaatctaattttaatgtactgataaaaacaaacatggttgtcctttactttgacaaagtaatgtaatttttaccttatttatctgtatgaaattccagtagttaatttgaacatttatttatatgacgtttgtatttttaggtctttaatacagtgtttctacctctcatttgtaactgcatgcattattcttgaaactaggtaaaactcactgaattgttgtgtaatagcctttttattattgcctgtacaaatgtatattaaggtaaaataaaactgacaaagtgtttctagggtgtagctgggtacatattaagtggcttgttgagccaggtacttccttagtgagtttagagacttggccatgaatatcctttgtcctgccccaggatttagatcttggctactgtcatgcaggcttccaggaacatagactgttttacctccacaaccctatttgttattagtgatactttattttatataatattttttattcacagtgaaatttcattcatgttctttcagttatcacctgtgttatctcagttgtaggtttattctatcctctcctcttcctctcccatttcttttttaacacaggatgaaacaggttcagagaggggaagtgattggcctaaagtcaggaactaggcaagtggtcaagccatgctttgtgactttcaagttaattcttcttgttcttgtatattaaaggtcttggggtagatggtgtgtgtgaaacagtgaagtctcaacagcagaaaagaacaaaatgtaaattcatgaataatggttctggttatacttccattatcaaggctaattaagagattttgccttgagtatagcaataataaacaaatgctttatgtttccctg

SEQ ID NO: 254716 - DNA, 450 bp, Homo sapiens
ctaggcttctttcttttctgcctagaaataggtcctatgttttataccttataaatggtcattgtagtttttgatgcctgagacagcagttttcttgttcaaactcctctacagtgacttcattaatgagcttctgaatgtttctgaacataaatacaataacaggttgtttatcatggccgggcgcggtggctcacgcctgtaatcccagcactttgggaggccgaggcaggcggatcacgaggtcagaagatcgagaccatcctggctaacacggtgaaaccttgtctctactaaaaatacaaaaaaattagccgggcatggtggcaggcacctgtagtcccagctactcgggaggctgaggcaggagaatggcgtgaacccgggaggcggagcctgcagtgagccaaggtcgcgccactgcactccagcctgggtgactccgtctca

SEQ ID NO: 254717 - DNA, 715 bp, Homo sapiens
ttttgtaattggacaacccattgaacatagtgtcatttatgtaatcatgagttttttaatcttctagtcaagaagaaatattatacaatctaccattgtaaatatacccaataataaagaatagcacattacttgcaaaaatctgagcaaagtatggctaattttactactttgctaaatttactttatactttccagcacaaagcactgtaacctgcctacacataatgacaatatttaaataaagatgaattatgtaataccatgggtaccttactaaatctatagactgctttcttgattagaaataatttttctttgtcatcaaaattgtggcaattctaattttatatagacattttatgggatgaaaagagaacatagacggacaacatgaattctttccatccacttgccctctaccaaaggcactttgatgggcagttgttaatgttaatacctattctgtttccctcagcttcttttataatgcattttttctatgttgacctttgcacaattctatctttactctttgaaactcacaaaaaccctataagataaatattttcatcacccctattttacagataaagaaacagggaagcctaaagtcaaacagatagcaaataaaagagctagaattcaaatccaggccagcctacctacaaactaggcttttaatcactatactttgactcaagcaaaggataaa

SEQ ID NO: 254718 - DNA, 464 bp, Homo sapiens
aagaaacaaaaggcatctacattggaaaagaggaagtcaaactatcttcctttgtggatgatatggttctatacctagaaatacctatagactctgacagaaggctcctggaaataataaacaattttagtaaagtttcaggatacaaaatcaatgtacaaacgtcaaataacctttatgctgagagtcaaatcaagagtgcaatcacatttacaacagccacagaaaaaataatacctaggagtacacctaaccaaggaggtgaaagatctctttaaggagaactgtaaaacactgctgaatgaagacgtaaatgacacaaacaaatggaaaaatatgtcatactcatggattggaagaatcaatatagttaaaatggccataatgagcaatgcaatgtatagattcatagattcaatgttgttcctaccaaactaccaacatcattttcacagaacttaaaa

SEQ ID NO: 254719 - DNA, 287 bp, Homo sapiens
gagagacaggtttggtactatagattgaatgtttatgtcctctgcctccctaaattcatatgttgatactgagtccctaattatgagggtattaggatgtggagcctttgtgggggcaattagtgcacttatagaagtggcttcaaaagcacatctttactccttctgccatgtgaggacacaacaaaaagccggtcctcaccagatactgaatgtgccagcaccttgattttggacttcccggcctctggaactgtgagaaataaattcctgttgtttataatcca

SEQ ID NO: 254720 - DNA, 684 bp, Homo sapiens
attttaaaattctatctttctgctgaactctaaccttctaatattgccttctaagcaaattaaaggctgccttatactgaatgaggaagagaacaaatacttggctgaatgaggtactgcaagagactgcatgcactttgaagaaagacttgagttattgtcataggatttccattctctttagctttttcttaaacatatgacaaaatacctacacagagagtggtatttgagttaatatagtacatttatttttcagactgacattcagcttaaatatgccagtatgtgatttaatccacaggtacctgatgaacacattattgtcagattggttacagttgctaaacgctatctgaaggtcattcctagtcatttatacgtgtcagggtaaaagtgaagcgatttgaactataaaaatacctttgaaataatttatcaatgtattagataagctcagtttcagaatgataaactgttagaccaaataatgtggctaattaacagtggtacgatttctagcccgagggtttaaaatggagttaaagtaagtgtctttaaactgaactcaaagaatgcaaaagcggcaagttcagaaaaggcaagaacaggacctttagtccattttaagccataaatattacacaaaatatgcctctaactgaaactgagaggtataaaaac

SEQ ID NO: 254721 - DNA, 505 bp, Homo sapiens
gatgctgactctgttttgcctgaaaccagacaagctctgcttcagggtctgtgagtggaaggggggtgggtgggaacctctcgcaacctctcctgggacagacacaatgggcaatcgtgacctcctggggtagatactgaaactgtgacaagtgataacaaaactggcagaaatcagttggacccaatatggccaactggagtttctgcagaaagagcttgctgatatcacagcctgaatttccacgcatgtttcgtattaactgccccggaatttgatttgcacacagcacccatgaggaagcatgaagagataactgcgcatgtctgaggacttgccagacctcctctttccttccaccgatctcctgctaatcccggaacccaccctctaacccttttctaataaaattatttccttaaaggcagcacagcgagacagatttgagctggactcctgtctccgtgttggtcaatttgcaatgaaaagcttttcttttctctga

SEQ ID NO: 254722 - DNA, 590 bp, Homo sapiens
catggccgagtctgtcacattcttccgatctttcctcaaatacctcccaccccacaaggtcttccctggccaccgagctagacttgcacctcctacagcactctctgttcccctgagcctggccaccaagctagacttgcacctcccacagcactctctgttcccctgagcctcttcaggtttctttttagcacactgagcacattacatatttgacttatttatcgtgtttattttctgtatcttctccctacaatgtaagctgcgtgaggacagagactctgttttattccttgtgatatacgcaggacctagaacagcaactactcagagcagacactaagtaaatattgattgatgattgattgattaaggaatctgtctacccatctaccatccagtggtctacactacaccaacaaccctccttcctttctcttatccaccaatcttagccatccaaaacacatcataaattcattgatctacctgttccacccattcagcatatggatctgtcccagccatccagcatccgttactatatccagcctgggcaacatagcgagaccccgtctcaaaaaaaaaaa

SEQ ID NO: 254723 - DNA, 422 bp, Homo sapiens
atttttactcacttaaaagtaaaggtgcaagatacaagttagaaatctaaaattcttctcatttgtcattggcttgtaattgttaatagtccagaattttctgagtgtctgaacctttatcttcccctctctcccctaggtaaagctatggtactttagaaaaagtcaactctgtgtaaaccactgtatcaggaaaatcttctggttgtgcctcaaaatctgctttatccaacttgttcctccttgcatttacacacttctctactactcagtacttataaaaactttgccttgctctgtaaattcctgaaactactttcattgcttttttaaacacttcaaaattacagcaaacattttattcttaaagattttggccatttcattactgttgagttttagagagctcacctagtttcaga

SEQ ID NO: 254724 - DNA, 341 bp, Homo sapiens
gaaaatcacctgagtctgggggtttgtggctacagtgagctttcagcctgggcaacagagtgagaacattgtctaaaaaaaaaaaaaaaaaaaaaaaagaatatgcaagaactttatggagataactggaacattttactggagagcattacacaatgttaaataaatggaaagagattttatgttcatggatgaagacccagagtagtaaaaacaggtaattctcacagaacaacctataggtttagtataatgacaattaaaatcctggattttctcttctggtggtggtaaacaagataatttgaacctgttttcccagttaacttaaaaagtaaaaa

SEQ ID NO: 254725 - DNA, 421 bp, Homo sapiens
  misc_feature (368)..(368): n is a, c, g, or t
attcgcggccgcgtcgacctcccttcccagcctggctcagtcttcccacacaggttgagagaggaggggatccaattgcctgtgaggaggacacggctcctgggtggaccctgcagattgtgaagttcaagtcacagctcctgggaaggtctctgtgtgtaaagatcatgggggtgagacagattcagggaccacactctgctctgctctgtacctctgagtgtcgatccagctgccttgtgaccaggacacttagaagaagcatggaccctgcaagaggatgggctcaaggacagcttgcctgactgcagccataagggtgaagcctcttcaggtagagaaggactccaggtggggcctgtgcaganggttcttacgggcgcagtaggattggggctataaaatcagtaaatggaaaagg

SEQ ID NO: 254726 - DNA, 473 bp, Homo sapiens
  misc_feature (450)..(453): n is a, c, g, or t
gactcagggagcagagaaaatgatgagcccgacgaacattctggagcaagtcaaaagaagcaaatccccaaggaatgggcgagagcccagaaagtgctggtgctggacacaagtgcggggttggagggacccgtggctgcagacactccctggggcgcggcaatgggcggcctagggaagagaaggtgtccttggaggggctgcggcagcgccggggagaagtgggctgctcccagaggagggccgggtggcccagagggaagaccctgcttgctggggaccctcagagacccgtggagtgggggcgctgggctgcagggggttaagggcgaagacatcttttgggtgcttgagagctgcggtagaaatggggcaggaaggggtggcgcggggctcgggggtgacgtcccagcagcctgtcccgccccggctggcagcgcgacccccgcnnnnggggaaggagcagcggtcgc

SEQ ID NO: 254727 - DNA, 289 bp, Homo sapiens
gccttataatcctcacatcaccgtcgggaggcctgtgcaactgccatttccccacttcagaggtgaggaagcagacctagaaaagtttccatgacttgtgtgatagcacacaactgatcaaggatgagttgaggtttgaacccaagaagcctggcaccagaaaggaaaacgcactccaatgcacaagacatacattgtcacccacacaggcccagccatctcccctcctgcttcatctaaccactagaagtgcggggatagttatggcagagacaaagaaacccactca

SEQ ID NO: 254728 - DNA, 1890 bp, Homo sapiens
tatgttgccaagctttatttaggctgtaatggttacagataacacacatctaaccctatattctctgcgtcccatgcagtcccctgagcaggctcagctaccctttccctccagtctcacttcttgtcttcctccttcttgtccttcttgccatccttggtggcctggcaggccagggagcccacagcgtttcaaatggcttcattgttgggatccacacctgggaggttctccaggacactctgaaggaactcaggatcctgcatcacgtcgtaatcatcctcctccttggctggctggcaagtgtccatggctgagctggcatcaatgtctactgattccgcctggccaaactctgctcctgcagggacatcttcatgacataagcaatcccctcttccttaggtcaggaagtccggtatggccaaactcttgttggctaatggtcatcttcagcaggacctcgtctgagccttcagtcccagttgtagcaatcctggcctcagcagcagaggctgcagctgctcgtctgggctcctcatcctgccgctgctgctgctcctccatagaaacccgagggccaaggccagctgaggatcagcactgggatctactccaaattcaaagtcactggcaccgagacccagcatggcacccccttccccagccaaaatcggagaactgatgagagcatcagccaagctgggcccaggaggcactgccaccagatgagaaccgcttccatctttgccattcaacgtgtttacaaaggctgtcagcttttctctgttcacctcctcttcccccaaatttatcatgtcaacatttactttctccttcttgaggaatttagccagtttcaccagatccttctcattgcctttgggcttcccacgaaggcaatgatatgcgtcttgtgattcttgccccgtcagcgcttcagagccagatgggccatgtggatgccagtgtagaaggtgatcttgcccttgggttggacggtgtgtagcttggacaggatgcggccggtgtctagagtgagtgtggtcagcacttcacagtcattagccagtgtgatgagggccatgttgttctcagggttgctgtggattttgtttaattttttttttttttttgagactgagtcttgctctgtcacctaggctggtgtgcaatggcgcaatctcagctcactgcaacctctgcctctcgggttcaagggattctcctgtctcagcctcccaagtagctggaactacaggcgcctgccaccacacccggctaatttttgtatttttagtagggacggggttttaccatgttggtcaggctggtcttgaactcctgacctcatggtctgcctgcctcggcctctcaaagtgctgggattacaggcgtgaaccactgcgcccggcctgttgtgggttttgaatgacatactatgttgacagcgtcttgctgggcctgcagctgggtggggaagaagtcctcattccgcacatactgttgtccacacacaccatagcgctttccgacaccatcctgccaccctcctccctcccatttcttgaaataatccttcatgtataacttaggttaatagtgcctcatagtctacttagaaagaatcagatagaattttctttagtaaggaaatttccaaatagagaatagaaaagttaattgatggcaatgtatttaatagcgaggatcagtgaggaaatgaattaaagaggttccttttacacttttcttctctgaagctaggtacaccttagttcatgttgcagcttctttggtgctgtcagatcatagttggtatgaaatgggaagtttctgaaagtcagatgacacatttgtgaaatgcaacctcactgttatctacccggc

SEQ ID NO: 254729 - DNA, 443 bp, Homo sapiens
agttgatgcagtttcttcatagtgtcattggtctgtgtacttcagtgtgtttttgcagtggctggtattcagcatcttttcatgtgcttattggccttttgtatatcttctttgaagagacatctgttcaagaccttttgcctgtttttaaaatttagtttttaaattggcaaatacaaattgtatatatttatcatatgcaatgtaatgttttgaaatatgtacacattgtggaatggctaaattgagctaattaacatatgcattacttcacatacttttttttgtgatgagaatacttacaatcttactctcagcaattttcaagaatacaggtgaggctgaggcaggaggattgcttgagcctagaagatcgaggctgcagtgagccatgttcacaccactgcacaccagcctgggcaactgagtgaaactttgtctca

SEQ ID NO: 254730 - DNA, 942 bp, Homo sapiens
actccacatcaaatatttgatggcactggaatagactttggcaaatgtagtccattttctaatttcttcttcatttgcatttaaaggaatttcttcttcatttgcatttaaaggaatttgagttacagaggagagatgatacttattaaagccaagacaggtttcaaacactttcttctgaaaatccacttttttcctttgcggtcagcagcatttactataggaaaatatacacttaacatttagccaaaaataaaaacttctgcaaaatgtctatattcagattgcttctatattttgaggttgcattcacattaacctcaaaagaacctagatgctggtgctcagaagaaattgagtagttgaaaaccacagtggagtcagaaatcagaagaaattaaattaccattatggcactaagccctaatcccagaaaatcaaaacacaattagtcagccactaaatccattataaaatataataaacatcattagaattttttatctcccagcaaataaagagttggagacattatcccattgcttaaccactttttatagtggggtcattattccttaaggtgttactaaacacactcatcaacctagaaatcccaagtttaccttccaaatacatgatctcatccttctgtgtaaagttaatcgaagttgtaaaagtgcttcattctctatctttatttttccccacagggacagggaaataaaaatgtgatgcattggaggagaatcacaggatgcaacaaataaaacttgagatgtctctactctatgagaaagtatgtagagattaaccctctcctggaaaatgaacatttaaatgtgttttctacggatatcatacttttagttaggaaattctttatatccagcatgactttttcatgctgtaataaccttccagttgttaaccaagaatttttct

SEQ ID NO: 254731 - DNA, 699 bp, Homo sapiens
gtgaggtctgcatttgtagactcgaatctcccatttacattcttggactaaaacctcgctcctgcttatcatgtaatcatggagctaagctaggcttggagaagagtggcaagaagttcccacgtgcatggagctgtagtttttcccacattcctcttaggagctgtgcctaagatgctgcgctagcaacctctgtattgtgaaggaactgcgtttcctggattcccacaggagttggattcctgtccttgtgaagccatctcagggaacagggtgggcggaaggggcactggaggccatcatgattgtcctaacaggcattcttctggcaggaactggcaaggatagaacacagacttggtccctgcagctgaaagggaggaggcaggatggtgatggaagaggcgaaagaaagatatttgcatgggcaagcccagtattcaataactgtggcaagacttcatccttacaaatctacttagggccgactccacacctgagccgcttcccagacctgctgttctatcccggaagcagagggcagcatggcgaagacctgcctctgtctttgacgctggcacattgatgcgattcttccaagctctttgctcctgggtgacccccattgcacgcagagcctccacaatgtttggggagggggctgagcacacctctgtgtgcttcatccagccagccagc

SEQ ID NO: 254732 - DNA, 378 bp, Homo sapiens
  misc_feature (367)..(367): n is a, c, g, or t
  misc_feature (372)..(372): n is a, c, g, or t
ttcaacatggggtttggaggggacacacgtccaaaccatatcagaagccttcagacaagacactactgtttccttccttcccaactgatttaacgatgacttccacattgctagttatattcctggaccccactggcatttgtgttggaggccgggacaagtcgtggctcatgctgcttttgccttttgatgccttgtccagccagagaactcctacccttcaggcctagctcaacttccaattcttctgtgtgtctgtgcctcctgacagactcagtgagcatgagcagctcccttcctgtgtccccagattgttcaaggcatatttcaacagatgaattcaattcactgagaatcagtggactantatantatcaa

SEQ ID NO: 254733 - DNA, 448 bp, Homo sapiens
aacagactaatacatggctttgggcagcttctcatgtctagccatggtagctattcttatgatttggatggtgcccaagcattgctctcgagctccaggcccatatatttaaccacctccagatattctatacttaaatggtttagaggcaattcaaacagctacaaaagacaaatcatgatctcagttcaccccacccacatgtgacttccagagctcccaagatcagccagtagcaccacctgccatcagttcaacttcccaagccagaaattcaaaggataccttgatgtctcccttctccttccccgttctgtccaatctcatctgttcattcagcaaacacttactgagcaccccagcactgtacaggagctagggatgaacaggtgaataagagaggctctttgggaggttaggtgcagtggggcagacaggcaatcacggt

SEQ ID NO: 254734 - DNA, 412 bp, Homo sapiens
ccatcttgggcctgtggcgtgggccacctgtgtccatctgcacccctcgtctccatcaccgttgctcagagtgacttgttctcctctccaaagggccgcatgctttataggtggtcatttgtgatatctgtggggcaccagccagcccagtgaatccctgcatgtgccacaggggcctcccgtcccagtcgcaaggactctggcctaagggtgcaaggccagaggctcccggcccccaccccatcacagttactgtgagccttggctgaatgtgcaacagtgtctatttcaagatcactctgggacttaaaatagtctgtcctggcacacctggttttctggtggatttagtaatggagttaccatatgctgtaaatcatgcaaaatcaataactcaagagaggtgggcata

SEQ ID NO: 254735 - DNA, 406 bp, Homo sapiens
gggagagagagagagagagagagagagagagagagagagagacactaacataattactgagtttcctctgtcttctccctccctccctccttccctctgtttttcagtctcttgcagtcaaaaacatacttgttcaacacatccagctagggtttaaggtgtagtgtggaataggacagcagtttttttctgggatgctacttcatgcgtggagcacaaaactgagtgtgatcacttctaataagctatttgacttagcaaaagctaataatgagagaaaaagattttgttatttttattgtggctgttattcagtcactataagctatcatattattatgtagggccttaaaatttattgagaatctacagacaatggaaaagacaccaaaaatgtaagtagtta

SEQ ID NO: 254736 - DNA, 643 bp, Homo sapiens
cctcagagcggccccggagcggccgcagcgcggtggtctcggcccggctgcgccagagtccgcgcgatggagccccggccgcggcggcggcgcaggagtcgccccctggtcgccgccttcctgcgagacccgggctcgggccgcgtgtacaggcgcgggaagctgatcggcaagggcgccttcagccgctgctacaagctgacagacatgtccaccagcgccgtgttcgccctcaaggtggtgccgtgtggcggggctggggccgggtggcttcgcccgcagggaaaggtggagcgtgagattgccctgcatagccgcctgcgaccccgcaacatcgtggctttccacggacactttgctgaccgcgaccacgtgtacatggtgctggagtactgcagccgccagtctttggcccacgtgctgagggcgcggcagatcctgacggagccagaagtgcgcgactacctgcggggcctggtcagcggcctgcgctacctgcaccagcggtgcatcctgcaccgcgacctgaagctcagtaacttcttccttaacaagaacatggaggtgaagattggagacctgggactggcggccaaggtggggccagggggccgctgccacaggtgagagccggggggagggc

SEQ ID NO: 254737 - DNA, 627 bp, Homo sapiens
gtgggcctcaggagctaggcagatgggaattttgaactctaagtgtctatttctgaagtgaaactaatcaatgtgtttctacagttaacatttattgagcaactactatgtgtcacaaagttcataaatgttatctctaagcttccaaacaaacatggaatgacagcctggttacaaatgattaaaaagggactcacagagtctattaacattcccaagagtcattagttcttactgaacattagtaagccaaaggcatatttatatcaacacaagagttaatcacacagaaaagatgacagtcttaattcgaacaatcaagggtcaaaatcattatatattttgaatacgaatatggttgaatatgacaaggatttgaatacgtcaaaacacaaatcacattccctgacatgtaactgaaatgacaagaatatcaagaacttaagtacatgtttattctaacctctaacatcagtattgtgcaatgatttcattttaaactaaatgattaaaatgtacctttgttttaaaataggtatttgagtttctacagcagtgtttctccaagtgtgagccaaggaccttttatgttaaatgaatcacaggagggtgctcgttaaaagtaca

SEQ ID NO: 254738 - DNA, 573 bp, Homo sapiens
gtgggcctcaggagctaggcagatgggaattttgaactctaagtgtctatttctgaagtgaaactaatcaatgtgtttctacagttaacatttattgagcaactactatgtgtcacaaagttcataaatgttatctctaagcttccaaacaaacatggaatgacagcctggttacaaatgattaaaaagggactcacagagtctattaacattcccaagagtcattagttcttactgaacattagtaagccaaaggcatatttatatcaacacaagagttaatcacacaggaatacgaatatggttgaatatgacaaggatttgaatacgtcaaaacacaaatcacattccctgacatgtaactgaaatgacaagaatatcaagaacttaagtacatgtttattctaacctctaacatcagtattgtgcaatgatttcattttaaactaaatgattaaaatgtacctttgttttaaaataggtatttgagtttctacagcagtgtttctccaagtgtgagccaaggaccttttatgttaaatgaatcacaggagggtgctcgttaaaagtaca

SEQ ID NO: 254739 - DNA, 488 bp, Homo sapiens
gtggtggcggacgcctgtaatcccagctactcgggaggctgaggcaggagaatcgcttgaacccaggaggcggaggttgcagtgagctgagatcgcgccactgcactccagcctgggtgacagaacgagactccatctcaaaaaaaaaagaagaaaattaaccttttatctatgaaatgagttagatatttgttttccagtttgctatttatcttttggcttttatgctggctttgttcatgtagaaatctattttttgtagctaagtgtacccaacttttcttgtagagcttctcagttatgtcaggcttaaaaagatcttgcctttccaagattgtgttttacattcttctatattttttcctgtaatttgtttccttttttatagctaaatctttaatccaactggaaattattttgctgtaaggtgtaagagtcaagatccaaccttatttttgccctggcagcaagctgtccattgaattcat

SEQ ID NO: 254740 - DNA, 410 bp, Homo sapiens
ttctcaccattaggaaaattggccttcatcggaaatgaaaatattaatatattaggccaggaagcacagagcatgtctatatttaatgagccaatacctgttttcctacagttacctccctggctcaatcatggagacattctgatcagcagttctcaaaatctgtcttgcatcagaatcatctgggggggcctgttaaaacccccagcacatcagatttggtaggtttaaggtggaacctgaaaatgtgcatttctaacaagttcccaggtgatgccaatgctgctggtctaaggaccattgctgtaatattttgaaatatcagatgtatttaagtagacatttggtgattttgtcaatgacttgccacctagcttttcatttagaacccaaatgggctggtgttaagg

SEQ ID NO: 254741 - DNA, 353 bp, Homo sapiens
gagtgggggcgcaaaaaccagtaagatgagaaaatagtgtttcctcagttctagtatccaggggaaaaaaagaaaagagaaaatactgtttcctgccacttaagaggaaggactcacatatcctaccttccatcagccttgaaggagacaagtgccctctctctcacacccggtggccttcccttcccctttcccagagcctccaagaaggcccctggctggcctgatgcccaccatcagcagcaataggcaccaaaacctttctccttcctatccctccccacctcccaaaagggctggggacagcaggtgtatccttgttagttccatcatgagacagcacattcctacaa

SEQ ID NO: 254742 - DNA, 420 bp, Homo sapiens
tcaaatattcagcctgatctagttgaatctgaagatgtggacctgctgatgaagagggctgactgtatctaacttagggtcttgcatgcagctggcacttaatacattttattgactgttttagataacattcaacagataattcctaataaaaactcttaaaagtaggagaagaaggactcacatatcctaccttccatcagccttgaaggagacaagtgccctctctctcacacccggtggccttcccttcccctttcccagagcctccaagaaggcccctggctggcctgatgcccaccatcagcagcaataggcaccaaaacctttctccttcctatccctccccacctcccaaaagggctggggacagcaggtgtatccttgttagttccatcatgagacagcacattcctacaa

SEQ ID NO: 254743 - DNA, 220 bp, Homo sapiens
cagtttttatttaaaatgacccactgcctctaaaaagagagcatcaacaccggccttcacctgaagcaatccttttctccaacagaagagcaaatcaagtctgcagggttcgggggcaaagggaaaggattaagaaatccgatcaagtgtgaaaatgcgtggtgcatcgagttttggagatcaaataccagctttgcaaacaggatacggccaggtcagc

SEQ ID NO: 254744 - DNA, 295 bp, Homo sapiens
  misc_feature (46)..(46): n is a, c, g, or t
  misc_feature (61)..(61): n is a, c, g, or t
  misc_feature (88)..(88): n is a, c, g, or t
  misc_feature (157)..(157): n is a, c, g, or t
  misc_feature (281)..(281): n is a, c, g, or t
ctgtgttcactatctgggtgacgtgatcaacagaagcctaactctnagcatcatgcaatanatgcctataataaaactgcaaacatancccctaatttattatttgggtgtgtgtccctgcccaagtcacaagtcgaattgtaatccctagtgttgnaagtggggcctggtgggaggtgattggatgatggggacagagttctcatgaatgggttagcaccatcctcccttggtgctgtttagtgagtgagttctcatgagatctggttgtttaaaagccngtgtcatgcatccc

SEQ ID NO: 254745 - DNA, 588 bp, Homo sapiens
attgatctcagctgttgcacagtgcctttgcatgtaaaggtgctcaataaatatttgaattgatgagcaaatgtttagactgtttcccaggaacttataccttatttgcatgttatgcctagggtgaattttaaaatttgatctaatgagtatagtgctaaacagacaactatataacgtctattccccagacatctagaatttcagaagctggcaaacactatgtatagatgtttaggacatataaaagtagaataaagtgttaaatagtgtatggatgatgaaatacttatgaagagttaactgcattttggaggattgggatggcaagtagagtcatgcgtcacttaatgatggggatacgttctgagaaatgcaccttgggtggttttgttctgcaaacatcatagagtgtactgtacttaaacaaacctagatggtgttgcttaaccacacacctaggctgtgttgctcctaggctacaactctgtacagcatgttaactgcactgaatatcataggcagttgtaacacgtggtgtttgtgtgtctacacataggaaaggtatggtaaaaatatgatattata

SEQ ID NO: 254746 - DNA, 717 bp, Homo sapiens
aacgcatagcttctgtcaaacttacgtatcttaagactcaatatgacacccttgttaataactgaggaatcaacaatttgattccccgaaaacatgggtggtgaatgtaatgcccaacattgtttttactaaccctgtttttagactctcccttttgctctcttaatcacctagccttgtttccacatgactaaaactctcgcttagctgagaaagccggacgaactccatctggcccccttgatttgtaagacattaaggactccttacccacccccttcttcaaggagttaacttgtgtaaacagattctcaacatatcaaaagagtccaattaactgataaggtactgaaacaaacaatgtacgaagttcccaggattttgctcaaaagataacaccacaaagccttgagtctgtgtccggcatagcacccatatctaacatcttatgaaggatttagagcccccgcacctgctaccgttgcttttctgtaaacatttgtcttttaaattgtctgtttctctgtaatcatttgtccttttaatttttgcatgtttttacttctgtagaattgttgcgtttgagctcccctccccttcctaaaccaaagtataaaagaaaatcaagccccctcctcatggccgagagaattttgagcgttagcggtctctttggccaccggctaaataaaggactcttaattcatcccaaagtgt

SEQ ID NO: 254747 - DNA, 1186 bp, Homo sapiens
aaacaatgcattttatcatagggccggacagctacatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctgtaggttttctgaatacttctgagtttaggagcattttttctcaacaggcaagtcaggagctgctaagataaaccatggcagtaagctcgagccagtgttcgtatttgccattgatcggccaccaagtgcttgctatgtgccatgcattgtgctaagcactatctcatttaatatttacagcaatcttatgaggtagatgctactgttatctccattttacagatggggaaactgaggcacagagttccacagctggtaacttgaggaataggaattcaaccactggagagtctggctggagttttttgtggtaggagaaaatatgctgtctaaatttgccttgggaaaccatcatggtggtcacaaaaccacttctacggcttgccttgacctagcaggaatgaagatataaagaaagaatgagcgcgtcatggttatgatgggatgatgatgtctgttgtgttgtttggtgtcagtttctgtaacgcctttctatttcaatcaaggctattaacttttcctctgttttagtgaagtttccttgaagtagaaaatgggagtgtattgggcatctcagagttttcagctgaactgaagggtctgatggtaactttacccccaaatccctgagagaaaagcagggggtccctgcttcagctctgctcagaagagcctccctcacatggtggtttctgtgtcactagactggttaaccaaatggttcttctaaatacccaacttttaatagaaactcttgcggcttggattattaaagtcctaacatgcttatttaatc

SEQ ID NO: 254748 - DNA, 524 bp, Homo sapiens
aaacaatgcattttatcatagggccggacagctacatgcacaagatgctacctgcagagattggtttttgcccagatgtgcaggagagatgcacagagaggaagaaatgcatacatgtgtgcaggttttggcgtgtgcacaagaagcctggaaggattttctttggatctacagtcaaaatggatttccgagaggaagctgtctgaaaacacacctcttccctgtgctacatacggtcccatctctgccagccaggttgtcaggaaagtgatcagcactggcttcaactctggctagagctctttggccaatgtgatgggcagaaaactggaatgaggacagaaaagcacctcagaggtttgaagagtctagtctctcaccaccttgctgctgagacttatttgaatgcctgtttcatatggagcttttaagtgtaacagttgtgagtgaaattgccccttttcaagcgctccgagtttgcttctgcatggaaggggaagatggactagagctgatacctcctg

SEQ ID NO: 254749 - DNA, 452 bp, Homo sapiens
gctgagacttatttgaatgcctgtttcatatggagcttttaagtgtaacagttgtgagtgaaattgccccttttcaaggtaattgaattccatttttcactttccatttccctctagaaaaatcaaaacgttttcagagcttggcttcttagtgggtgattttctaaggtgggaactttagaaccataaaacattctagtgtggcaaaggcattcaggaaccggatgaccaggccccttctccgcaggtgaacagcctccaccagccggtcttggagaacatattgatttcactgtgtttttatttgaaacaccaaaggaatgcccatatcttgtccttgggccagggctgtgggttaggggagctgggtttctgtccagaatcttgtcatctgtagggcagctgaggggcattattacccagaggtccctggaaacctgtgctaaattggt

SEQ ID NO: 254750 - DNA, 460 bp, Homo sapiens
caagttctgcaaaatagccatttgtaactttgtatcactaaggttatgaatttaagttcagtccgccctccatacatgtgggttccacatccacagagtcagccaaccacaaatcaaaaatatttgaggaagaaaaaataatacaggttagtaaataatatagtataacagctatttacataacatttacattttattaggtgtcataagtaatctagaaatgatttacagtatgccagaggatgtgtgtgacttatatgcaaatactgcaccctttcctgtcagagatttgagcctcctccagttttggtattggagggtgctggcatcctggaaccaataccccttggatgcagagggacgaccatatgttcagcttcacatcagtaggaagcaagccgcagcaacgtctcgttctgagccttttctcctgttactcccactcctccccaaatctgat

SEQ ID NO: 254751 - DNA, 688 bp, Homo sapiens
ggggatgctggagtctgtcctgcagaggccgtggcgcgggcactgctgcctgatttcgaagaggctccatcaacctactctcttccaaagggctgggcagcccagccacagacaggcagcctctggatctcagaagtgagggacggagtctatcctgggtttggtccagtagaaaccccccacccccacccccagagtctgggaaccagtgctgtgcccacagatgcaaagagaaagagcatgggttaaagcgctattgggatcggttagacaccacacttttccaaggaagacattttcttcgagaggaacagcaaaaggagtcaatataatgttaaaaatattaaggcaggtgctgtgccacatgttgaagtgattccaaaagcagagaaaacatgggactcacatttaagaggattaattgtagcctttgagtttttcccagaaaaaaaaaaaaggctagcatatatattttcatatatttatatgaacaggtaattaaataaggagggattttaaaaaattgtctatttggatatcgttttcctttccatttgaggaaaagccaaatgcaaataaggagaataatatttaaagaacatgcttttaatagagcctcaattatccttctaatttaaccaagatgaaaataattgtgaaataaagcaaaataaaatcttggaagcat

SEQ ID NO: 254752 - DNA, 793 bp, Homo sapiens
tatatatatatatatatatatatatatatttataaataatatttttattttataaaatatttattataataattcctactagctgtaataggaattcccatttatgagcggttatgatcttttctagtttatctctcccctaaagatttcaacaaagagtatatttgcttgggaaattttagagttttgggttctgtataaatcacaagatttgtactgctcacaatgatggaaactaactgcattgggtcagtaatttggctcacagagttgatcatctatattctaataattaaatgtcaccaaaatatttatttaatgatttatattagaattgagaatgatacaatatcttactttagatatgaaaatttggctgggcgcagtggctcacacctgtaatcccaacactttgggaggctgagacgggaggatcccttgagcccaggagtttgtgatcagtctggacaacatagtgagaccttgtctctacaaaaaaaaaaaaaagaataaattagggaaaaaaagatgaaaattcacttttagcagtcgactgttttagaaaaggtgcctaatatatgttagagtctgtgtttaaagtgtgaaaggaaaataaaaacgtaagacccccaactcactctgccaaaagaaaaaaaattaagctgaaagctgagtcatgcagaaagctgcctttccttttgttcctaagcagatagctacagataaagggttaaatatttccacaggtagctactttatattcaccttatcttatgtaaagtgccaatttact

SEQ ID NO: 254753 - DNA, 416 bp, Homo sapiens
tgcaaaggagtttgatgcctttcttcatcctctctccgcctccccaccccgctgttgatgctaatctgaactcctgaaggagtcaccttcccccagaaaggtgtcctttgaggggaggagagaaggaaaatgtggggatggaaatgtttcttgattgcctacatctgattagtaattacacgccaagagccgctctggagagaaacactgtctccctctgatgaggaagaaatttaataaggcagttcttccaggtggaggttggggtaggaaggtgatgaggaggagaggaggtggtaacagatatacaactgggggacctgctgctagttgggctggggtacaggtaggcagattattgtatccttcaccagcattaccacttctccatttatcagcatgagtgatcttgagct

SEQ ID NO: 254754 - DNA, 410 bp, Homo sapiens
tttcccttctacctcagaggtcagcaaactgtgcccctgtggccaaatccagccagccacccgttttgtacagaaccgtgagctaagaaaggatttacatttctccatggttgaaaaaaagtcaaaacaagtataatattttgggatacgtgaaaatgatatgaaatttacatttcggtgtgcataaatgaggctctattggcacacattcggatatggatttatttattgtctatggccacagaggagtctcaactgagagagtcaagcctgaaatattcgacatctggctcattaaagaaaagatgtgctgacctccgctctaattccccccatcccttattccacaggattatttttatgttacctttatgcactttcctgtttggataatacaataatttgcccta

SEQ ID NO: 254755 - DNA, 516 bp, Homo sapiens
gaggactcgtcaagcaagtaaatgtggttagaaatcttaggactagtagtcttccttataatactaactgttttactattgttccgttgctgtgctcaatctcctcccccaggcaaggccctcttctgtccttgctggatatgaatacgctgtacattgttttgctgttatcaccccccttgaccatgttaaaataagtacccttagaaagtgtccccattgtacacacactacagggtcaggaaacagtataactaggactctattattctatacttattaggagtgtacagggactcacctaggaacttgtacttacaatcggatcacctattcaatttgtgacccaggaaatggccagccttatatatgctatgaccttctaagtctttacctaggacttggtttgaggttcatactgagtcaaagaaaggaagtcttataaatcaaagccaagcctctaccccccagggggggctatagccatatactttgatatttgtcagttaacatccg

SEQ ID NO: 254756 - DNA, 231 bp, Homo sapiens
agacctgctcgacggagaattcaatgtgtgctgctgcaactgcaggtagtgccgtggagttcggcttccagtggggtcctgtgtcaagtccatgggattttcctgccctccaggtctcccaaccccaggctggcaagtggaagcctggactgaacttggagctcctgcatcctcaaagagtgcttggccctgtagattattattcattgaataaacagatgaatttctcta

SEQ ID NO: 254757 - DNA, 477 bp, Homo sapiens
gaaagccaattttgtttgatttcatatacttttttatttttctacctttatttcgtttatttatagatcatgggtatatttttagactgggggaaaataactttctataaaaggatatgtattttcctagatacttttatcattggatataacatttaggaggagagggcaaaaaaacagaggctggaaaaaccagagagttgcaaataaacacaggaggaatgttggtgaacatactcttgcaaatgttagagccactcaaaataaaaatatccatttgaggaaaatcaaacactagtatgtattattttacacttttttaacctctttggcttatacctttatactcactcttcaagtggtaagtcatccccagactacagacactaacatctccaaataatttatcacagttcatactgtcaaaaaaataaactgcttacactgaaacaaccaccatctcaacccaaataagtg

SEQ ID NO: 254758 - DNA, 262 bp, Homo sapiens
tgtctgtgagactggaagcctgggagactctaaaatcatgctgagatcatgatgaattccccatcaatgtctgtcattcagaagtctggaaacccaaattgagaagttcccaaacaaaactgctggaccttgaagaggctacaaaagagtgagctgtggtgcctccatcactcaggaatgtgaggggctggccagctcttctggtcctagttctcctttgtgtcaccccctccttggcttataccttgccaaactaaatctt

SEQ ID NO: 254759 - DNA, 159 bp, Homo sapiens
tatatttttggtgaagtctcaacctctattcagaaacacatgaagaatatttttaaccgtggacatactaaatttgagctgtttgggagacatttgggtagtaagcgttctatagacatttgaaaatgagcctgtcttaatgtagaaagttgaatatgg

SEQ ID NO: 254760 - DNA, 439 bp, Homo sapiens
aatactctgtaccctggggctgggtatgctcagatcttgtgaggattactttataagaggaaaagaaccaggttgctgccctggtgatttggatggagctaaggatgggaagagagaggcagtattcagaccaggaattggagctggaggttgaatttcaccaccatcttcaggtgcaaaacctcaagaaatccactcagtctaaatttaaacctgcctttctagtttcagtttcctttgagtaaactaaaaggatgatgccaatcagggaggggtctggaacactgtgtggtcaaaaattacttagtctggactggatggcgtgaggggaagcctctgggcatggagtaggaggggctgtgtgctgggctggacctccatctcgatcatttcctttgtgttttctcttttcaataaaacaacatatttgatccctcta

SEQ ID NO: 254761 - DNA, 409 bp, Homo sapiens
atcttcaattataatcacattctgaggcgctggggaaaggccttcaagccatgaattttaggggtacacagctcaggccatattaccttgcatttctttttataaaataacatttatgatctcacataagaaataggtgtttcatgtagaaaactgtactatattggtaagaaaaaagtaaacaaaattactcataatcttatctaccaggaataactactattgacattttgcctactgtgtcccaaaacttcagtgcatagacatgtatagattctaaaaattgagactatacaatacgattccattttccacctttatctgccaacatttctcctgtttcattcttccttcatctgcttcctcctcatcacagatgatttattctttcctttgtcacttgtctttc

SEQ ID NO: 254762 - DNA, 233 bp, Homo sapiens
agggtctccctatgctgcccaggctagccttaaactcctggactcaaatgatcctcccatctcagcctcccaagtagtggggactacaggtatatgccactgttcccagcttgagatggtagcatttttatgtgtaaaatttaggacactaaattacaaaaagagtaacaaccatgataccagagtgataagctattctgtggcggcaggaagatctctgtagcccctgaaat

SEQ ID NO: 254763 - DNA, 485 bp, Homo sapiens
ggagttaatgaacaatcttttattctgagtattttgcactgtgcatatctggctttcaaaataggttaaatggctaaatttggcaataagatcaagtaacacaattcttcacaattatgacagtattccctaaaacataatacatattgggaatgaagcactgattttgtttttcactattccttgcatttgcataatgaaggccgggtgtggtggctcatgcctgtaatcccagcactttgggaaggccgaggtgggcggatcacctgaggtcaggagtttgagaccagcctggtcaacatggggaaaccccatctctactaaaaatacaaaaattagccgggcgtggtggcgggcgcctgtaatcccagctacttgggaggcggaggcaggagaatcacttgactgcaggctgaggttgcagtgagccaaaatagtggcattgcactccagcctgggcaacaggagcgaaactctgtctccaa

SEQ ID NO: 254764 - DNA, 479 bp, Homo sapiens
ccatgttatagtatttggtgtcattttaagtgcattttgtgcatttatttggaaattaaccactaaactgatcttactgttccctgttattaagatgtaattcaaatgccataaaaattcactcttttaaggtgtacagttcagcatttttagggcattcacagtgtttactaccatcactgctgtctagttccaaaattgttctaccctgaaggaaacttcataccgttcatatccattcttcctctgcccctaggtcccccagcaaccagtaatatgttttctgtccttatagatttgtctatgttggatatttcagataaatggaatcatatagtatatggctttcttgggtttttttgtttgtttgtttgtttttaggcagagtctcactctgttgcccaggttagtgttgcagtgagccaaaatagtggcattgcactccagcctgggcaacaggagcgaaactctgtctccaa

SEQ ID NO: 254765 - DNA, 302 bp, Homo sapiens
tcccctgtaatccactcacttctcaccattcttactgccactaccttggcctgtctgctgccatccatcatctggtatctggtaatctgcctgcacctctctcatccatcctctttgatacggtgacagtgatcttcctaaaatctaaatgagatcatgccatttcatccctaaaaccctccaatggctattggtgaaatacaaatcaaaattacaatgagataacatttcacacgcagtagagtggctataatcaaaaacacagacaacagcaagcgttggagaggatgtggataaactgg

SEQ ID NO: 254766 - DNA, 557 bp, Homo sapiens
ccactcagtaaacaggatgatcaatgcaaggattatgtttcattgatgccattgtttactcttgttaatgctatttatatgctcagcaaaaactcccacaagatcccagtgcttcacagttttttaaaatctgattgattataaatggaagaaatatggtagctcatctaccggggatggttgggacagcagaaggggagacttcccctcagtgtggaattttgaggtatgcagagattttatttcaatttcacgtccactttctgttcctctccactcctcactcccccagaattccttttacttctggtttctaggatttacatacagctttgtttttcctttctgcaaatcaaacaatctgataaatgtattaacaggaagtcttcagagaaaagagctatggacttttccaagggtatttttgttcttaaaacaacaacaaaagaaatagtaaagaagcatataaaacatacatcaagatgaaataagaattagttattgtatcatttagagaagtcaaaaattcttttaaaaattctgttttgaagaagccc

SEQ ID NO: 254767 - DNA, 298 bp, Homo sapiens
atttcagatattctcaactttaggagcatctttagtccattcagggtgctatgacaaaataccatagactgggggggttatcaacaacagagatttatatctcatagttctaaagcctgggaagtccaagatcagggtgcctgcagatttgatgtctggtcacagccacttcctcacagatgacaccttccttctgtgtctcacatagtggaagaggtgagggatctctttgggatctcttctattgggcactaatcccattcatgaggaatccatcctcatgacctaatcacctcct

SEQ ID NO: 254768 - DNA, 606 bp, Homo sapiens
cgctctcatcctaagctcccacgtctggtgtggctgggggggcgtcacaggtcccgagggagcgtcctgcctgaagtttctccctcctaacccactcgctgcactgcatatgttgccgatgttttcatttctgtggcctcgacccctaggctcccgtcccataaatctagtaccccaggtcccgggcaccggcccggctcactaactcagtggcagtatatgctttcgacatttggtcctgatgtccaggaatagcgcgaaaagtttgactttgttaggcgaagccgttttggaactgcggagggatgggaagaaatcgccgagcgtcttaagccgcaacatagtgctctgctcagccctggaaatagaggttttcagacattgaaaactttccaagtgctccgtcttggcggagaaagaactgagttggaaggctaatttagaatgaactttttgcttttgttctttgcaaaaattacataaaatgttgcaacagttcgagaccaggactataacaaaacgcatttcatggagctactttgtaccgcgcttggcgacttaccttgtcagagctgaataaaagtggttgagttcacaaaaaaaaaa

SEQ ID NO: 254769 - DNA, 293 bp, Homo sapiens
attcttacttaaaaccaggtcttgactggagcagggaagggaaggagagccccacatactctgctgcagctgaaggtctagttccttcgttcctatccacagggactgagcagggaaggaaaaagaaggtccttcctccctcccttctttctgggttctgtcttttatctgcttgaaagttgtgttctatacttttcttggagtcaggtcataatatttgcttaactaaatagcaagaacctgagatttttatgttctactcaaagagaggttattgctttcccttccctgca

SEQ ID NO: 254770 - DNA, 529 bp, Homo sapiens
tacagtacttaagataaccctgtgaaggctgagattgatatttgaaattcacaactgatcttggagcctggtacagcagtcatggatttgttcatgtgtggatgtgatggaactgaagtcgctaggttcatgctacctggaacatgagactgacaaatagaggagcactgagtcaaatgaatctcggagaaatggagctggaagaaaactggaagtttcattcttgttgcccaggctggagtgcaatggtgtgatcttggctcaccgcaaccttgacctcctaggttcaagtgattctcctgtctcagtctcctgagtagctagtattacaggcatgcaccactatgcccggctaattttgtatttttagttgagatggggtttctccatgttggtcaggctggtctcgaactcccgacctcaggtgatccacctgcttcagcctcccaaagtgctgggattacaggtgtgagcagccgtgccctgctgaaacttatttgtttgagcaataaaagccacatatttcctc

SEQ ID NO: 254771 - DNA, 526 bp, Homo sapiens
gagaatgggctgaacaaggcaaagggaacgccaagcaactagttgggaggggtactaggtggctcaggctgccaaaagaaaatagcacaggctgggtgtcttaaacaacagacatttatttctcatggttttggaggccgtgaagcataagaccaaagtaccagcaaggaatgaaagaaaagatatacgcaaagtggattctaatcatagagtttcattcttgttgcccaggctggagtgcaatggtgtgatcttggctcaccgcaaccttgacctcctaggttcaagtgattctcctgtctcagtctcctgagtagctagtattacaggcatgcaccactatgcccggctaattttgtatttttagttgagatggggtttctccatgttggtcaggctggtctcgaactcccgacctcaggtgatccacctgcttcagcctcccaaagtgctgggattacaggtgtgagcagccgtgccctgctgaaacttatttgtttgagcaataaaagccacatatttcctc

SEQ ID NO: 254772 - DNA, 488 bp, Homo sapiens
tggttcccaaaattcagggattacagatgtgagccactgtgcttggcaattttaaagtcttaaaacagtgttatattaatataaatcatggtaggatttgacatttcaaagaacttgaggataaaaacatttcttaggggaccaaaaatgatcactaatttgtaaaatgggcctagactcacccacatctcccaagtgatgtttccttcttcagagctgctctacatgtaattaagagaacagaagggccgcctgcatcaatcaaatgcacaaccttccctagcacacacagttccaatgaaaatccaaacagctattgggatgaactgaggaatgatgtttatcaggtcttcaaggtgaaaataccaccagcatttattactgagagaagaatcttttagcaaacaatagaccaataaattttacctctcaaaaaagtgtttcacttcattcttccacttttgactccaagtcataaaagacccagc

SEQ ID NO: 254773 - DNA, 296 bp, Homo sapiens
aggagtgctagccaagttcaggatgtaccatttttctatccaatgtttgacatacagagtagatgaacataaacattcacttttttcctatgaagaatctacatttaatttaacttacccatgataaactattgtattaatgattatatcttttaaggagacctcataaatttattgtatcttagaaaaatttaacatgtattaaatataatgttccagaaaaggaaaagggaaaaaaataaacacatgaatggcactgctactgctgcttagcattctaacagaccagctcactg

SEQ ID NO: 254774 - DNA, 521 bp, Homo sapiens
aactttgcatgctgaagccctcatctccagtacctcagaacatgactgtgtttggagacagagtcttaaaaatggtaattaaagttaaataaggttatataggtgggctctaatccaatctgactggtgtccttataaggagaggaaatttgaacccacaagagataccagggacatgtgcccctgagggatgaccatggggagaggcaggaagaggatggacaactgttttgctaaggaaagaggggtcaaaaggagtcaaccctattggcacctcgatcttggacttctgtcctccagaactgtgagaaaacaaacttctgttgtttaagtgacccagtctatggcattttgttacagcagccgtagcaaactaatacgtcatctgaggtgtgttttgagaccacataaatatgttaacatttcactcagtagagtctgattgctacttcaaggaaatttgtaaaaaattactaacttgaatgataaaatcttagatttggaccagccctgcgacctta

SEQ ID NO: 254775 - DNA, 440 bp, Homo sapiens
ccaaggctttgggacaaaacgccccagcccttgagcctggagggctagtccttccagaagaaagtcatgctttgtctttgctgagattcactcagggctaacaaaagcctggtttacagatgtgcagcttttctggaacaggactgcttcctagcacagtgcattcctttactgaaactgataaagcgagcctgccccattccagggctgtcaccgcccccaccccagttccagggcccttgagggatcccgggcagcgggcagcaggaccttcagaggaccagaaggctgcacttctgagcacccagcacagttgtttctactaaatgccgaaagcaagcgttaggatcaggcgctgggttctaaaatgagatttactgttgtctcttctgtggttgaagcaagcaaagagagtatttctaaacgagttcatgtcattg

SEQ ID NO: 254776 - DNA, 401 bp, Homo sapiens
cagagccctcatcaggaactgaattggccagcaccttgaccttggacttccaacctgccagaactgtgagaacataaatttctcttgtttcaactaccgagtctctggaattttgttatggcagcctgagaagacaactgagacacacaaataccaaacatggggaaatatttggaaaattaaaataatgaaaaattcaaactcttcttggcagtgaaccaaaatttagttttctggcacactttggagtcactatgtaacattggttgttataaaatagaagaaagaatcaggtaaataaagtagattgtaccttagatttgttctggaaaccaccaagcagaatacatcataacacatagtcttacattacaataaaactataatattaacaagttcta

SEQ ID NO: 254777 - DNA, 832 bp, Homo sapiens
taattctcatggcaatcctgagaggtaaatagtgtcattcccatttgagagacagacaagctgaggctccttgaagttaaaatacgtgtgcacaaaaggcagtagaacatggtggtttagagcacaggacaaagccgggcgcggtggctcatgcctgtaatcccagcactttgggaggccgaggtgggcggatcacaaggtcaggagatcgagaccatcctggctaacacggcgaaaccccgtctctactaaaaatacaaaatattagctgggcgtggtggcaggcgcctgtagtcccagctactcgggaggctgaggcaggagaatggcatgaactcaggaggcggagcttgcagtgagccgagatggagccactgcactccagcctgggcgacagagcacgacttcatctcaaaaaaaaaaaaaaaaaaagagaaaaatagagcacaggacagatcttaaccaacccgggcctgttagctccttttcactggatgatgtatgagggaattttactttgctgaggccttacttccccagtagtaaatgagagaatatcactgcttaacttcatggggctttgtgagggtttgaaaaagtgatgtatcaaaagctcctggcactgggcttggcaggtgcaaatgttgagcaatgttaactgttaacactgcccaaggccatcacaggaggaatatttgcaatctgtccgtggctctggctccaaagcctcagggacgctcactttttctgcccacaccctcactcacactcagtctcccttctccggggcctctccctgcgaaccgctacctggacccctagcctcacgggg

SEQ ID NO: 254778 - DNA, 320 bp, Homo sapiens
cactgcacagataagatcagtccacagagaccacagcgttgcagtaaagaaagagtttgatgtgaggccagccacgtgggaaaactggagttatcactcaaatcagtctccccaaaggcttggaggtcaggatttttgtggacaatttggtgggcagggagctagggaatgggtgttgctgatgggtagggggtgaaatcataggggtgtggaaaacagtcctgatgtgctgagttttcctctgggtggggccacaggaccagctgaatcatgaatccaggtggggccagtgtgaagaacgtatcaaaaaatcaatctta

SEQ ID NO: 254779 - DNA, 344 bp, Homo sapiens
tcctttgatttgcttcagctgctaataacagacatcccaggcaacaaagaccatcacagactaagccagcacatcatgaccagcagtgcctggccgaaagggtcccgaagccctaacggttttccggtctctgatgcagtgatagacatccagggcacccaccctctgcgccttggaaagcctgcagcaccgtcgctaagagcaagtggtctggcaagttgccaagcaatccgtcgtcttcctttctacttatttcctgttttggatatagttagagctcaaaatcaataaaaaagttcttgcgttccaatccccagttagacagatgggaaaacaaataaaaa

SEQ ID NO: 254780 - DNA, 4331 bp, Homo sapiens
ggcttttcttccccttctgattttcccctccccccttttctccctttccgggtttggttccccccttttcttcccctctcccccctccttcccaagcccctttcccctcccccgtcccagtcccccctgcttcccagccctcggccccggggaagccccggccgagaaaagcccgcccccagaagcgcgccgccgccggccgtcggggccgagccgcagccgagcggccgtgggcccgggcggcgggcggagacgtgggcgccctccccgccaaggcccgtgcgagaggttagacttgtttcttatatgtgatgccattccagcactggactcatggaggctgagcatttattcaggagtccatagaggccactgtattctattgaagaacatgtctaacagtaacactactcaagagaccctggaaataatgaaagaatcagaaaaaaaaactggtggaagaatctgtaaacaaaaacaagtttatatctaagactccaagtaaggaagaaattgagaaagaatgtgaagataccagtttgcgtcaggagacacagaggcggacatctaaccatggtcatgccaggaaaagagccaagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacaacaataatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagactggccagaacggatatctaaatgacatcagactctccaaagaagccttttcttctagctctcacaagagaaggcagatttttagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaagaagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactgg

SEQ ID NO: 254781 - DNA, 480 bp, Homo sapiens
agataattacaacagccaaagagagaaggaagtgaatttcccaaccagaagcgtagggaaattcagatggctttcttttctcccagcagaggaacagaaggcggagctaagggcaggaaccaggagttggtcaaggagctataggaggtgatgagagtagaaccaggggtaggagctggtctggtacccctcaccctctaattgggagcccagggagaaggactgaaaagaagatgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaa

SEQ ID NO: 254782 - DNA, 562 bp, Homo sapiens
tcctatctacctacctgcttctggggattggagaaattaatgtaagtgctttatccactgtgaaaccaatttaagtagaaggcacagatgaattaagaaacacttcctgctatgtatgatctttgtccttctcattctctgccttttctgacttgtggcctaaatcataaatgcttcctgataataataatagctgtcaattgttgaacactttctccatgccaggcattgagctaaatgcttcacaggtgttagtttattttatcttcatgataaccttgctcgctggtagtcttattgtttcagtccccacagttgaacctggactctgaatccagcatgctcttctagaaaagctcatgcacttccctttaggctgcattttaaatgaaggagctgcattcatgattttcaattttgacatttaaaaaatgatctaggtcgaacgcagtggctcacacctataatcccagtactttgggaagctgagatgggtggatcattttgaggccaggagttcaagaccagcctggcccacatggtgaaaccccatctctactaa

SEQ ID NO: 254783 - DNA, 665 bp, Homo sapiens
agccacctaaagctggggttgaagtgacacaagcatccctgtggccaccaccactgggactgtgctgggtccgacctgaagccagcacagcactgggtctcacccaagacctcttgtaaccactcactagctactgcctatgtttgcttaatgccctgggacaacaatcatcagatggaaaaactagccaggcctgtgtccttcccttcagggcagcaatgtttcccaggccccaggtgggtccagatgtgccatccaggagtcagggattacagtcaaacaaccttaggagtttatctggtgttcttttttactgttctgagctggcactcaaatgacaagacacagtcctttctactgttcccttccctttacaaaggcagaagagccttaccccatagctattgccacccctcaccatggggcgtactgccagactgctgccaatgttcccttaaatcccaaaggctcttcattcagcttttggtgaatgttgcttggtctgggactcacctttcagggtactgggttcccctctgcttcagggcaggtttcagaaatgccatccaagggtcaggtcctggaatcaggaataccatcaggctacttttgtgctctacactcctgtgaccatgctgtacctaaagccagcaagtctcagaggc

SEQ ID NO: 254784 - DNA, 909 bp, Homo sapiens
gtaattcttcccactgccctctccccaggttgtccctgatctgctttttgtccttgtagattagttgcattttctagaattttgtataagtggagtgtatctacagtatgttctcttttgtgtctgccttcttgtactcagcataattattttgagattcatccacgtctttgcatggatcagtcatctgttccattttattgctaagcagtattccactgtatagataaataacattttgtttatccgtttacttgttgatgaactttaagttgtttccagttttgagttattagagtaatgctactatgaacatttgcatatgaatccttgtatggacatgaactttcatttcttttgggagtaggatagctggatcatatggaatgtatatgtttaacttttaaataaactgccaaactgttttccaaagtggttgtaccatattacattgccaccaacaatgtatgagaattccagttgtcctatattctctccaacatttgatatcgtcggtcttttcaattttagtcatgctaacagatatatcatggtacctcattgtgttttaacttgcatttacctaatgactaatgatgctgagcatattttaatgtatttatttgccattgacatattttctttggtgaagtatcagttcaaatcttttgtccattttgagggaggttgtttgctttcttattgagtgttggacattctttatgtaatggatataagttctggacttaagttctttatcagacatatgctttggaaatgctttctccccgttcgttatttgtcatttcattctcacattagtgtcttttaaagagtggaagttttacattttgatgaaatataatttatccatttgtccttttagagattttgcttttagtatcatct

SEQ ID NO: 254785 - DNA, 501 bp, Homo sapiens
gagaaacatacagttttgattgtcacatgttaaatggaatttcactttattttagcttctagctggcagtatcttattacagaggcatgctgtaacagttagttcacaagctacttatctcaacgtgtttatttgaattctcttcaactctttcgcgatacgggtgtggggttcaggatttctaagggagtcagcgctgactatacagagaaaaatccccaagggagaaagtcaggagctgctaagaaggtcaaaaagaacacaggggaaaaaaagaaaaatgagttatgccggtgttctttaaaattgaagacagaaaaattcttggctgcactttcattctatttcaccttacaaaaacctcctgctattccactctgctcaaagtcttctttccaaagtactttgaattaaaacatgaagtaatccttactaagtgtccataggatctcttctttatccttcgctgtgtaagtggggacaaaaagagctacccagtat

SEQ ID NO: 254786 - DNA, 442 bp, Homo sapiens
gccctctccttcctgagcagcctggaaccccaggctcagggctaagccctgagcacatcggagcctcaggaagtgccactgggatgttagctgcaaaatacttctcctgtgagctgaacatctgtcttgggtggaccagagatcacgcccatttggctgtgcattcaaatgccctgctggcggcagcctccacttcctggtgatttctgctttcttttttgccaagtcacatctgtttgccatctgtaggtagctgatcacatttcaaaaagctggctggggttttatgcatatttcatccactgggagattttggagaaggaaagctctctttaagatcaaaatgagctgaagaggtgctcagctgggtcacccagacagtgaagattagaaaggccctaattccagcctgggcaacatagtgagactttgtctctactta

SEQ ID NO: 254787 - DNA, 664 bp, Homo sapiens
ttggcttgctaatatgtctttgggatgtttgcaactttgctcaaaagtgagactagtctgtcatttacttccttgcaatgcccttgtcagattttgatatcaaggttatcctagcctcttaaaataaaaatgggtaatataccctctttttctgtcttctagaagagtttgtattaagttacaatgatttcttcttaaattattgcaaaaaactcatccctaaagccttctgattttgctttcttttgggtaggttttcaatttctagttccatttctttaatagttatgagaagtcaagttcttcttttttttgcatcaactttgttatattttatttttctaaagtttccatttcatttaaattttttaaagttttacagaaatttattcatcttgtctcctttttaaaatgtatatattttaacaaaggtagcttttgaaaaaaagaagaaaagatatataatgatggtcatttcacttttataatattagttacctttgccttgttgctttttctttgatcagtctcactagaagtttattcattttattagactgtttaaagaaccaaattttagcttgttgatccactctaatgtattctttttagagaaataataaatacacatatttcacagtttagagtaaatatagtatagagt

SEQ ID NO: 254788 - DNA, 864 bp, Homo sapiens
ttctcagtccctgtggaggctaacgcaaagctctgtagaacaagccttagagtgcatgctctatggtctaatgagaaacttgtgtttgtgcttgcacacgtttcaatgttccctacaggatattttacaaaggtatgaaaataatggccaaccagaagctagtatcagtttggggcctaaatgcagcaggtgttcctgataagcagataagcagagctcttcctgcagtagcccaggtctcaccaaatgacaaatggctaatcaagacactcctgcaagcccttgatggtgagagctgcagagctgtttcttcagctgccatcaaggcaggacctcaggacctgactgtctacagtcagggaatagtgaacaatatgggatatgggtataggtaggtggtagacaaggatcgtgccccatggctgatgggccgggtgtctcaggcaggccccctgtgcacagaaagagcctaagtgcagagaagccaggcatctttcccctgtcatctgtggaaggggaatgtgatggccacagacaccctcatggcacagacatggccagcctctgacgttcctctgcatcagagtagttctgtcctcgaagccccagtcagcagagctggatgaccagatcgcaagaagcaaaccagaaagtgtgatggcagagatgtcagatcccgtttaataaacacttcagtaaaaaaataatcgatcgcaaaccaaaaagggggggcccgccaaaaaaattttcccctcgaaggggccacaaatctttaggcctttccccaagtttcgtggcacaaaggggggccctaaaggggagggcgtttaataacccaaggacacgggccgtctttttacaacc

SEQ ID NO: 254789 - DNA, 382 bp, Homo sapiens
ctttaattttttagagtaatgtttattgaagcataatttacatgtagtgaaagtaaaagtttaacaaatgtctataattggatagtctccaccacagtcaagacatagaaaaggacgtttccgttactctaaaaagttcactcatgccctgtcatgagtcagtcctctacctctacactcccagcccctgaaaaccgttaatttaattgatgctcttaaagttttatctcgtctggcatatataaatggaattatacattatgtagcctttcgtgttcccttgcacttagcgtaatgcttgatatttattaagttgttacatgtgtcagtattttgttcagtgatgtgctgggaaatgtcttaacaacatactcttcagaaa

SEQ ID NO: 254790 - DNA, 453 bp, Homo sapiens
ctccatgtctatattttataagtctaaaggaaaagaaatatatttctccctaacaatttcaacaaaaattccatagttgtgcttctctagccctgattggctgacttgggacatgtgaccatcctggctgcaactctgtgatgtatcctgtttaggcaggtccagatcacatcatcctcctccagctaggaataggtctagggtagggatattgtttcaaggaatattagagcattggtagcagatggtggagtaatgcatgctgttgaggccaaaacaaatgtgtactacattcaaaacattttaaatataatttctatactttcatacattctttaaagttttgggctcacaataatgatgtttccagtcaaagaaactaacattgttcatggctgttttgattcattatttttctttaggtggcactcttagtaaagactgtattaaaaa

SEQ ID NO: 254791 - DNA, 5169 bp, Homo sapiens
ggggctggtgcccactgatcttcaccacacccagtcagtcccagatgctgcaccagctcctgcagcagcacggagctgagctccctacacacccctccaagaagaggaagcactctgaatccccccccagcaccctcaatgcccagatgctgaatggaatgatcaaacaggagcctgggaccgtgacagccctgcctctgcaccccactcgagccccatcgccaccctggcctccccagggtccgctctccccgggccctggttccttgcctctcagcattgcccgtgtccagacaccgccttggcacccgccaggtgccccctccccaggcctcctgcaggacagtgacagcctcagtggctcctacctggaccccaactaccagtccatcaagtggcagcctcatcagcagaacaagtgggcgaccctgtacgatgctaactacaaggagctgcccatgctcacctaccgcgtggatgcggacaagggcttcaacttttcggtgggcgacgacgcctttgtgtgccagaagaagaaccacttccaggtgacagtgtacatcggcatgctgggcgagcccaagtacgtcaagacgcccgagggcctcaagcccctcgactgcttctatctgaagctgcacggagtgaagctggaggccctgaaccagtccattaacatcgagcagtcccagtcagaccggagcaagcggcccttcaacccggtcacggtcaatctgccccctgagcaggtcacgaaggtgactgtggggcggctgcacttcagcgagaccaccgctaacaacatgcgtaagaagggcaagcccaacccggaccagaggtacttcatgctggtggtggccctccaggctcatgcacagaaccagaactacacgctggccgcccagatctcagagcgcatcattgtgcgggcctccaacccaggccagttcgagagcgacagcgatgtgttgtggcagcgggcacaggtgcccgacaccgtcttccaccacggccgcgtgggcatcaacacagaccggccggatgaggcgctggttgtgcacgggaatgtcaaggtcatgggctcgcttatgcacccctccgacctgcgcgccaaggaacacgtgcaggaggtggacaccaccgagcaattgaagaggatctcgcgcatgcggctggtgcactacagatacaagcccgagttcgccgccagcgcgggcatcgaggccaccgcgccagagacaggtgtcatcgctcaggaggtgaaggagatcttgcctgaggctgtgaaagacaccggagacatggtctttgccaatgggaaaaccatagagaacttcctggtggtgaacaaggagcgcatcttcatggagaacgtaggggccgtgaaggagctgtgcaagctgacagacaacctggagacgcgcattgatgagctggagcgctggagccacaagctggccaagctgcggcggctcgacagcctcaagtccaccggcagctcgggcgccttcagccatgcagggagccagttcagtcgggcgggcagcgtcccccacaagaagaggccccccaaggtggccagcaagtcatcgtccgtggttccggaccaggcctgcatcagccagcgcttcctgcagggaaccatcattgccctggtggtggtcatggccttcagcgtggtgtccatgtccacactgtacgtgctgagcctgcgcacagaggaggacctggtagacactgatggctcttttgccgtgtccacttcctgtctcctggccctgctccggccccagccccctggggggagtgaggccttgtgcccatggtccagccagagctttgggaccacgcagctccgacagtcccccttgaccacggggctaccaggcatacagccctctttgctgctggtgaccaccagcctcaccagctcggccccaggttctgctgtccgcaccttggacatgtgttccagccacccctgccctgtcatctgctgttcctcacccactaccaaccctaccactggtcctagtcttggccccagctttaaccctggccatgttctcagcccaagtcccagccccagcaccaaccgctcaggccccagccagatggcccttctgccagtcaccaacatcagagccaagtcctggggtctttcagtcaatggcattggccactccaagcatcacaagagtctggagcctctggccagccctgcagtccccttccctggggggcagggcaaagccaagaacagtcccagccttggtttccatggccgggcccgccgaggggccctccagtccagcgtgggccctgctgagcccacctgggcccagggccagtcagcctctctccttgcagagccagtgccctccctgacctccatccaggtgctggagaattcgatgtccatcacctcccagtactgtgctccaggggatgcctgcaggcctgggaacttcacctaccacatccctgtcagtagtggcaccccactgcacctcagcctgactctgcagatgaactcctcctcccccgtgtctgtggtgctgtgcagcctgaggtcaaaggaggaaccatgtgaggaggggagccttccacagagtctccacacccaccaggacacccagggcacctctcaccggtggccaataaccatcctgtccttccgtgaattcacctaccacttccgggtggcactgctgggtcaggccaactgcagttcagaggctctcgcccagccagccacagactaccacttccacttctaccgcctgtgtgactgagctgccctcctgaggcagcaccacaccagggaccaggggtgcccaggcaccccccaacactggatgcaatggtgttacactggagcccgctgcaggccagctctgctgttcactggccctacccgagactggtgaaactggaagtcttcacactggagttgctgttccagctggtcgcccctcacggcacagagggaacctgagagccagagacttcttgggccttcctgcctgccaccccctaggggccaggacaggaccagtttacctctttccagatatggtggttggagggctggttcaggtgccctggagggaaggggaagcctgtggccctgatttgttcagagcccattctcccttgcctccccttttgagactggagccaacccttttggagagaggacctgcccacctttgagatcagcagggggctcggatccagccctaagagacttgggtggacccccatgagtcaatggagggcagacggctctcccccttaaagctgttccctgggggatggcttggtagtggactttctggggtttgcctgttacgccagactcggacttctaagctttaagtgtggcccaggaggtttcttctccctgggagggcttggctcccaagaagtcccagggcagccgaggccagccctgcctgggttggagaaactgactttgtgccttaagtctactcagtgcctggtgaagccaccctcagcccttcacaggcctgaaccagtaggggccagtgggccaggtaagccctagagccttgaaccaggaatatccaggaagaggaaattccctttgagcccccagatggtattgcagcttcactgcctgcgttcctgggagcgtctggagctcacagtgatcagtgaccacatcattctctctgagcagaggagcaggaatccctcaagcagcagcctggtcttggctggtgggcagatgcaaatagcttttgctgttattaatgaagtaattactaaatgcacttaaaccagggcaggaaggaatggaaggatggagctagaaagctcagagtgggccagagcaggggtgtgacacttgcaaagacagggctctgactctgatccctcccagggagcctccgacacccatcccactcccaaccaccaagaccctgggttagggaagaagttgtatcttaagtgccaccttcaagtttcttagtggtgcctggtgcattccgaggctacatccaggctcatggaaggagtgtagtattcatttagccatgtctgccatgggtccagaaatgggaaagggaattgctgtccttgccctgtggtatgctgccacctctttgggaagcaggccttgcccctgtcccaccactcattctcagctttgaatgggaggcctttctatagtggaggcctttccttgaagcctatgaactgcaggcccccttttgccattgatctcaaagcacttgtcctcaggatagggaagagcagggggatgcaggaatagcagggatagcttgctcccagccccctccccaatttggttccgttgacataggaattttacgattcccaaaccatgcaggggctgagccttccttatgatgactttgttctccctcccactgggggaatcctccctatgccttaaaactgccgagccccactccatgtaataggattcctgggcttcctcaatgggggttcatgttcttggactgcgggccctcagtccttaactggaaagtgaccgtccactgccccatggagcccatctggacacagcacagccccaaaaccgttagcagctggctctgtttccaagcctggggaggggttcctcagtgcaggagttggggacaggctggggatccaagctgcttgagggggtcaaccttggaccaaagttgccttaagcctgtggtaaaagggcttcagggaaggtaagtgggccacctgctggaagctgccagctgcccggctggcaatggtgtgagtgtcttggccctgtccctgccctggggtccagcaggtcatccctcccttcttctctctcctttggcgtttgttcctgtagtcactgggctaatctccccctagcttcaagctgtacatagggcctcccagtgcaaatcctcctgcccataccgtgcacccttagaagcctgcgtgtgcatagagcgccccctacttcccagttaactcccagttcttctccctgagcttggtatttgtcatgtgccaactctgactctgaggtgggcagtgagggaagcagccccgggcctgcttgcttcctgtccccgaaatgttcgtttcttctgaagtaaatatacatatataaataaatgtataaatactgctttgtatctg

SEQ ID NO: 254792 - DNA, 250 bp, Homo sapiens
ttgatttttgataagggtgcgaagaccattcagtgggacaaagaatagcctcttcaacaaatggctctggggcaacttgatatccacatgccaaaaatgaaattggacccttaccccacaccatatataaaaattaactcaaaatggatcaaagagctacactacccaactcttagaagaaaacatagggataaatctttattatcttagatttggcaataattttttatctatgacaccaaaagcacaa

SEQ ID NO: 254793 - DNA, 275 bp, Homo sapiens
ccatctggggaataaacctgtccttgtatcatgccctggctgttgttaaatccctgtctgttacctagaattcaagctctcaaccttgttttgtgaagctactactactaaggatcatttttgctcattcttgtagaatgtcctggtgtcatgttgagccatttacacccatttttatcatttactcctcccaggggctattacccccatcttaacagatgttaaatttgtggaagatcatgtaactagtaaatgtttgtgtcaggtctgattag

SEQ ID NO: 254794 - DNA, 785 bp, Homo sapiens
aattagtaggaatatccagtgaaagggaaattaatgaattttataagtatactaatcaagaagtatattcttttcctttgaggtagaatgtaatatagcacctcccctacccaaggcctgggttaagagtatattaactgcttatttctcccctatgcgtggagaggcttatctgtgttccatcgtttcacattccttgaggcacagcgagttcttgcttccctccctagcgctgctgtaaagtcacaaaactgattagcaagtgttacaaaagcatgtattcccaaggacgtaagacatatggtgtaacaaatgtaagagtaatttactgcctttgttcttgcttctgcaagtacacttcatgcaacacgtaactcccaacacaaactgcttaaaaggtgattgatccctttgttcggggctcagactttctggaccctagtccgactgagccggtgatcaccttaataataaaggctctcctgaactctgctcggtctctcccgtctatgatttgtcccgcaacaccagttgcctgcggaacacctctacctagagagctaacactcatccccggtcagtaaatccaaaactaaacccgttgcctcctcctaccaacctgtccctcctataatgcctgtgaagaaaaggcatcactgtgcacactgttgccctctccatgcttcatctaatcagtcatcagatcctataattctaccaccttaaaagtttcaccgtttcttccgtccagtcgcggtggctcacgcctgtaatccctgcacttt

SEQ ID NO: 254795 - DNA, 798 bp, Homo sapiens
agcatgaatagaccgtcagggagcaccagatgtttgaggaatggaatatttgggccattgaaggattttaagccaaatgacctgacagtccaactttaaaagaagacaactttattttttcaaagaacaattttagattgatagagaagttgtacaaagagttatcatatgccccacattcactttcacctattactaacattattatggcgtatttactattaatgagccaatattgatacgttattattaactaaagttcatacttgattcagtatttccttagtttttcccagtgtccttctctgttctacggtcccatccaggacaccacattatacctagtcatcatatctctctagactcctcttggctgtgacatttctgacttaactacatcagtgtagagtgagaaataaaaattaaaaagaaaaaccctcaaacatttctgccttacattttaatgatgctaattctggttgcaggattcagaagattctgatggtggcaaagtgaaagcagtgagacggattaggaagccactgcagtaatccaaggcagagataatgatagggctggatcagaatgatggtggtaaaagtgaaaagtgttccatttggggatgttataaaagccattagcctggatggggaaactaaaggaatgagtgtagatggagaagaaaagagttccagggatggagcccttggggcacctgaatgtttaaaagttagtgagataagaaactagcaaaggagacccaacaggaagtggccagttacgtaggaagaaaagctg

SEQ ID NO: 254796 - DNA, 344 bp, Homo sapiens
ctgaaaactttttttttttaaatgatactctgttttaaccaaagtgtgtggaatatgctacataatatactcaaggcaggaaaaaaagtcctcacaatagtagcatttgtacagaacacatgaaaggcttcagtaacattctctataggtaatgaggcatttgaagctggaaatagtgatattttcaaatatctaataatgttagtttaaatgagaggaatgcactatcaaatccatattatcagtgaatttattgtgattttacatataaatgcaatcaagttacatgaaaatgccttgctagaatttaagtttaattaacttacaatcaagatgccattcca

SEQ ID NO: 254797 - DNA, 431 bp, Homo sapiens
ggctagatgtcctaagggataaacctgcttggaataattctgttcctgtttacatgtccattgttaactaaccatttatttgcatgcccccatatcttctggaaatcatgactgtctattgggaaatgataataccagctaatttctttttcacaattaattgaaattttacactcttacatttcaatatccatcaatatttttacatactgacacttttaatcaaggattatctttcacaggggagctgtaacagggccctaattaattaaagtgataattactcctctccctcgcagtttgttagttacataacacattctccaggaaattcacatccttagaattcctctttaaatttctctcatttataaggagataccttggcttctatctctgtaagaatttactgaaaactcaaataaatttat

SEQ ID NO: 254798 - DNA, 300 bp, Homo sapiens
tcagggagtctcagccaggacctagttcccctacaatgtgctatttaagagcatgggctttgaagacacacagcactgagttccagtcctgcctcctctgcctcccaagacaaattactcagcttgtctggcagagcttgagaactgtcacagtgcctgcctcatattcctggacccagtgtctgacacatggtaggttaagtccactcagctctgtccagtgccagtgaagacaggtcagcaacaacacgtctccatccagcactggccacagactcctttacagactgatgtccaggc

SEQ ID NO: 254799 - DNA, 964 bp, Homo sapiens
ggccacatcttaagctgagccacagggaagatcaaagactgtgggagggcagatgtcacttcttaagcctatccagtgctgtaggcttcccctacaggagtccgtgtccacctacttgtgtgttatgctgggatggaagaaaagcacaccaaattcagagaacctaggtgagtttggaaggaaagatagaacccgtcacagcggtgagccagtgtcagtgagagcttggaagcaggatctcgttcaccaggttaccatcaatgaaccaggaaacctgtcctggatgtcacatctaggaggagctgagaggccaggcccacatttagaatagcagatcctagatttcaccaagaaggcactgaaatgaagccaatttatgcctcccataaaaagcctgtctctgtgctaacaacctcatctctccttgtctactcctgggcttttactctaaaatgatctcttttcttttgcattgatgatctctaactcctcgtatctcctgttctctaaccaaaattaggtcaaagattctgccctcctaattaaactctccctcagatatgtacctgcctcaagttcccttgcttttggtaccaacctctcccttttctcaagaccattcttcttgaaattcccactttggtttccttacattcctttggcttctttagtaacctcacaatttgtttttttcctcaaatctcctgaaactggtctctctagtgatcactagttaccttcttaattaataattagttatcttcctaatcaatacatcctgtggctttcaccttctctttcctcattcctccatgcctctccatttcacacctagtgagatcataagacttgcacttcttgtgcacaacagcaggaaaaggacataggaggcaggtgtgctgatcctcctgtgttaggtaggagacatagagtcttccttggcacttgagaagctccgaccaaa

SEQ ID NO: 254800 - DNA, 419 bp, Homo sapiens
ttctctcaccttgccctgacagttttcatttgctgtttagaagaaacacaaattctcccttaggaatcaggtaagtatatgaaagagatgaaggaactggttgagctcacagattctttatcttttctatttttttctcttttctgtttctgttttctataagccagggtttttcttccccctgaactcttcctttctcttcccttctttggggaataacttcaggtactctgtaagcacctcctttctttttactgttttcctgagtatattttcttgagagtgagactggatttctgcagaattttccttgagatgctcctagccccatgtcctaagatggttgatttttcttgggttaaacaccaattagggtaccaaaaactcagggcagtggggcagggggagaatttttttac

SEQ ID NO: 254801 - DNA, 479 bp, Homo sapiens
gcgaaacccatggtgggggggaggcgcccaaaccacagtgctaatgatattacaattagctctgggtcatgttcaggacatttagttgatttatggtgcctgtgcctaagttgggacagtcccttctgagcagacatcctggtatgagaggaaattcttaactacatttccatctgctagttacaccatagggagggtacaggtgcggtcccaccggcgctgtctctctcccaagaacctccttctctatctacctagccagcctctaattgcctcctctctcactgtttctttaggtaaaaacatcctaagactataaagggggtaatacatctggctatcatcagggcacttgattaactttattctaattgtgttcaatagacaatgtttgattttctcattgcctcttttcagaggcattcttccactcgcattcacgtgcataataaacttaattacggtgctgcaaaaaacaa

SEQ ID NO: 254802 - DNA, 417 bp, Homo sapiens
agttccatatctgatttgagaccccgtgttctattttgagttcttctagaagtaggatgtaaaacaatcgttcaagtatgaagagtgtaagtaataccaataggagaaagaaaaactgacacaggaatggaagggaggcaatttacgatgcattatttagccagtatttacaatggacaactggcaataaaataggtaaatagataccttagaactatcccaccgaaagtgccagatagttacaaaatgtactcatgaactccaaagagtcgctgattgagagctgctcttaggagtgctaattcttttgcactttaggcttcctagcctgtcagaatggccactctgcagactacaatgctttatgagaaaactcttttaggagaaaaaataatgcataaccacatcttgaagaac

SEQ ID NO: 254803 - DNA, 492 bp, Homo sapiens
cgtcttatttaaaacatttattctttaaccatcatgctcacaattttctgtaaatacatattacttttataaagatgagggaaaaaaataaacattttcagtgtgtcagtagtgtaagtatgtttcagttatctaagcatccaaggagagtaaaacagctaaatttagcaactcattgtacttttatgatacaatatgcagccattaaaaagtcatgttttggccaggcacggtggctcacgcctgtaatcccagcactttgggaggctgacgtgagcagatcacctgaggtcaggagtttgagatcagcctgaccaatatggtgaaacccagtctctactaaaaatacaaaaattagcctggctgtggtggtgtgtgcctgaggcaggagaatctcttgaacccaggaggcatacgttgcagtgagcagagatcacaccactgcactccatcctgggtgacagagggagactttatctcaaaaaaaaaaaa

SEQ ID NO: 254804 - DNA, 166 bp, Homo sapiens
cgtttccagaaagagaaaatagaaagaatgggagaggaggcaatatttgaatactgcctagctgagaatttttcagaactgaagaaatatcagtagggtttactctaggattataggaataatataactttataaaatttaatgtaacttaccatattgacatatt

SEQ ID NO: 254805 - DNA, 299 bp, Homo sapiens
gccaggctgacctcaaactcctgacctcaagtgatccacacaccctggcctcccaaagtgctgggattacaggcgtgagccaccgcgccaggtcagctgcttaacctattaaaaggcacaatcacatctcgttagggatgaagggaagaggggaccagtttgagatacaaaaaacagacctctcagaaatataaaaaggagcattactacagatcttatggaaaaagtataagggatatactaggaacaactatataccaacagattagcataatttagatgaaatagaccaattccta

SEQ ID NO: 254806 - DNA, 306 bp, Homo sapiens
gttaaatcttcactccactgataattagtgatgtcgagcactctttcatttgcttatttattgaccattcctgtatcttcttttgtatagtatatgttcaagtcttttgctctttttattatgcggatgggatgtctgtttttttattatggagctacaggaattctttgtatagtctggatataagccctttcagataaacatgttgcaaatattttcttttagtctgtaaattctgtatttattttagcagtgtcttttgttgaacataaatttttaattttaatgaagtccatttagtcaatt

SEQ ID NO: 254807 - DNA, 486 bp, Homo sapiens
atgaaattcacattcagacactaaggttactcagtgatggctctggctgtctgggagactcatcagtgatttttttttgatacagggtctcacactgtcacccaggctgaggtgcagtggtgcgaccacggctcattgcagcctcaacctccagggctcaagcaatccttccacctcagcctcctgagtagctgggactataggtacacgccaccacacccagctagtttttaaattttttgtagaaacaaggtcttgctatgttgccagagctggtcttgaactcctgggctcaagaagtcctcccgcctcagcctcccaaagtactgagattgcagacatgagccactgtgcctaccctccctttcagttgagtttctcagagtgtctgcagactgagcttctccctttgatacccagtgtcctgctttggacagtcaggagttggctggaaaaaaaaatctttctggttttcaaaatcctttt

SEQ ID NO: 254808 - DNA, 414 bp, Homo sapiens
gtgctccctcgggtttgaggcactgtcgtcagattcccagagagatccgtgtgatagccgtggcccaagaaaggttaacagttacagacttagaactaaaagaagtcaggtacactgaaagccttagaatgccaacgattggccaagcgtggtggctcatgcctggaatcccctgtgttttgggagaccgaggcaggcggatcacctgagtttgggagtttgagaccagcctgaccaacatggagaaaccccgtctgtataaaattagccaggcatggaggcacacgcctgtaatcccagctactcaggaggctgaggcaagagaatcgctttaacccagcgggggcggaggttgtggtgagccgagatcgtgccactggactccagcctggccgacagagcgagactgtctca

SEQ ID NO: 254809 - DNA, 405 bp, Homo sapiens
gaggtgcttttgatgactggcacagggtaaaggtgaccggcatcaggtccaggtggaggaggatctggtctattacagtctgcctctgctaaccaggagactaaccaaagaggcagcaaagaggcagacctgtgtggcattttcgtgtggccaaaagaaatatggttagttaagtacacatcaaaggcagagatcctggcttaacaatccctgctctagggtgtaaacttgaagaagaccattccaaaggtggtatacagactgtactccagaggattataaatccatggctctgatcttctggctccctgaggagtctcatgaaaggaaatgaaggaaactaacaatattctaggtctccagttatttctataagcaatttttcaaacaaaatgggcaccaaac

SEQ ID NO: 254810 - DNA, 232 bp, Homo sapiens
caaaaactggaaataaacccgagtcctgacaataagaaaatcgccaagcttattgggatctgttaacacaatgaagaattaaagaatgattttaaatggctagaatgtgaactatattgatagatatagaatccttccccgtgaaataagcagaacccaaagtagtatgggttcgctgattacaactatataagaaattcatgggtattaaataacagaagagaggtccttt

SEQ ID NO: 254811 - DNA, 3280 bp, Homo sapiens
  misc_feature (3228)..(3228): n is a, c, g, or t
  misc_feature (3263)..(3263): n is a, c, g, or t
  misc_feature (3265)..(3265): n is a, c, g, or t
  misc_feature (3271)..(3277): n is a, c, g, or t
ctgaagttctccaagggcgaccatctctacgtcttggacacatctggcggtgagtggtggtacgcacacaacaccaccgaaatgggctacatcccctcctcctatgtgcagcccttgaactaccggaactcaacactgagtgacagcggtatgattgataatcttccagacagcccagacgaggtagccaaggagctggagctgctcgggggatggacagatgacaaaaaagtaccaggcagaatgtacagtaataaccctttctggaatggggtccagaccaatccatttctgaatgggaacgtgcccgtcatgcccagcctggatgagctgaatcccaaaagtactgtggatttgctcctttttgacgcaggtacatcctccttcaccgaatccagctcagccaccacgaatagcactggcaacatcttcgatgagcttccagtcacaaacggactccacgcagagccgccggtcaggcgggacaaccccttcttcagaagcaagcgctcctacagtctctcggaactctccgtcctccaagccaagtccgatgctcccacatcgtcgagtttcttcaccggcttgaaatcacctgcccccgagcaatttcagagccgggaggattttcgaactgcctggctaaaccacaggaagctggcccggtcttgccacgacctggacttgcttggccaaagccctggttggggccagacccaagccgtggagacaaacatcgtgtgcaagctggatagctccgggggtgctgtccagcttcctgacaccagcatcagcatccacgtgcccgagggccacgtcgcccctggggagacccagcagatctccatgaaagccctgctggaccccccgctggagctcaacagtgacaggtcctgcagcatcagccctgtgctggaggtcaagctgagcaacctggaggtgaaaacctctatcatcttggagatgaaagtgtcagccgagataaaaaatgacctttttagcaaaagcacagtgggcctccagtgcctgaggagcgactcgaaggaagggccatatgtctccgtcccgctcaactgcagctgtggggacacggtccaggcacagctgcacaacctggagccctgtatgtacgtggctgtcgtggcccatggcccaagcatcctctacccttccaccgtgtgggacttcatcaataaaaaagtcacagtgggtctctacgggcctaaacacatccacccatccttcaagacggtagtgaccatttttgggcatgactgtgccccaaagacgctcctggtcagcgaggtcacacgccaggcacccaaccccatcaccaagcgctggaagcacctcactgggactctgatcttggtgaactccctggacgttctgagagcagccgccttcagccctgcggaccaggacgacttcgtgatttgaatgggtcccctcccctcctgctgctctggagtgcaagccctcttctgccctgcgtgccctgctgtcaccgcggagctgaagagggaggaaggggcggctgctcagacagatttaggcccgccagctaggctacacccatcatgcgccgccctcctccatcgagggagaggcctgaagggactgcctactgcagctcgttgccaatcacatagctttctatttgttaagtataaatttaaatttaaaatcacttttttaacgaatggggggaagggatctatgagaaaggtggtatctaatttttttatggaccataaaggtttaaaagaaaataggggcacaggctgttgaggtttttatgttgttatagacctttttaaattatgttagagatgtatataggtatttaaaggtcactgggagcgtttctgattcccggccacactttgcatttcaacactcagcccggaaagatgctcgttcggttgttggacctctttcactccctgcgtgtaagaaggtgaatcacgtgggaaaaagtggcttttcagtaaacgggtacagctcattctttctgagaaggccccaggtcctgctccctcctcggatttgattgtcttccgtgctttgcctcactcgtagtaaatgaccatccatagaatatgtgaatctttggtgagcttcagtgggcagagtgaagtcccgcattagcatttaggtgccctgagctgtttctgccaatagattagaaagcagccatgagttgacagtctttagggcccctgccagtgtgcaattagtcattgacaagaacaatgccatttgagagtgaggtggtccctgctgctacgaggccattgtactgttttttccttgaggtcaaagcagtgcttcccatagagtttgctgcctcttctgtggacaggaagaaaacttcatgaccgaatcagagccttggtggccactgactctcgtgcttattgcagatgctgtggttggcctcacaagcaacgccttatgctgatgtgcagaggtgccagctgccatttgccaaactctgcatttcatttcatctaaggcttaacccctcttccttcctggtgtacctgtgtctcctcggaaggaagtcatagtttagatgaaaccattttttgtacaatgtaaagatcatctgagcaagatgagcattttgtaaaaatgaaaatgtgactcacataaaatcaggaacttgacacagtgttgcattaataactttagggtgcagacatgctgtgtgaatctcacaatgcgtcgtagatgtcgcgtgttggaagggagcaggaggaaggactgatactggcaaatcagtagagtgaggtgatccttagcaacgtgccaggacacttcctgtgtgcctgcagttgtcagggaccatttgggatcccgaatctcattctctaaaactgctttcttgaaacatgttacttccttagtataatcaatgtatactcccttactggcctgaaacgttgtatagctacttattcagatactgaagaccaacggactgaaaaaaagaacaaacattagctattttatgctgcaagaaccaggacacacaattcgccaatcatcccaccatataaccttcgattgtgcttctcaactccaccccataatttctcccagagaccatctatcaccttttccccaaagaagaaacaaaaccagttgcaccttaaaccatggatattttttcctcaggggctttaaatagtttcctatgcaacgtgtcttgtagcacaaatnaaattctacaaaagttgcagtaaattttatttggntnttttannnnnnnaaa

SEQ ID NO: 254812 - DNA, 288 bp, Homo sapiens
ttaagtaggcaggaatttgcatttgttctatcagtcttctcaacattcattattcatctgtagttgtcagtgaaatactataggtctttttagagaagatgtaaacttccatttaaaagtatttctgagtgttttattaataatatgagttttttctttccttatttctatcattaactgattattcttgttaaatgagattattattattttatgtaaaaaattaatgtgaatatacatatgtaatatttgatcactctattaaaatcttttattagtctgagaaaa

SEQ ID NO: 254813 - DNA, 410 bp, Homo sapiens
ctgtatctttatattcctaaaaatggtacttttggcataattaagaaatttttcttcatattatcacaatcatgcccttccattgaattattaattacaattaattactaaaaagcttggtatgtaaaattattctccacaatattaccatgcaagttatctctgaaatttaaaatgttaaagaaaaacatttctatattgaaatatatataatttataatgaaaattatagtagtttgtagtatttcattgaattttagagagatatttcatatatatgtactgtattttggatgtgtaaagcttctatgtattgaaatatttttttacgttttatttattgtacaaagtgtatataattactgttttcttttttgtcagtgtaaagcagtcattagaattgattatac

SEQ ID NO: 254814 - DNA, 245 bp, Homo sapiens
actttggattgatatctaagagtggaattactgaaacaaaagttgtggatatttatgttttgccagttgttctaaagagttggttaatttgcagggctgaggattcctcatctcagatgacataaggttcttgttatactctctaagtgccctgagtttctctctcacatatggtggctgtaatcagtgggcattacaggtgcctttgagatggtgtgacccttccagggacatctgtatcccac

SEQ ID NO: 254815 - DNA, 353 bp, Homo sapiens
cacctgttctgtggtaattaatctcatactcaaccatggagttgtttctagatcttggtgtgttgtcctccctcccctttgcctaaaatcaataacctgagcacacctaaaggtgtcttcaggcctcgatgtgccctgtgaattgtgcggggttctagggtctctgtacgtaaggagatggtctgcatttgcctggcccctcttgcaggaagagcagcagcggttgcctcgcctccggtcctcagcttggtccttagcagggtgagcagggccagagtcatgggcatgtgacctgtgcactccctcatggccccacgcttgctttcacattttcctactggcatcaatacttt

SEQ ID NO: 254816 - DNA, 554 bp, Homo sapiens
  misc_feature (3)..(4): n is a, c, g, or t
  misc_feature (7)..(8): n is a, c, g, or t
  misc_feature (13)..(13): n is a, c, g, or t
  misc_feature (47)..(47): n is a, c, g, or t
  misc_feature (58)..(58): n is a, c, g, or t
  misc_feature (124)..(124): n is a, c, g, or t
tgnnccnntgcgncgtcctcaagttatattagaatcgtgtcctcccngctttggccancttactattctaggacttgattccttcattcagtcacaatttattgagcaccgactttgcatcaanctcttgctgaagataacagtgctgacaatatacagccctgccctcagagcttatatagtagaggagaaaaagtgaacccataatatacagtcagtagcgagtatttactaagtactttctatttgcgaggccctgataaaagtactgtcctggccaggcgcggtggctcacgcctgtaattccagcactttgggaggtcgaggtgggcagatcacctaaggtcaggagttcgagatcagcctggctaacatggggaaaccccgtctctactaaaaatggaaaaattagctgggcatggtggcgggcgcctgtaatcccagctactcgggaggctgagacaggagaatgacttgaacccaggagttgcagtggccaagataagatagcgccattgtactccagcctgggtaacacagcgagactgtgtctc

SEQ ID NO: 254817 - DNA, 673 bp, Homo sapiens
tatgactttagtactttactatggtggacaatgaggcaattgatatttttatgtatataacttttttctttcacatattgttggaaatttgatattattaaatttttaatacatttgttaccatctctctccttttcaactgttacttcttttcttttctttttttttttttcttatggctccagctcaaaggaccattacttttcttagagtcacttctaaatgcaagtgatttagtgtgaagctgcttcctggtgaaacaccatctcccatgatgacctgtggtgctaaatagacagatggtgcttcagcaaatttcccatgcaggctcatctgagatgtgcttttgccaggtgcaatagaatttggagtgaaggtcttctgaagtctcagttcttgcaacaacctttctctcttatatctagcttctctccttaggcagcttcatagaatgaaaatgtaaccctcccttgggagagagagaacaggaaggggcttgtccttagacaacaaccgtctgtcacctggaaaggagctctgacctagagaagcgtggtgtgacatgcaagttgaagtccctccaggaagcatgttgtggcctatggttctgcacactctggtgtgttagtctgacccacctgctatggcaagataccatagattggtggcttat

SEQ ID NO: 254818 - DNA, 6503 bp, Homo sapiens
attactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactttatagaactaagttgtaggagctaagaggatcttttaattcatgctatgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggggaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctgatggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtgattgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatct

SEQ ID NO: 254819 - DNA, 9203 bp, Homo sapiens
attactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactttatagaactaagttgtaggagctaagaggatcttttaattcatgctatgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggggaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctgatggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatttaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtgattgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagcttctagtaccctctgttctactttttacttctatgagatcaacattttttagcttccacacagggactctgacttcaagagagaagaaaagtacttttgtacttacatgcctactgagcccagattccaaaggccttggggttctatgtttccttaacactgaatgggctttccaagtgcattgatcatggtggctgccacggtgcaagactcacctcctgccagctttccagccccagcaggaaaaagcttattcctagataacaaaatcctatggaagaccagatggtaccatcctgggtcacatcccatgcaggaacaaatcacagggtaacagatactctggccaggcctgggtcatgaacagcatccaataatggaaagagtcaagttggtttcataaaaaaccacatggagtggaattcctgccagaagaaaggattctctgaccaacagaagggggcaacagtgcttggcaggccaaagtaacagacgtccactatacttactttctaaatttgcttgttcattgatataagtttgaacaaggccaatgacagcttctgtcacaaaactaggaaactttatcagtgtgatttcagtttattagaatagtacttgtgatctatcatataaccaaatgtctctatattgtccacaagaaattcataagaaactatgtttaatattttttattttcccgttccattaatccaataacctctattttaaaaaaattgagttgagtttgtcatttctaaggggattcatgctaatacttataggtcataagtttcttaaactattcaggccaaggtatatccaaatttatatcatcatttattggtaataatcacctggggtttatactcagctggtaggccctggcagaaccctatcagttaaaatattgaaaatagctactgtccaaaccttgcaggtgttccaggcttccatccactgaggttagaagcatctctaggcttcctgacagggatcctccaggatgctagtgcagcgctagacctgcagccattctgattgggcaatgcttatgccacactcattattaaatattttgcatatcactcctagctctaattatgtgctgaaatattctttttaacctgaaccagtcagattcaggctgaaatacagcatttatttcaggttttcttctaggagttctctcacacttactgtgttagaattttactgacaattttctcacatgtagagagaatcccatgtaagataatgagagtagccagcagtaatagacatgagctgcttggagatgctagaaaatacgtttgtggagaaggttcatatgcatagaagctttccaaaatctgaaacgcattcttcttggaatgcttaacctggcaagtgagcagagctttgcacagtgttgggatatgacacttctcagtatgtcagttatgagactgcattctccagagtactgtttgactgtttctctgtgactgacttgtacatgttcgtttgtacaagcatctggtctcgagatgttccctggcacgttttgaatcattccctatttcagagaggggagttacaacatggaatttgtagctaaaaatatatagtccatcttcagacttaaagagccagttggttaaaatcattttcattcctatccccatgtcttaagctgctaaatggttgggaaataagtgattgaaagatagcaacagtttcttccacctgttttttaaaaattgtcctttggtggtcactagagtgtcttaaacacataaaacatttctcttatttaaaatagcaaacagttctctctctctcactcgctctcttactctccaccccaccctgccttttaccctttcttttcttgttttctatgtgtctctcgttgctatatgttgaatttcagttttaaaattaaagccatcttttatgaagagattttcccaaatgaaaatagtttttgaggtatcgtaagaaatggaacgtatttctttgctcatagaaaatatagattccatcccaaatggaatattggatcaaattaataatcccccttcaattcccacttagtatccagaagggttcagtgcaggtgtctgcttagatacagtacatatttagtcttggctgcttccttttgaggataaacagctcttgggaaatacacattgttaaataatcagttacagaggactaattgtttcaaggcactccctttgcagttgctttccaacagccaacagtaataagaaatgtcactttgtttccattggagactagcacatgaactattcatgaagagcggaaaagcagtcttcccagaaaaccctggaataaacatgtagaagccaagggaggctgggactctatcattgatttgtcccagagccatgtcaaattcagtgaaaaaaaaatcactacatttgttttctagagtgagaattcagagagactaatgaatgcctcatgcacctttcaaaacatccccaaaggtttctataacttcacaaataaatatatagaagctgagacaaggaggtgtacttaaattttcttaatcaggttatgcctctctgccccgtgttcagtagcatctgggctggtgaaacacctctgtgtttttgagcaacaagctaactccatttcacaatgagtgacagtgtctgacattgcctgctcattagcctgttgattgaccaggcatagttctttagatagactgcaggattttcacttttgtttcatctggattctctaaataaaagtgtcaaggtctgatctgccagtaaacatcttccacaaatatagttttagtaatgaggggcttgaacagactataccttttcatacctggctccctccttccaaacaggtgcctccatttcttctgctctaattcgtgctatcttttaatcttttaggtttttttcctgtgatttttccattttctgagcattctatgatcacatttattgcatcttaaacaatgtgttaataacatgcttttcctgggctctgtgagcctttactttgcctgcaaaaagatctagcacactccaatacttgaaagagcaaacctacaagatttaaactaaacaagatgcgtacgtcctctttaagagagtttgggagagcaaagcaaatgacatttgggactcgtttttacctggtcattcagattctttgtcttcatgttaactgataattttttccaggatctaaaactttattcttctctctcatattactcaaatgttggggtggggagaatacattttttaaaaaaaaactttatatgaatattttacaccaacattttgtaacgttcagccatcagatttagtagaaggtgcatgcagttaagtgtcaagcaacctctattttaccaagcaacgtgagttatccgcttttcagaggtgctgattttgcctctaaattttgtcctaaggattgtgtaaaaatatatgtgtataaataaaatctgtaaactatgc

SEQ ID NO: 254820 - DNA, 497 bp, Homo sapiens
ctgtgcctggccttgactagatttaatagttgttacagtctgctatatttgtgacattttttctgaagcattttaaagtaaaatacatagattatgatatttcaccccaatctacttcaatatgtatcctaaaaatatgctggggccagaatttaaaccaaagcctgacactaagtctatattaaagcttgcctaacaccagtatcttttcactactggattttgtcattgagccaggaaagaaaaagatataaaggagaaaagtaaacagggaccgaaagcaagatttgtgtggtctcctgtaagtttacctctcccccgacccctttttaaaaatgttttaccttttgtgaactataattgaattttggaaaagaaaatacactactacagttttaaaagtcaaatcccaatttaagaaaagaaataataccctactttgctttttcatgttttctttcagggagcctttcattttcccacggtgaacaaaggaa

SEQ ID NO: 254821 - DNA, 326 bp, Homo sapiens
aagagaaaaaactctgcttgtctgcaattctttagcctgcagggcactgatattttctgaccgacatggtttggtgggaactagcctcaagctctttcagggttctgcagggtggccccagctccttcttttgtgtctgtggcatttactttaggttttggggatcccttccccttccccaatttgtgctttacaacttctctaactctgctttgcagagatgtgtttaaatctcttatttgctggtggtgactacctctaatttccttcatcgttctaggtcttattcctttttaatcatcattttaatagatttgtgtaagacc

SEQ ID NO: 254822 - DNA, 611 bp, Homo sapiens
tgacaggtaccctgcaggggagagggtggggccctgagctggactccacccaacactgccacctccccagcctgtgtcctccctaccacccgaggagctgaaggacccaacagcacaccctcagtggtttctgaaaggaagcaaagttctttctaccctttttcactttgggtgaaaacatgtggctgggttgacaagtcggttttttagaaaggaagcactgactagcgaaggactcgcccagccagaagagggctctgcaaagacagccccatccccaggatgggaatgctggattcagacaccacaaaccaagagaacccagactctggacgtggagcagtaccagggtgaaagacttttcccaccgacatggtcacatagccattctccttgaagtactgggggatggtggagaagtttccagcgtgcaccctccagtaggagttgaagtcgtacaggcgggtggtgtcaggtctcctgccagtgaggaaagaaacgcggctcggggcgcacactgcttgctgttagggagcagaagcagaggggggacatctgctgcttcccaaatgccacatttcttcaaataaaaagcagaagacagcatgcag

SEQ ID NO: 254823 - DNA, 443 bp, Homo sapiens
ggcctacaacccctggatggacatcaggcaacgggaagacgtccaagccttaaacatcagtgtgccgtatggtccaattcctgtggactttcagcggaaaatccgccagagctactttgcctctgtgtcatatttggatacacaggtcggccgcctcttgagtgctttggacgatcttcagctggccaacagcaccatcattgcatttacctcggatcatggggggacatctgctgcttcccaaatgccacatttcttcaaataaaaagcagaagacagcatgcagtacataaggaactcatgtcttggtaaagacaaaattgaaattcttttaataattagtctcatgtcatagaaaagaggactgattttcctcacccacccagcaaggttgctcttcttgctatacttgtttggcataaactactgacttcttgcgagca

SEQ ID NO: 254824 - DNA, 768 bp, Homo sapiens
tgacaggtaccctgcaggggagagggtggggccctgagctggactccacccaacactgccacctccccagcctgtgtcctccctaccacccgaggagctgaaggacccaacagcacaccctcagtggtttctgaaaggaagcaaagttctttctaccctttttcactttgggtgaaaacatgtggctgggttgacaagtcggttttttagaaaggaagcactgactagcgaaggactcgcccagccagaagagggctctgcaaagacagccccatccccaggatgggaatgctggattcagacaccacaaaccaagagaacccagactctggacgtggagcagtaccagggtgaaagacttttcccaccgacatggtcacatagccattctccttgaagtactgggggatggtggagaagtttccagcgtgcaccctccagtaggagttgaagtcgtacaggcgggtggtgtcaggtctcctgccagtgaggaaagaaacgcggctcggggcgcacactgcttgctgttagggagcagaagcagaggggggacatctgctgcttcccaaatgccacatttcttcaaataaaaagcagaagacagcatgcagtacataaggaactcatgtcttggtaaagacaaaattgaaattcttttaataattagtctcatgtcatagaaaagaggactgattttcctcacccacccagcaaggttgctcttcttgctatacttgtttggcataaactactgacttcttgcgagca

SEQ ID NO: 254825 - DNA, 415 bp, Homo sapiens
tggtgggttttagccagctcctttactgcaatctgttttatcagcaaggtctttatgacctgtattttgtgccgacctcctatctcatcctgtgacgtagaagaccttaacggtctgggaatgcagcccagtagatttcagcgttgttttacccagctcctatttaagatggagttgctctggttcacacacctctggcagttttggcaattcaggtcaattaagacatcatgataaactcttacaaaaatggccatgctgttgctataaactcagcacattttttattttccagagatcattattagctgcagttcaatctgagtgtcttgtaagcagtgaggtagaacaaaatcaaggagtcttaaatcagcatttcgcatacttcaatataccaggcagataaaagtccaaa

SEQ ID NO: 254826 - DNA, 141 bp, Homo sapiens
cagagtaataaaatagaacatgatccagaaacagcctatatattatactgtcacatatacaaaattacaataccttttccaccggaatggctaaaataaaaaagagagacaatatcaagcatcattgaggatggccaaaac

SEQ ID NO: 254827 - DNA, 675 bp, Homo sapiens
caacagataactatgttttcaatagtacagggcatgctagtgcagctacaactagatagctatgacctggtatggggaagtctgaaatcagagtgacttcttccatttggcaaatatcagttaaaatatctactgtgtgcatgtacactcctgggtattagggttacaagataaatgagctggacacggtacctgaaattctattgatgagaccaaaaaaacccaagcaaagtgagtaaaaaatatttatttaaggaaaagtactatgaagaaaatagggtgattttatatagtgtaattgcactgaggggcaactttagccagtagatcggagaaagtatcctatgcagtgctgtcgaattgagatcttggtggaaagtcattggagaggtttcaataacgaagtgacttgatgttgttttcatataaaaatgtgaatcaggctactgtgtgggaaatggctagagagggaaatagtgaaagaaaggcaagctaccaggctatagcattccattcgtacaaagaaaataaatccagtgagaaggaagtcagctgttcttatgggcctaataagcaatggccagccaagtctaatacgcacaccctcgggagtggacagcgtgagcatttaggtacaaactggtgggcccattgtggctacagatgagaacatga

SEQ ID NO: 254828 - DNA, 391 bp, Homo sapiens
ccggaacctactagtaactttcaccaggataaaagtgactctgcttttctaacctacatttccgaacagtgctttataaatcacctctcggggttagtttatcaagcgcaaaaaaaagtttaccttgtctcttccggaagaaggaacctgacaaaacccctcccggtagtattgcccacaatcagagccagccagcgcaggcttgcaccgcgcagcaaagggggagcccagcatcaagtccacgcggaaagcatctgaatcccggctgctggctttactggcggagcacagaggaaaaccccaagctcctgcctacagccccggcctgtctggctccctcctccacgtccccactccacgccacgttctgtgcctggcagtccacgcgccc

SEQ ID NO: 254829 - DNA, 417 bp, Homo sapiens
ggtaggagatagatgaataaactacttctttgtttgaatttatagattccttctgaaaaaaattcctagttctaatgcattgcttatttcccattttttacatcttaatttgctgatattttattagctgatcatacagatcatcaggaatgtttcctagttcaggaaaattataatgctatctcaattatttttgccccattaaccatttgctcagttaattttacaagtatcaatagtgcatttcttgactgtgattatcactctgaccttctctttaattgaccagagggcaaaacagagtcagagagattgtgcaaacgtactttgtctttaagtgtttacagcttaattattaactttgcaacattcctaaagataaataaaaattttaaaaaatggatcacttggttgtca

SEQ ID NO: 254830 - DNA, 664 bp, Homo sapiens
gtctacactagtaggtacctgaagtttttgggtcctggggcatcactgtaaagtcttcttgtcagtcttttcctggcgtgccaccccagctggacagcttgggttagtggagtcacaagggagcccgatctgagtattattttgtacaaattggagacacctgttagatccttgatctgttttatcttttagatcaggtatctttagtaactaattgcgtaaggtttgttttgttttgttatttaccataatgtgatgatctatgaccatatttagttagagaccaccctaggtttttgggaatctaggttctttttttttttttttttttgtcattaatagttcatctttctgaatctaagtgtggaaaataccctttgcgtttggctttaactcctgaggtgaacactgaggctgggacttgtggagtaggatgtctgggatcagggtcatttgtaaagttcacatgtttgtgttgtctttttagtagctgtgtctttaggttgttattattttttaataacctcaaatttttattttttatttttttgtgaccctggcagtaggccactgctacccttttaggtagctatactgctgcctctaatagctgtaatgtttttaatattattaacctccttatagtctgcagtcaggaggcctc

SEQ ID NO: 254831 - DNA, 420 bp, Homo sapiens
gaagaatgaaagctccatgttatgtttgaagttttacgagttgactgctttgtaagaaaaaaaaaaaaatcctagatctatgagaatattcccgtgaatgccagggatttgcatataccagtttgatgatttcagaaattaaagtctactctatgaaaatgtttttcatttgaaaattttccctagaatgatttaaattaaaaataatgaggaaaaacttgtgaatctctacagatatatccacggagactagtttgaggatacactggcatagctatcagagaacctgggcttcaatattggcccttccacttactagctttttttcactaaggcaagttgcttagccattggtaaacctcaatatcctcatatgaaaaataggttaaatgagaatgaagtaatgtgtgtaaagtaaaa

SEQ ID NO: 254832 - DNA, 267 bp, Homo sapiens
tgagcacaagctgcagaccacccacacgtcagaggtgcctggggcacccaccagcatgccctgatccttggggaatttgcattctttgcacgtgctccaggtcgttctgatgcacctggagatttgtgcaaggcaggaatgtgggctgcagcccattccctagctgtaggggtgttctacattcaactcagctggcttaaactcaactcagtgaagaggactcactgtcgtataactgataagtcccaaggggagtggggttaaggg

SEQ ID NO: 254833 - DNA, 403 bp, Homo sapiens
agatactacctggttcttttgtttaattataattgaaaacaccaagttttactttattttgtgaaatcaagtaaatacatggcctttaaatataagataaaaaacaaaataaaaactcttctgaataagcatttcaggtataaaaattgtgatgaggtcacatatgtaaagaattaaacaattcctttttcactccttggcatttaggtgaattgctaacaaacacccagactcccttatttacagctgttctagaaacacttaacattttattgggccccacgctggctatttccctctcagcaaacatgcactgggtctgagaataaatcagtcgttcttaaacttccttgagtcatgaatccctacgaggctctacgataactctaggctctctctccag

SEQ ID NO: 254834 - DNA, 497 bp, Homo sapiens
aaactccactccctgttttagagttaaacaatagagggaaaaagatagagtaattactgtaaagtattgtaggtcaccatccaaggtatctcaacaaactgatcttgccacattattttccctatacacagtttatctcctaatatttatcatcattggtttgtaagtttaagagaatactattatgggcctagcccccttcaaagagataagtagatacacgtgacaatacttgaaaccctttaaaggaaatgtaataaataattttgagatgttatttttagcaggtaccctagtaacaaatattatacttaatccattttcattttgtggctgagtacatttctaaattgcttcaatatgagtcaacattataattttcagtgcagctgagaaaaaataaaacgttttggatcagacttccttcatgagcaaatgcattaattggaataacaaaggttgtttgctttgctgtataaacattatggatctgacag

SEQ ID NO: 254835 - DNA, 400 bp, Homo sapiens
gtaaatattacctgaacagaacttcttaaaataccctttacaactaaatacctagtaatcattaaacaaggcaagaaatataaggtttggggttgtcgggggaagagcaagcaaacattgttttacaacaggtttctggaaactataaactcaaatagcagattactaattattgggaaggagatgggatcttggttctaagaatctctgtaacaacttggatatagatgtaatagagcctaactaaattatttcttgcaaagacagaggtgtaatattctcaacaaagtcctgtagagtacacccagtcagctgacagtcatctgtggtaaagtcattcatgggggctttcagcagaacggagggagaaagtccaacatattcagcatgctctctaaag

SEQ ID NO: 254836 - DNA, 178 bp, Homo sapiens
tgccatggttttgccatgttgcccaggctggtctggaactcctgacctcaagtgatctacccacctcggtgtcccaaagtgccaggattacaggtgtgcaccaccacacctggcctccagtgtctattgtccccacctctgtgtccatggtacccaatgcttagttcccccttataag

SEQ ID NO: 254837 - DNA, 474 bp, Homo sapiens
ctgtctcagaggtctcatggcagaatgaaggaatttaccaaagccaagccctttgactctgggcctatctatttctttgatcagttgaaacctgaacggaaagatgggaaaagataacctgtgaagaaagttatcccacccaaaatgcacctcaagagctaagtgttggatctttcaacatccttactcaaaatgggaaattctgaagtggaagacagtccccagtatagctgtgaagagactacaagtagccataattcaaatcaaaatagaagaagcaaagcaaaaaaaagagggcgtcaacaaacaacttatccggcgccgctatgaggacctggaaggcgtggaggagagcagggatcagcagtgctcacagagtttctggctggagctgctggagaagaagcctcagatgccaattgtcaaaaaggctgaccccaacatgaaaaaattccattacgctctggtggatgg

SEQ ID NO: 254838 - DNA, 433 bp, Homo sapiens
ctgtctcagaggtctcatggcagaatgaaggaatttaccaaagccaagccctttgactctgggcctatctatttctttgatcagttgaaacctgaacggaaagatgggaaaagataacctgtgaagaaagttatcccacccaaaatgcacctcaagagctaagtgttggatctttcaacatccttactcaaaatgggaaattctgaagtggaagacagtccccagtatagctgtgaagagactacaagtagccataattcaaatgtaggaagccctccatagtctttataatcatagacttttataaagcatatggtttgatgggcaagaagaaacgcagagcatgtggccccccagacaagtcaccttatcacgatacctgcctattgtatctgtaatatgaaaacatatatacacagctgcacacacaaaa

SEQ ID NO: 254839 - DNA, 419 bp, Homo sapiens
  misc_feature (38)..(38): n is a, c, g, or t
  misc_feature (46)..(46): n is a, c, g, or t
  misc_feature (55)..(55): n is a, c, g, or t
  misc_feature (59)..(59): n is a, c, g, or t
  misc_feature (63)..(63): n is a, c, g, or t
  misc_feature (65)..(65): n is a, c, g, or t
  misc_feature (84)..(84): n is a, c, g, or t
  misc_feature (89)..(89): n is a, c, g, or t
cccaaaatgcacctcaagagctaagaaaaggggtgtgnggcccctntttttgggnggtnaagnanccttggaaaaatttggggngggcntctgggccaggatttacacagttggatctttcaacatccttactcaaaatgggaaattctgaagtggaagacagtccccagtatagctgtgaagagactacaagtagccataattcaaatcaaaatagaagaagcaaagcaaaaaaaagagggcgtcaacaaacaacttatccggcgccgctatgaggacctggaaggcgtggaggagagcagggatcagcagtgctcacagagtttctggctggagctgctggagaagaagcctcagatgccaattgtcaaaaaggctgaccccaacatgaaaaaattccattacgctctggtggatgg

SEQ ID NO: 254840 - DNA, 355 bp, Homo sapiens
acacagctgctttcacactgcaatagcagagctgaatagctgggacagagaccatgtggtctgtaaagcatgaaatatttatcatcactggtaatcaagaaaataaactacagacagagtatcctaatccaaaaatctgaactccaaattactccaaaatcctaaattttttgagcatttgcatgacactcaaggggaatgcttactgacagcatttcagattttggaattttgaatgagggatgctcaaccagtaagtataatgcaaatattccaaaattttaaaaaaagaaaaaaaccaaaaaccaaaatcctgaaatctaaaacactgtggtccccaagtatttaagataag

SEQ ID NO: 254841 - DNA, 258 bp, Homo sapiens
gaccagctgtgggccagtcggacattctgccagcagagtaagggacaggtaaaactatatgctaggcaggaaaagccaacatttaatatgctccagatgaaacttcagaagaactttttgctttggcctaaaaaacctggtcgagttacagcctaccagacatgtgccttaggagaggtgacaaggcacttgccctctttgagctatacatactttttataataagcggaaataaaaataactatttctcaccactaa

SEQ ID NO: 254842 - DNA, 410 bp, Homo sapiens
gatcttggttcactgcaacctccgcttcccgggttcaagcgattctcctgcctcagcctcccaagtagctgggattacaagtgcgcaccatcacgcctggctaatttattgtatttttagtagagatggggtctcatcatgttggccaggctggtctcggacacctgacctcaagtgatccacctgctttggcctcccagagtgttgggattacaggcgtgagccatggagcccggcccaaacttccatttttaagcagttcacgaatcccgcctacttcctgcagatcacccggtccttcgttctcataaccccaagaagcagggaggggcacatgcacctgagggccttgcttctgctggctctgggtcttacgaaggaagagtggatcttcctaagcattcaggtag

SEQ ID NO: 254843 - DNA, 274 bp, Homo sapiens
tgtgcagccgcatgtgctgcagcggtaacttgcattatcagaccttgattttgtaaggatgagttgaaaatggaaaaatgaaatgactaatggtagttgtaagggtaggtcttctaaagttgatagaattggaagatttttaaattcaatgaatgtgccagaagtaagaaatctttagtgtcagttgaatactcattgacttaagtcaacagccctgctcagttgtgaagagaaaaaaacacacatagccaaagaataatgtctaaaatgccca

SEQ ID NO: 254844 - DNA, 327 bp, Homo sapiens
gctgtgagtatatgtgactcataaactgctgctgatctcatctgtccagtgcctggcgtcccatgttcagctatccccataactctagggcaagggatccctccctcacgaataagacaaacaaaaggaaattaaaacaagcaacttctgaggtctgctaaaccaagttcaagtgagctgtccacttagcgtctgtttaggccactgcaaggctgctttctccctaccctgcaagtctgggttccagacacaggattcagcaagccctggctggctctccagcaggcgctcttgagaatgttaagggctcagcaggcacaccgtgtt

SEQ ID NO: 254845 - DNA, 432 bp, Homo sapiens
cagcttctaaggctctttacatctctaggaaatgtgaattttgtgcacactagccactgttttctgcttacttcaagaaacaagtctaaagatttaggatcttatctctgatgttcttagcaacacaaatagcaatcttaaagaaggtaaaacattatttggccatcagaaattatcatagaattaagagtggatgaggacagcaaaagaaacaaatagagtaaaaagggcaacttacagaatgggagaaaatatttgcaaactatgcatccaacaaaggtctaatatccagaatctataagggactcaaattaacaagcaaaaaacaaacagcctccattaaaaagtgggcaaaagacacaaacagttttcaaaagaaaacatacagtgaacaagcatatgaaagatgcttaaaatcactgatcattagag

SEQ ID NO: 254846 - DNA, 428 bp, Homo sapiens
taggcagattatttaaaacgtaaagaaaaccttttacaatcttttaccaagaagagatcaatactacaagaaatctttgtcattttaacagagagaagaccaatttttagttttgcattagtgtatggtattttgatgttgagtcatttcagacccttataataagttcattcaatggtagtcaacttgaccacacaagattctctcttcccaattttctatatcaattttttgtccttcattctccttttacattctgaaaaatttaaataatctccaagctagaaaaaaattcttttttcaacaaacacacattttcatactccataccttttcttaccaaaaatacaccctacttttcttatacacaaagttgttttccctattatctctagtaattttaattgcatatactaattagaattttt

SEQ ID NO: 254847 - DNA, 106 bp, Homo sapiens
agagcagagctctgtgttggaggagatttgcagggtgagaatccagccagcaaactacctcatcccagcttgtgcttactcctcaatgcatcattttccactgatg

SEQ ID NO: 254848 - DNA, 724 bp, Homo sapiens
gaagatgggaacaatagttactggggactactagagggggaaagggagagaaggactggaaagctgcctattgggtactataatcactatctgggtgttgagataattcgtactcctaaccttggcatcatcctatatacccatgtaagtaacctgcccgcctacccccgaatctaaaacaaaagttgaaattattttaaaagacttgaataaaaggatgagagagtgatatcattaattgcgtgtatagatgagataattgatactcaggataatttgcccaatatcacacagcaaaagctaaacactaagtctttctgattatattttcataatatagtacattattattattcaaataagtaatgcattgttataatttatgtagaattgtgtattggttttatgtgacaatttttttcatgaagacaacctagtaaacataaaactaaatatgatttaattgtatgtaagcattttcatgtaaaaagttctacaattcagaaaataaatctgtccaatcatgtatttttatttgatttggaaaataatatgactggggggcagggccaagatggccgactagaatcagtgtcagtcagagtcttccattgaaaagaaccaaaacagtgtgcgaatccttcactggcaacccagatatccaggttctgtcatcaggactgagtaggaggctggggtgacccacggagaggaaggaagagca

SEQ ID NO: 254849 - DNA, 466 bp, Homo sapiens
tactcaatcatacaacatgcaaataatgtcataactttccaacggtcataactttttttttcttttcctattgcactggctaaaacctttaggacaatggtagtggcatcaatggcattcttgtcttatttacaatttccaaggaaatcttacaacggtttactattaaagatggtatttgatgtagattttttggtagctctccttcatcacattgagaaaattcccttctattcattttttaaaaaatcataaataggtactgattttaacaaacgcttttctgcaattattgaggtaaagaattttcttttgtagtctgttaatgtggaaatttatattgattctaagttttatagttttccagttttatgcagaaactctcaatcttaatgtttaaaaatctatttgcacatagtaaacttcgatattttaaagtctatcttatttcagtatccaaagaccc

SEQ ID NO: 254850 - DNA, 517 bp, Homo sapiens
agtcatgtcaatagattcagaaaaatgattaatacccatttataatttaaattaaaataattcttaataaacaaatagtgcaagagaacatttttaacttcataaatggaaatttcccaatatctccacaaatataatattgatagataaaaattttaaagcattacctttagatcctggaatcagataaggatattgttatcactatctctagtcaacattgtgctaagagttctatccagggttataaacataaaagttctaagaattgaaaattgaaggaataaactgtcattccactcagacatatgataacctacttacaagaaaatattcataaatacaatcatatatgtgattaagctttgcactacaattgcttaatatgaaaacaatattcaaaaacaatgatggctaaggtgtggagatgcagttctgttacgttctgttacggcaccgtgagcccactactgcccaaccctctcactaactacagctaaaaatcatggacaaaata

SEQ ID NO: 254851 - DNA, 571 bp, Homo sapiens
aaaccagcctcctgtttgtgcaggctgggcggctgtctgtgcaaattgattgctaagtgctcattttcccactgtgggtttctgaaattgcaaatatggaggtaggatggcagtgtgtgggtgaatgaggagtgaactggtgtgtgctgcatatgacaagtgcctcccatgtgtctgcttttgaatgtgccatcctggagctaatgacacttctcaattaaattgcaattttgctctcagtagctttgccctattgtccaggccacttgacctgtcaggcaaagaggagacggtgtgtgggaaaagaaaattccctccctgctcacagagagagaagcctgttcgcattctgagggtctctcaacttctcagagctggaatggcctatctcaagacatcatcagatgcaaataaaacaaagcctctcagctctggctgcacagtattctctatctgcactgtgagtcaccgtgctcatagtaatggcttgccttgtgagccgctatcaagcgtgtgcgtgtttttctttctgagagatgacagttcccaagtgaaaggacacttcagctct

SEQ ID NO: 254852 - DNA, 1150 bp, Homo sapiens
aggaaaatacatcagggatcggacatcacatcggagcagaagcaactgctgctgtggctgctgagggagaaggagacagcagcactagcatcagagcgaaatgacagatttcccaatagccgatgttggctgcacaaatgcatatgaagggcggagatatgaaactttacctctagctccaggggctggaaacagcttgtcaggaagaatagagagggactgctcctagagctttgttcgacagtttccaggacagccaggagaggacacaggaatgaccagacccaaagggcatagcccacaggtaagtgacccccctacttgccactttacgaatgactgtgcttcttataaaaacaggcaatgaaataaggccgttacacttgatgttccttaggtgagtataccaaacaaattggggacggacttctcttggggcctgttagagcccaggggaagtgccccaccccagagcaggccactcacactctgggggaggacagcgatggccaagggcaagggggaaaccagggccaaatcccaagtacagatggagacaggccaaaaagataaaacaggtacagggacagaagtccagggcttctaaatatgccctggacacattaccctctaaatatgctgggagatactggtatcccaataggctgtagatgagccctggaaaagagagggttctcatcaggccccagaaggatcctgcttgaccagctactcaatacctaacatggctggctttatcagaagacagccaagcaagttcccttctgcttgacggagaaggcctttgttgacagagccagagtggcctgggccagtgggaaggcataccctcctggactcctgagaatgggagttggcacagggatgagttagctgtaaacgcttctgttggcgattcagctaactagctccagtggtggcagcccaggggcctgtggccctaaaaacagaactgagactccaatgctgtggtcgtgcccttcggctggggggtgcgggcgcctctgcaaaaccagtggtgctgggcaatcccacacttggtgcagggctgcctgctggagggcctgctcctcctctacccagactaaccccagagcccagatcttttctccctgatcctgacgcccaa

SEQ ID NO: 254853 - DNA, 386 bp, Homo sapiens
catggaagtgcccccgagcgcagcctctagatcacactcccggtcgggctccatgaggcccggacaaaggctgccatgctttcgtctggtcatgcctgaaagaaagaaaacacatttgacttcttgacagagaactcgcacttgagtatatgaatcaagtttaatgcagcagggctttcccatgctctggaagaatctttccgaaatactctgttctcttcagcctgttcctccgccattcctatcctttttttaaaaaacgtagctcttgtctgacttgattgattttacaacccactgataggtcttgaccacccacgctttgagaaaccccaaccttacagccgggcgcggcggctcatgcctgtattcccaccattttggga

SEQ ID NO: 254854 - DNA, 363 bp, Homo sapiens
ctgtacagcagtcatgacgctggcatctgcttggcttctggggagccctcgggaaacttacaatcatggcagaaggtgaaggagaagcagtgtccattctccagtatggttttgggggagtatggcttcctacctactgtggaccacctgtcaactctgggctgtaacatgagagaattgtgaacttctgtcttgtttgagccatggtttcattctctttttcagccatgtagcctgtgctgtaactcagtgccacattagcaactagtgaaagtcaatgtgggtaaatttgtcattcttcaggttagaacatttcttccttttattcttgtgtttttggctaaataaactgggaaattatag

SEQ ID NO: 254855 - DNA, 264 bp, Homo sapiens
aaaatagccaaagcgaaaaaagaagaaaaagaacagaggaactctggtagatatcaaccataaaagtggagtaatgggaaagcagatcatagggaaagtgggcaggacctgccctggttacaagcagagacccccaagttgatactgtttgctcttctcttgagcactgctattctcatctgctttagtggcagctactatggatggaataatggctcccagcaaaggattatgtagctgctcttgtcaagaatggcttacaaa

SEQ ID NO: 254856 - DNA, 449 bp, Homo sapiens
gattctttctgtaccattactgaatatgtgtttccaatgattgatctgaattttcaagattaatgacagcagtgcccattagctctcttccttcaatctacatcattagactggctgggtacacactagaatttatgttttgctacaaacaactgttcaaggaacaaattaatatattttcttacattagatactaggtagtagaatcactgttttctgataaaagtcaggagctgtcatcatgtaaattgttaatctaacatcccgtgatttattcctttgttcctggcttaccttactaacctctggtccttcatctacataccaaattacactttacaggaaggctactaagatttatgtacaaacaagtcttagtatctacaaacatgggcaactaaaaaaaaaatccagaaaggttaacttgttaaatgtatattaaaaaaaaa

SEQ ID NO: 254857 - DNA, 509 bp, Homo sapiens
agcccctactcccagctcagtgaaaagccctaggtctcagcttctttccagggatgaaaggatggaagagctggattatgtatccaatgtttcaatttttctggatgctgcccaaagaattggcttctgtcttacctgtctcggagtactatgagatgcatcatgctctagatgcctgggggctgctagaaacaaaaatggtggtttggattagtgtgagtgtttgagaccacccctggcctccagaatctcttcctggattgattaagggatttctccggtatgagaccagtatgtgaagactgggagagttggctattttttctaatgcatagttaaaaagagtcaaggacaataaagaagtaggaaaatatgttgcaaacaaaggaacaaaataaagctccagaaacggaccctaatgaaacaggtaaagaacttacctgacagagaatcccataaaaatgctcgtggtcagaagaaaatgcctgtgcaaagtaagaattttaaca

SEQ ID NO: 254858 - DNA, 363 bp, Homo sapiens
ttttatgaaaatatcctaaaatatcttattatcataaaattcattatttgcatgatttcaccactgccatggcccatcacactttaagatagttttagagatgtaaatagaattgggaatacttgataaatttaattacttttttttttgagacagggtctcactctgtcacccaggctggagtgcagtagtgtgatctctgctcactgcaacctccgcctcctgggttcaagcgatcctcccatttcagctactctggaggctgaggcaggaggattgctggatcccatgagttcgaggctgcagtgagccatgattgtgccactctaccctagcttgggtgacagagtgagacccagtctc

SEQ ID NO: 254859 - DNA, 607 bp, Homo sapiens
caaagatgccaaaactccagccagcctctgggtcattctggagaagaggctcttctggctagaaggtggtaggcaaatgactgcactgtcaggcctcccttgcctgtgtgcagttaggaagatgagctccatttccaagcacccttaagcccaaagactttttgaaactggcctctggctcctgctcaggtcggaagcaggaggtgtctgccatggtcacccctggacccctggtctgtctcctgtgtgtctccaggcagctgctggctctggaggcatccacccacccagtgggaatcgggatcgttcactgattcagcatatctgccctgggtgtccctgggtgtggcagtcgggaaggcaggctccggtcgggatggcagggtcggtggccctgaagaagcccccaccccagcagggaggcaggtatccagttagcaggagaaagcaaagtggatgatagatagcgaagggtgaggggatgtcaggtggagggcacagcaagtgcaaaggccctgatatgggaccaggaaaaggagctggggctgggcccaggtggaggaagaggcagctgcaagagtgcagatgggccccagtgggttgtgtg

SEQ ID NO: 254860 - DNA, 665 bp, Homo sapiens
ggcaatcatgcaatgacatataaggaacatttaactgcatggaggactctttcttatgtttgattgtaggtacatgggtagacactatcccatttttaacatgtttaacatgttttaacatgtatcccgtttttaacatgtggtttaaatattgcgtgagtaattacaaattagtcactttttttttctgaaatacctaattaccttgttggacttgggatagaggaactcaaatggtctttttatggtggatgactgttatagatagagatgtcatccattatatgcttaccctttctagattcatgtttagttttgtcttctaaattctgagtatactttgttcttatatgttgattaatctggcatttgtttaatatttcatagttacgcaaataaagttcacatatatcatgttgttttatccgactgtcccttcttaattctggcagaagatggaacacttaccctctagatatggtgatccagaaagaatttagagtaggcaaccaaagctaattgggagtaaagcttccataatgaaagctagagggttacacaaaaatctatgaatttagtattaactgccacttctcagctctctttccagatgtggttccagaacactgggatttgtgtttttactctcaggggaaagagcctct

SEQ ID NO: 254861 - DNA, 414 bp, Homo sapiens
ccatgatgggaggggctcgggcaggggctcaattctgagtgtgagaagcccggggagagggggcagagtgtgtagggaatagagcaggcctgagggcagcttcaggttgctgccgtgtggtgcacacaggggcatgtagggaggaaagaggagactgtctcgtctggagaggctttgggcaggcagtgaacacaggcccagggcgagggcacagtgatggatggaatatttggtagcatcagtaaccaccagggctgcagagttctgcacactcaggccccgaagacctgatatccttccttttagaggtggccaggcttggtagttaaggacttggggccaggcgcggtggctcatacctgtaatcgcagcactttgagaggccaaggagggtggatcacctgaggtcaggag

SEQ ID NO: 254862 - DNA, 474 bp, Homo sapiens
ggcactgagaactgaagaggaaacgtgaacagaaagaagagtgagggctgaataagaagcctcgccagtgggaaatagggcccttggtaccttttgctcctaatagtcacatctgtgtttagaagggccaggaactcccacctcctgcgtcagagcctgtcaagcatgtcaggcctagagtggctttctgatccctgttatacacctatttataagttatctaagctaattctgagctcagagtaattttcctgaaggagcttcaggtaaataaggatgacaaagaactaaaaccaaatttactgtaaatgataacttcagcttctaagaaaagaattactgactccacactgatgtcaatagctggagagcaagggctacgaggaagaaaaccagtgaaataatccatggtcatgccacttgcccaaatatctgaattgcttatcattaaaaaagagcaaatttacgtttata

SEQ ID NO: 254863 - DNA, 1108 bp, Homo sapiens
taggtaaagatcctgttacttctcaaacttccacctactggttttagtatccattactttagttatacctggcatggagcctccgcagctggtatggtcttgtggatttttatttaatagaatctaaatcattactgtcactttttattttggtgctcaaatcatcttagatttggccattaaaaattccttcattgctgggattacaggcatgagccattgcacccggcctcagctttactttcctaacagggatctgatagctaaaggaaaagcctttgccagtcacgatggctcaaacctataatcccagcactttgggaggctgaggctggaatattgcttagagcccaggaggaggctgcagtgagctgtgatcgcaccactgcactctagcgtgggcaacaaagcaagaccctgtctcaaaaaaaaaaaaaaaaaagaagaagaagaaaagcctttactccagatgtagagcagactgagctcatccatcatgatttcttcgtgatattactgccaagcagattataaggtgaagtcaatgtgacaaaaggaaattcggctaaaagcttcctgaagccttttgatgctaagcagtccttcttttgatatttaatacccatggacataaacttctgccttagaggtcgccatggagttttgttttgttttgttttgttttgtttttgccatctgttaacagtcctgagtacccatagagccttttactatttatcagcattctagagtcgtcagtatggattgtcaaaacttgcatttgtctcttttttgttcagtgttgtgtgcatccacattttctttcttttttaaacaaccctgcttatgtaacatccacattttctgacttacctttcaaacctgccagaaagcagaagtgatatttaatacacttggtatgttttatatattgattctaatgataatgtttagtctaagatggacctgacaaggccaggcatagtggttcaacagcactttgagaggctgaggcaggatgattgcctgagcctaggagttcaaggttacagtgaactgtgatcacatcctgccttctagcctgggtgacagagcaagaccctgtctc

SEQ ID NO: 254864 - DNA, 416 bp, Homo sapiens
tctacatacacactccaaggatcccacacttttaaaagggtgctaatactctcttacttaccttggccacagccctgtccctacagtcatctgccctttgttcctggcagctccaccatgcaggtgaaggggcaggagcaggaaagtgtgtgtgtgttgggagggaccctgtggatccttcacaggctgtgaagctcacttccttaaactagggagatgggcttgtgccaccccaatctgaagccctggaggtcagctgtgggacggaacagaggggcctctcttgaaagaaaactgggagttgaagaagtgttgcattctacatgcttcctcatttccttttctgtagcccttctctgtggcacctgatgctacccataactcctagcatgacaatgctcacccatggctcctcc

SEQ ID NO: 254865 - DNA, 461 bp, Homo sapiens
gactccatctcaataaataaataaatgaatgaaatgcaagtacaaatcaatttagaggtgggaggaaagaccttaaaaaatatcacagtggctggcccttggaatcccagcactttatgaggctgagaccagcctgggcaacatggggaaaccatctctacaaaattttagctgggtgtaggctgggtgcggtggctgacgcctgtaatcccagtactttgggaggccgagtcgggtggatcatgaggtcaggagattgagaccatcctggctaacacagtgaaaccccatctctactaaaaatacaaaaaattagctgggtgtggtggtgggcacctgtagtcccagctactcgggaggctgaggcaggagaatggcatgaacccgggaggcagaacttgcagtaagccgagatcgcgccactgcactccagcctgggcgacagagcgagactcggtctc

SEQ ID NO: 254866 - DNA, 1985 bp, Homo sapiens
  misc_feature (258)..(258): n is a, c, g, or t
tagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctntaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgtgccgtcgagtacctgcatggtctggagatcatccacagcaacgtcaagagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtgttggccgaggtcctcacgggcatccctgcaatggataacaaccgaagcccggtttacctgaaggacttactcctcagtgaaattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgtgtggctctgtggctgctgtggaagagcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatgttacaagaacacttcgtggcaaattgagatcaatgagcgcccaaaaaggaaactgatggagcaatatttctgctctaccaaagagggacaaactgtggacaagcattgacactcttgggcccctgattgaccgggaccacagctgaggacccgtggtctcacgtgggacagatgaccatcgcatcagaacaaggtcttgagagcagaatca

SEQ ID NO: 254867 - DNA, 1412 bp, Homo sapiens
  misc_feature (258)..(258): n is a, c, g, or t
tagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctntaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttcccaaagtgctggaattacagttgggagccactgtgcctggcctggaagactttcaacttgtgtctcagtgcagttcttgactcacctctctgggcctcaggttctacaaatgccagacacctagcgaagagctctgcaggctttccactgcctgtattggaaatcttgcaattcacataattattcagtcactgcctggtacctttatcttcccatcccactaatgttagtgtcttttaatggagcttttattctgagaatatgtgttgtctagtaggtaagatattgagacagagtctcgctctgtggcccaggctggagtgcagtggcacaatctctgttcactgcaagctccgcctcccaggttcacgccattctcctgcctcagcctccagagtagctgggactacaggcgcctgccaccatgcccggctaactttttgtatttttagtagagatagggtttcactgtgttagccatgatggtctcgatctcctgacctcgtgatccacccaccttggcct

SEQ ID NO: 254868 - DNA, 208 bp, Homo sapiens
gcttccagggatagagagaagcaaatgccagcatagtgagatcttccttgctctcgtttgtcttgccaagctccaacctacatttttattttggtcttacatcccaataatccccaacaagatgcatgtactttggccaaaatggattgttcctttaaaacttactagtttctcattttagttaacaatatagttttaaataaacaac

SEQ ID NO: 254869 - DNA, 409 bp, Homo sapiens
gcttcaacaataattgtgttaatgttttggaaaacaaacattaactaaaataaaagcaatatcctagcaactctcttgattgcctatgctttccccctaacaataccttctccgattatgaccaggtaaccaacactcaaggaaagatgaccctctccccagctcagtgtaaaatcttgaacagatagtaaattgattgaactaatctcacttatttgggagtaatcagtttaggagtgaagatgtgtttcagttccaacaaatgagacatgaggaaatcagcttctgggttggggacaggaggttcttcactcttgaaaagagacttggtggagagttcaccagcagtgaaaacaccacacaatgttgcatgtgcacgtgcccccgaaccacagcgaccatattgtgc

SEQ ID NO: 254870 - DNA, 682 bp, Homo sapiens
ttatgtccatgtgtgctcaatgtttagcttccgcttataagcggtaacacatggtatttggttttctgttcctgcatgaattcgcttaggataatgacctccagctgcatccacgttgccacaaaggacattatttcattcaattttatggctgcatagtgttccaggagcaatttaatagttaaacttgcagccatgatggagcaatagtctccgatttgccctccctcctgagacaactgaaaatggacaatcaataggaggcaatggctctcaggttatctgacaccagacaatgaagtcagtgacctctgagagacagaaaacaaatgaattaatccctaactctgccccagctgacttcatggaagtttctgggctttgacacagagaggggaaccaaagtgaaatctggagatctctctgagtggaagagatgagagatgagggataccaaccagttaagagtttcggggcagagaatcaaaaaggagacagctgcacagataggaatttctggagattttcagaggctccctctcaagtcataagcagaacacagatcagtacgtgcatatgaatagactacctaagtcccagaaaaggacgaccagagtggattagaggaaccatccccagggcagggacaaaaggaagaagggctgttcccatctgccagagt

SEQ ID NO: 254871 - DNA, 361 bp, Homo sapiens
gtctaagagaaataacctttaatgataaaaataatttgctaaaaagctgaatggaaaaatatatttagccagaggataattcccccaaaccagaaaacacacagtgttaagtaacatcattatccacccttttttggttggaaagtatggatatatggtatccacgctggcactgcttctcacagtgcctctttgtatagcagccaaataacaagttgtgttatttgctggatgagaatgttgctggctgagaatgtgtctttttactctctgaaccctcacacctttacagtcatgggtggcaggtctttatgcatgaatatcttctctggttgcagctgtagtgacttgcagatggatc

SEQ ID NO: 254872 - DNA, 681 bp, Homo sapiens
ttccaaaaacaaaatatctactggaatcatcagctttagccctaattgtaaaggatcaaggataggaaaatgttgagcttatcaaataccacttaggtgggaaaaggtaattattttgtttcccaaggcaaacacaaaaagaaatttggcattagaagatgaaagtagataatttttaagttaccaaatcaagatgctgtttgcagaaatatttggtccacagtagatgattcatttaaaaaatacactttacctgacacagtgcaaaagttaaaatgatttttattttattttgcggtttagctttaatacaacctgctaaaatggcacagaatcaatactgcaatgaaaaacctctgtttctttgttgagtctggtgtctgtcaataggtttccaggggcatctgatcattatttaagcttaaactcaattattcagaaaatgccctgtggccctagcgtcagcataaaatagcagcaagaccttactaaactgctcagaactgggtgaagagtttcatttcccaactttcagggtgaaatgttcaaggcatctgaggaaggatagtgtaccacattaaacatgcacagtgcatatgaaacctgttttgttaatgggcacaatagtattatatttaactctgggaatatttccaccaggaagcaacaggctgcatttag

SEQ ID NO: 254873 - DNA, 252 bp, Homo sapiens
tgctttccaaacacctttgcctcctgagtagttgctgaggcctgatcataccgcatctcaggggaagctacatcgttgccaggcttcccacctcctggggcaggaatgtggatttcctctcatttccagaacatcctaagtgcagggagggagagttggtgtcctgggcgccacggggacctagagcgcctacggcacattggaggctgcaggttgagcaggccactcttgtggggtaagatgagtccacca

SEQ ID NO: 254874 - DNA, 358 bp, Homo sapiens
gaagctattgcttccaataataataataataataatttgtgtcatgtcctgtttttgcttacaatgttattatggtatgtccagattagtcatcaactgaaagggctagaataatgattgcccaaagagttgctctaattgaggaggcagtagcatagcctgacccagcttccaggtttgctttcccttttgctgtatatctggtctagatccctatatttttaatttcctcttaccttctttcctccccctattttaatcttcatggggcacgacctgctaagaatgagccttcctagcaaggtgggacctgaatttctgggaataaaccatcctagcaatgaaggaccagctcaaa

SEQ ID NO: 254875 - DNA, 5302 bp, Homo sapiens
  misc_feature (292)..(292): n is a, c, g, or t
  misc_feature (300)..(302): n is a, c, g, or t
  misc_feature (305)..(305): n is a, c, g, or t
  misc_feature (309)..(309): n is a, c, g, or t
  misc_feature (311)..(314): n is a, c, g, or t
  misc_feature (679)..(679): n is a, c, g, or t
  misc_feature (734)..(734): n is a, c, g, or t
  misc_feature (740)..(740): n is a, c, g, or t
  misc_feature (1945)..(1945): n is a, c, g, or t
gcttggcacagaagacagccgggacaccctggaggccgccacaagcctgtacgaccgagtggatgaggaggtgcacaggctggtcctcacctcgaacaatcgtctccagcagctggagcacctccgggagctggcgtcactcctggaagggaatgaccagcaatcctgccagaaaggactacagctggcgaaggagaacccgcaacgtacagaggaaatggtccaggatttcagaaggggcctgagcgccgtggtcagccaggctgagtgcagggagggagagctggccagngccctccnnntcncacngnnnngcagctggatggggcccctggacccggaggcttgtccctcctcacccgtggctgagtgtttgaggagctgtcaccaggaggctacctcggtggctgcagaggccttccccggggcaggtgtggcagtgctgaagcctcatgccctggggaaaccgtgggcatcacagcaagacctgtggctgcagtacccccagacccggctccgtctggaagaggccctttctgaggctgccccagaccccagcttaccgccccttgcccagagccccccaaagcatgagcgtgcccaggaggccatgaggaggcaccagaagccaccctcattccccagcacggacagtgggggtggtgcctgggaacctgcncaaccactgtccggcctccctggacgagcgcttctgtgtggacaggacggggagnccctgngcccagggctgtgtgctctgtgggacccactgtccctcctcaggggccttccaggggcaggggccaccacggcccacctggaggacagctctgcctgttcctctgagcccacccagaccctggccagccgccccaggaaacatccccagaagaaaatgataaagaaaacgcaaagtttcgagatacctcagcccgacagtggccccagggactcctgccagccagaccatactagtgtcttcagcaagggcctggaggtaaccagcactgtagccacagagaagaagctcccgctgtggcagcatgccaggagccccccggtcactcagagccggagtctgtcctccccctcggggctccaccctgctgaggaggatgggaggcagcagccgactgaggcacatcatggccgagatgatcgccacagagagggagtacattcggtgcttaggatacgtcattgacaactattttccagaaatggaaagaatggacttgccccagggccttcgagggaagcaccacgttattttcggcaacttggagaagctccacgacttccaccagcagcacttcctccgggagctggagcgctgccagcactgccccttggccgtgggccgcagtttcctgagacacgaagagcagtttgggatgtacgtgatctacagcaaaaacaagccgcagtcggatgccctgctcagcagccatggcaacgccttcttcaaggacaagcagcgggagctaggtgacaaaatggacctggcctcctacctgctgcggcccgtgcagcgtgtggccaagtacgcgctgctactccaggacctgctcaaggaggccagctgtggcctggcccaggggcaggagctgggcgagctccgagccgccgaggtcgtggtctgcttccagctgcgtcacggcaatgacctgctggccatggacgccatccgcggctgtgacgtgaatttgaaggaacaggggcagctgagatgccgggatgagtttatcgtttgctgcgggaggaagaagtatctgaggcatgtgttcctctttgaagacctcatcctgtttagcaagacccagaaggtggagggcagccacgacgtctacctgtacaagcagtccttcaagacggccgagatcgggatgacagagaacgtcggggacagtggcttgaggtttgagatttggtttcgcaggcggcngaaatctcaggacacctacattctccaagcaagctcggcagaggtcaagagtgcatggaccgatgtcatagggaggatcctgtggcggcaggcactaaagagcagaggaaggcggggaacaccccccaggcagagagacctgggcagccaccgccatgaatgagagctctctggctgtccccaggccagctatgctctgatggccaagcgtggtggtccttgcctgtgtccgagcgtggggttagttctggaacatttgatcacttctcctgctccactctctgcactccacctggaactcccgattacacaactcagaatccaagaaatggcatccatggggataggcaaccagccattcatggatgtcaagcccagagaccggacccctgactgtgcagtgataagcgacggggctcccaaatgtgcagtgatgagcgaccgggtccccgacagcatcgtcaagggcacagagtcacaaatgagagggtccacagcggtgtcctcctctgaccacgccgcccccttcaagcgaccacactccaccatctcagacagcagcacctcctcttctagcagccagtcctcctccatcctggggtcgctgggcctgcttgtgtcctccagcccagcccacccgggcctatggagccctgcccacagcccctggtcatctgatatcagagcctgcgtcgaggaagatgagccagagccagaactagagacgggcacccaggctgcagtgtgtgagggggctcctgctgtgctgctgagccgcacacgccaggcctgatgactgtcagggtggcagtgcccatcatgtggctagaacaatacagagggagcagcacgccaggcctgatgactctgggggtggcggtgcccatcgcgtggctggaacgatccagagggaatagcacagcaggtgtccaggtatttcccaggattttagacattccctaacattttcaaacaaatttataattttgtcttatttaaaaaacaaaccttccacttccacccaagacaacagcataggaaacagacctaaaacaagacaaaaaaagactaaacatgaaacaaaagatgtcaagacacaagacatttggcaacaaaggaccgcgatccctgagagacaggaaaacgggaggtgagcccggtgatggcctcagacctccctccgccttgagagtttgcaggcctcagtgcagggaggggcccaggaagagcccagcagcctccgtgagttgaagagaccaagtcagcaggagttggcaggtcagagtgccagagagagatgcctgcatggggaaagactcaccagatcagcccctccagcacctagtgggttgctacccattcgcacactcaaacagggaggctaccaaggctgggagcaacctttgaaaagaccaaagatcaattcctggtactcatgtgggctggggacaggacccgttcccaccagccagactagggaaactctcagtagatcaattcctgatactcatgtgggctggggacaggacccactcccaccagccagactaggaaaactcccaatctgtgagcattaggtggagttctcagaaaatcttgcctcaggaatggggataattagccctagactgagccctgctcctgactcgcctacaaaatcataaaagcaagacctaaaatgatcaaaccattcccagataattcactttatcccagaacaaagctccagatgatctaggggttaccaaagtgtccgcaccctgcaaggtaaactcacagtgcctgacctcggagtgccaggcgtgcagaggagcagccaagggcaaacactccaaggagagtcgcctggcaaagccaaccacccagagccggcgtctgtgctagaatcacagaattcaaactgtggctgaaatcgcagcccaggcgtccagaaagttaaagttaagaacctataatcccagcactttgggaggccgaggcaggcggatcacgaggtcaggagatcaagaccatcctggctaacatggtgaaaccccgcctactaaaaatacaaaaaattagccgggcatggtgttggccgcctgtagtcccagctacttgggaggctgaggcaggagaatggcatgaacccgggaggcggagtttgcagtgagctgagatcacgccactgcactccagcctgggcgacagagcaagactctgtctcacaaaaaaggttaagaaatgacttaatggaagagattcagaagacccagaccgaccttacagggatgagaaactacaatattgacagtggaaactatcctggatggggtaacagattggatttcacagaagagaccatgaggcaccttgaagacacatcagtggaaactatttgcatttgttgggcctccagagagacagaaccaataggagatagctagatatatatacagacagatagatagatagatagatagatagatagatagatagatagatagactgacagacagatgagaggggccttaggggcattggctgacacaattttggcaggtcaagagccccacaataggccatccacaagctggagacccaaggaagctgctagtgtgcccagtccgagtcctaaagcctcagagccagggaagccagtggtgtaattctcagaggccaaaggcctgagaacctggaggccactggtataagtctgagtccatagacccagtgaactccaaacacaagagatatgagtgcacatcataatcaaattgcatataaccagtgataaacagaaaatcctaaaaccagtcagaggacaagggcatgttctgttgggaggcacaaagctgatgaggatggctgactcctcaggagcagcatgggtgagaggcagtggaatgtactaaggagaaaactgccaaattcacattctgtacctgacaaaatctttccgaagcgatggtgacataaagacattttcatacacacagaaactaagagtttcatccccagcagacctgcactacaagaaatgttaaatgatgtgcttcagggaagagaaaaatgaagagcatgtgcaccatccaggattttcctcgttatttgaatccctttggcccatctcccatttgccccaaggaatgagtgctggcagtgagctgcactttttttttctctaaacgggaaatgggttaaaagatgagtggcttggccgggtgcggtggctcatgtctctaatcccagcactttgggaggctgaggccagaggatcacttgagcccaggaactggggggtcatgctgggaaacatggcaagaccgcatctctattaaaaataaataaaagttaactgactgtttaaacaaaagt

SEQ ID NO: 254876 - DNA, 687 bp, Homo sapiens
tccttgacattgaacttgccaaagagcacatgtaagttaaataagagcctagaaaaatgtatactttcttacttgcagtttaaaaaataaccttaaatgaaaagagaagtgcacaaagtgatacaactttgtcttaattagctacgctgtttctctgtgctttgctgactagtattgaatcaaaatcctgattgtcactaaggctccacctaagtagaatcatacagtaagctgtcgtggataacgcagatgtcaggtgtattacagtgaataaaatgaaagaatagcctaatgtagatcgaccccaataatttgtgtgtgtgtgtgtgtaatttttaaaaaagacaaggtcttgctatgtgaccaggctggtctcaaacttctggcctcaagtgatgcgcccaccttagcttcccaaagtgctggtattacaggcgttgagccactgtacctagccaaccccaatagttcttcctcataatttatctcatccacgtaatctagtgtgatttacaaactgctctgcagctcaataactttctgtaaccttaaacacaagtaaaagtgagctgctacatccaaggaaggagatggcattggcggtgtggagagaggaggtgagaaatggtcagattctggatgaattctgaggttagagcccataggagtggtaggattctgggtttg

SEQ ID NO: 254877 - DNA, 416 bp, Homo sapiens
tttgctaaaactcatgataaagtacatacagtggtaatatacaatacaggatgaccagtgtagactggctgactggggaagggttgatgtaggctggctaactaaggagaggctcagtgtagacaggttgactctggaaatagttggtgtagaccagtcgattctgaaaaggctccatgtaggctgactgtctcataaagggctcagtgtaggctggcttcccacagagggaaatatttgagatgagtggattgggaggttatatcctgtgccctagttctgccattaacattgcatttctttgcaaataaatgtaactttgtcacttcaaatctgcaattagcattaactgtcaatgacaagactagggtgacagtgagttcgggttcacaaccacgagctaggaccaggagagc

SEQ ID NO: 254878 - DNA, 516 bp, Homo sapiens
ctctcctccctcatactttgtgccagctactcccactgcctgtaatgtccctgactccatgttcacttaacttgtccttcaggttatcacttagacatcccaccaccctctccaggaagccttaatactaggagatgtctctcctatggtgtcccaccaaatttcatgcttccatatctaaatagatcacactatattgcagttgcttcgctacttgtttttcttactgtcctataaacatcttagttatttgcctttgtaacccaatgcctaatacaggagctgaaacatagcagatgctaaaaaaaatctgctgaataaatgaatgtatgaagaaatgggtgaaggaataagagatcaaagttgatgccacagaaaggaggtaaaagaaaatcccttccaattacatgatacctttccctagccttcccaaatgggaatgagtgaaagacataatggcttatttcttcccattctttttggttgtttagtgttagagatgttatgctggatgaa

SEQ ID NO: 254879 - DNA, 375 bp, Homo sapiens
tggaggttacagtgagccgagattatgccactgctttccagactgggtgacagagtgagactctgtctcaaaataaataaataaccaaggatttaacatttatgtagatttcacaccacgtaagtacagaaccacatacattaaaaacaaagaaaagaaaatagacctcctattttagcaagccaaaatcaaggttacaaaaagatatcctgaagggcaagtactgtccgtgactgtattccataaaacaagcctgttagggggccggacgcagcagctcacgcctgtaattccagcactttgggaggctgttgggcggatcacaaggtcaggagatcgacaccatcctggccaacatggtgaaaccccgtctct

SEQ ID NO: 254880 - DNA, 224 bp, Homo sapiens
atggcaaggaatagatcagaccatttataatccggtagaactttgcttcatcctcctgctgctgctcacttaattctttcaccactcccttggaatttctgaagaaagccaagtggggcatagggaaaagagacgggaggtgaaattcaaaatatcagatgtgggtaccttttaaagttattctgttaaaagaaatctaacagaagagagtataaatattgatt

SEQ ID NO: 254881 - DNA, 444 bp, Homo sapiens
aaactgaaccctcccccttcctccataccccccccaaaaaaaaaacccagcacctaagtgtcctgatactatgaggcataacaaatatggaattggagttgcagaaggggtgagggcagaaaaaatatttgaacaaatatggccaaaattgttccacattggatgaaaaatagaaacataaaaatccaagttcatttaacttcaaatagaaaagaaaaccataccaaaacatatcatttctgaaaccagtgataaagagaaaagtcataaaagtaaatgaagaaaaaggcacatcacaaaatgcaaaacaaaaatgaactgacttcacatcagaaaaaatgcaaaccagaagataatggaatgagatcggtatcaaaagatgaagacttataaaccttaaattctataaccaggaaaaaacatctaaaatgatgacattttcag

SEQ ID NO: 254882 - DNA, 344 bp, Homo sapiens
taaagtctctttcaatgattggattcagtggagctgggtttactgtaaagggaactttaatagctatttttcaatgaacacagaccatctccttttgattaagtttaactattaatgtaatttgacaaggaggtgagaagctcatgcctcatcttcatctgctgtctaaagtaacttaagcaaaagcaaagaaaagaagcagtaaggtgttgctgctggaaaattctgtctgaaaatgctgttatttgaaattatttatagagaattcactgaagtgaactatttcaataatatttttatgttaacgaaggttatcaatgataagatgagccaattataatagt

SEQ ID NO: 254883 - DNA, 301 bp, Homo sapiens
aaaatggctacggcttctaaagggccacagtaactagtggtatatagtatatctgtggtattaaatttaatggaaggggactgggggacacaatagataaatgtctaaaaaggccgcttagggcgactataatttttttaaagcctgaaaaacagtaatctgattcaatcaaatatcagtacaatcaaaatggtgaccaaaccaactataattccaacctcattttcacttttgtatggggctcgtaatccaacatcacaaccacaggagggattcattcactaattatttactaaaccct

SEQ ID NO: 254884 - DNA, 504 bp, Homo sapiens
gaaataattggggcaaatatgcatagataatgtagaaggacttttattgcaacattgtttgaaagtgacaattataaattactcggtatttactaataggaatcctgttgaataacttagggtgtattcttacaatgtaatagaggaacttcccaataaggtcccacactgtgctgatgccctgagacactgtggcacacggtgggcacagtgaggtattttaaatttccaagagaaacacaggtacatttgtcagataccctggaactcctagttcctggtagttctgtttcaacattagatggtgccaaatccctttctataatgtcatatttttgtgaaactgggtttttagcagttgctaagtacaggcaaaaatcagtttgtagaagaaataaaggtggtgctgtttagtctgattccaaggtttgagaggtgcagtgcctaacaggcgccataagtgagtgagatggttatttggtaaagaaataaaaatgtaaaaaa

SEQ ID NO: 254885 - DNA, 351 bp, Homo sapiens
ttttttcacttaaagtcaattttgtccaatataaatatagatgtattaggccattcttgcattgctatagggttattataataaagtaccacagaatgggtgccttaaataacaaaagttcattttctcacagttctggaagttataattctaagatcaagatgtcagcacatttggtttctcctgaggcctgtcttggcttgcagctgcttgccttcttgccatgtcctcttatggcattttttctgtgcacatgcattcctggtgtctcttcctcttctaataaggacatcagccatattgcatgagggccataccctgggagtctcattttagctttatcagtcctta

SEQ ID NO: 254886 - DNA, 382 bp, Homo sapiens
cgagtcttattggaacgcgggaccctatgcaccagtcccaaggctggacacttcatttttatcactagtttcactatttgccctttctccttccccccaaatctttgcttttaagacaggaaaacctacaagataatttggttttattgtatatgtttagtctattcacagcaattaaatgagaggggttttgaaaattctccagtttatttataatccatacttgacattatgcataaaaaatgaagacagtgtcatttttcatgcttgagattttactatcaactggccttatcattgaatttactttagggttacttaaactagtctagtgcaaaactattaaactttcttccatgtgttgtagaatagtgtgatttgg

SEQ ID NO: 254887 - DNA, 435 bp, Homo sapiens
tgctatgctggatggaggtactgaaggcaggaggaagggtagatgatataggtttaatttctattctctctggcaactgggtatcattcaacagtaaacaagcaatctcagttttgctttattttaaaataagcctgactggatattttccatggctagttatatccttatcaggggaaatttcagaatttggggtgagatactcttctgtgacaataataatggcaacaaaaaccacgaaatgacagctgctgttttttgagtgtttaccaaattttagaacctatgccatttctttacatgtattgtttctatacctcatgcccacccgatgtggtaaatttattcctttttctttctaaatcttgaaaccttggcttgttgacactaaacaacttattccaggtctaagagtgagtatgtggctcagcatta

SEQ ID NO: 254888 - DNA, 290 bp, Homo sapiens
agctggtgtccgagtcctctgacgtcctgtccaagtgaacagctgtggcagcccctcccagcctgcccctcctgcggctgccccagagcccagcgggggaggctgctgtgcagggtagcacagggaacgggagacccacctgaggctcagccctagccctcaacccacctgcgggggagtttactgcctagggaccccccttgcccatgcctccagctacaaaacaattcaattgctttttttttttggtccaaaataaaacctcagctatctctgccaaaaaaaaaaaa

SEQ ID NO: 254889 - DNA, 420 bp, Homo sapiens
gaccagatctgattcgtaattcagtttaagaatgacgcaatcaaattaattttttaaaggtgattcttgctgcttggtagaaaatagatcatcagagaacaaggagatgggtgagaagaccagtgcaatagttcagataagaaatgatggtgatttgaacagggaagtaacaacagtgatggcgaggagtcagtgatttaaggatatattttggaggtaaagtaaaaaggaattcctgatagatcctggggaaagggaaagcaaagaatcaaggataactttcataacccaagttgggcagatgggaatgccatcttctaagacagaaaaaaaacttggagaagaggtgattggtgggcttttggggtaattaagagttctcttttgaacaagttgagtttaagatgtttattaagcatc

SEQ ID NO: 254890 - DNA, 188 bp, Homo sapiens
atgccacatagctaggagcagagatttcaatcaggcagtctggctctcaaagtatgatgccttccgtgtggccgggtgcagtggctcatgcctgtaatcccagcgctttgggaggtcaaggtgggcggatcacaaggtcaggagttccagactagcccggccaacatggtcaaaccccgtctctactg

SEQ ID NO: 254891 - DNA, 681 bp, Homo sapiens
ttcctcttttttggtgctcttttctctatatcctgttgtaatgctctcccttggctccagcccttgctcttggaagcaaagttcagtccttataatcggctgatgcaagtccagaaccaaatacattgtatatagaatggggtggctttccttttttctacatcagactttttcctttctgtttattataaaggttgccctgcttcgatagagtgattattctatggatgaattataaatattttgtttaagttattaattatgtattcagcatgtttcacttgtatcagtgtgcatttaaatatgtcatctcagcctgtcctcatgagacttatttcaatttcacaaatgaaaataaatctaagcctacagcctctgcacaactccctgatgtcacctagtgttctgttctttccccagcatcatcattttcaaatcagctcccaagggtcagtgaggcagactgagcatgtgaatcttgttggaataattgggtttctatgataactggagaccataataggccatgcactggttttccaataggggttttttttaacaaacagaaccataaaattctaagggaaaggtatcagtctggcattgatcatcttgcaaactattctcagtggccttgaatttaacaagaataaaagttttaccctcaaatgcaagcttttg

SEQ ID NO: 254892 - DNA, 738 bp, Homo sapiens
catcataagaaaagatgttttaaatcttatgaagaaggtttagaggccatttgtgtagtaaactaacaaaagaacaaacttctttgaagaaacattctctctcagagttgaaaataatttctgatttcctctaaaagtaccaaatgattgtgtaataaatgagggttgagaaatagaggattaccttccaagaaaacatcaaccacagcttgtgtattttttaagtgttgtgaattgtactttgtggtacaagcagtaataaaagtaagtatctacttctaatagtggtgttcaatcgtatctagtgactttttaggagagctgaatatacaaggacacctttttactgatgttcatatacatttcactggcatcgttaaaaagaatgaacattccagagttgtgataggaaatgatagataactttgtcttctatctcagacttcctatatgcccgatttgttctagcacattgcacacatttgcctgtttccttatctgtaaggtacaaccagagccaaacaagaactagagttccgtgaaaagtgaggttttgtttgcaccccacctcctaaagtgctgacaagcaggaaacagtcattcttataagtatgtgctaacttcttggggaggttttctttttcactgtgggtaaaatgagaaatgttggatgcctctagaccgacaattagctaaccaaaagtaagcatccagttttcagtagtatgaaagcatctg

SEQ ID NO: 254893 - DNA, 583 bp, Homo sapiens
ctgcattccacaagccttgatatatatgacctgtgtcattcataattctcactgtgatttttctttttaactcatatagtaggctgaataatgcttcctctacaaatatatgtatgtatgtatacacacatacatgcacacacatctctttctgtacatatcctaattcctggaatttatgacatggcaaaaaggcaaattctcccctagagcctccagagggagcgttgccctgacatcttgatttcaggctggtgatattgatttcagacttctggtctccagaactgtaagagaatatatttctgttatgttcagctaccaagtttgtggtaatttgtaatagcagcaataggaaaccaatacgcctatgaattatttgaaaacacatttctaagttgcctaatccatatttagcctattcgtattccattttttgctgatttctactttaattgcttttatttggaaaccattatttgcaatactttgattatttgaaacttgtagacaatttctctttgatctatacatagtacatttttatagtttatatgtacctgaaaataaaatatattcttca

SEQ ID NO: 254894 - DNA, 296 bp, Homo sapiens
acaaaattcccatttaattctacctcctaagatacaaccaccattaacgatttatattttttcactctttggagccagtctgctagggaccaaattctagctctgccaacagctagcaaccttggacaagaacttaacctctttgtacatgcttctttacctgtaaaatgggggtaatgatagtaccgattacatgcggctgttttgagaattaagttaatatatgttaagcacttgaaacagcacctggcaatagttaagtgttcaataaatgttggcctttttctaagtgtgaa

SEQ ID NO: 254895 - DNA, 496 bp, Homo sapiens
ctttaaggaatatcacgggaaagcatgaagctgttataaagttaatatctgctattctggactcaagaaggtcaatctgtaccctccgtacgtgcctcctttcctagccttcccaagaagtcttaagaaaaatggacatcaaccaggctgaaaccttggcatcatacctggcacctgctggatgcttaataagtacttgtggactgagtgactctcatgccttacctctgcagtgtagacaatagtacccatgcttgctacatcacggaggacttgttaagcattattcaattatgaatctttagctagtctacatgtcatagattctaatattgatgttttctaccctttaatataagtgaattttaatccattttatagtacatcttgaaattatatatataatttccttagtggtacctaatgtatcttccaatcaataattttcctgatttattgaaaaacggtattaaataaatgtaattacaaaaccaac

SEQ ID NO: 254896 - DNA, 308 bp, Homo sapiens
aaagaaacccaatggcaacaggtcaagtttactagaaagactgagacagctgaagcaaaaccaagcagctggagttgagcagagtcctttgacctcgcctcccttctcgtagctctagaaacggcagctgtgttttctcctctctgtacagagttgggctggcaccccttcccaggaagctggcagtgggcctggggcacacaccctcagagctcggctgagtcacactcccatcagataaaaccatacacctaggcaggctacagggcttgatggaaaccacatcacctcggaatcatgattcagtt

SEQ ID NO: 254897 - DNA, 554 bp, Homo sapiens
tggctcctgtgtccttttgctatgacccagtcctctttgattatttgccccctgtctgccaccacaagatgttccaagttcatcttgttcatttcctgtctctcacctttaagtcgccattttccaaggagccctcttctttcctttaggtattttggtactttcccaaatggtatttggaaaccacaatcaggttgttaggagtgcttcctgctcctggttggccatttttaagatatgtatgcattttaagccattctatagacattgctcaagtgccttcaggaagattatgcagctgtacatctacctacagtagaagagatcccaaagccacgctcatccaatcctggagaatcatttattttgaatatagaccattgaataggtgaaaaatggaaaagtcactttttgtacatttgcattccttcaataatgattaccatttgttcacatatttgttgaccattggaattgattttagcacagtgcctaaaatatagtaggtgctcaataaatatttgttaattgaataaattacttgtatgttcata

SEQ ID NO: 254898 - DNA, 691 bp, Homo sapiens
catgggagggatcacaccagtgtcacccttacaacagtggaggctgcttttgggcatgtggtgacccgtgaccctggccctgtctaggcactggccatcctgagtctagcacctcacacacacacatatatacagtgcatcccagtgctcaccgcctgcccacaccccccaacgccagcacccaccgtcatgacatgaacacagagaccagtaccctaccttgcactggtgacagcgcccctgtcacaaagccagcagcttcagacagcatccctcaacattcttcctggctactctgtccctgtccctcactccctctccagtagctcacagtccaaatcccacaacggatggggaagcttaggcccaagaggaagggatgggaggacacagtcatccctcctgagacccggggataggatcataaatgaggaaagaaaattgcctttggccagtgaatgacagacgtgggcatccaatacaaatcattcagctcctggtcggttgccccactgcagccctctgaatctgttcagctcctgccgtgcggcagctagaggggcccccaggacaggattctagaaatgggcaccaagctgggaccagagtcctaaggaccactctctgctcccaagtgtcagtcccagactatgggcccctaggtttcactaatccatcaaattctagactc

SEQ ID NO: 254899 - DNA, 200 bp, Homo sapiens
actactgctactgctacaaatactactagtgttgctgctgctgctattactattatcactgttactactatccttgccactatttctattactactactgctgttactactactattactgctactgctacacctgctactgctatccccactattcctactaccattgctcctactgccactactgtcttcgctataat

SEQ ID NO: 254900 - DNA, 424 bp, Homo sapiens
tgaagactcactctttttcatgatcttcaaagaaactcagatgcgatgtattgcacacaatttaatgaataattatggagggaagcaggttttctttctactgttataaatgctaaatgatgcacacttgaaagatactcattaaaagcttttttgcagttttgatgcattatcattcaatacgttttgaaaagaatgatactttgctacttctacttctcattatagtgatcttaatttttactttcaaggtccattttttttctctaaagttatttttttgtctttaatttgacctgaatccaatttaagatgaacaagtatgaatccaacaaagcggctttgaggtctgagaatgaaacttgtttactactgtaggactgctttcctctctgaggtggtttttactatttggggcttcaga

SEQ ID NO: 254901 - DNA, 1328 bp, Homo sapiens
cgggcagccttgcctaaatttctcccaagccaagctgtttgactgtgtgcacgtgtatgaacacaggtgtacggatgtgcatgtgtatgggtcaggtgtatgggtcacaggtgtacagatggaggcctatttgtatgtggctgtgaggtgtgtgtgaacagctccccgccgcccccactccccaaagcagcagctcttaaattttgggtcttggagcatccaatgaagatttaggatcctgcagttaagtacgaagttcgtattccatttaaaaaggctctggaatcagctatggacccgttgaacattcttctggctgtccttcccagctttggtgggagttggctctgactagatctgtcaggcctctgtgaagtcttcctgactgagtctctctctatgagcagagtggggccaagaagccaccccaactcctacccccgggcagcctggtcgccctggccctgcccacacagcctgccctgaggcatgctgagatcccagtctgcatcagggctgcccatctgccttggtgctcatcaccttgacatgaacaggcccgaagttcttttccaggatggcagagccttcagaaccatcaactcctacccctccatcgtgcagaggcccagagagggacagagacctgcccaacaccacagcaatgaagtggacaatgaagattcaaaaccacatttgcggtctcctcattccgagaggagattctagatgagccccgttacaggagtgtatttgcaccggcacacgccaagggactccatccccatgacgcagatggcccgggaccttcttcctttccaggctgtcccttcctcttgggtccctgagagggcagtcctggtgagggcaggagaggacagctaaggctaaggagcttgggaaaagatgtcctcttaagaactgctttccagcacatgttgtcccaccttctgaaattcaaggagatggttaaaagagaaaagcctttctccggacccacctgcagcattaagaaccatgggttgggctgggcacggtggctcatgcctgtaatcctagcactttgggaggccgaggtgggtggatcagttgaggtcaggagttcgagaccagcctggccaacacggcgaaaccccgtctctactaaaaatacaaaattagccgggcacgtgcctgtaatcccagctactcagcaggctgaggcaggagaattgcttgaacccgggcggcggaggttgcagtgagccgagatctcgccattgcacttcagcctgggtgacagagtgagactctgtcttaaaaaaaaaaaaagaaagaaagaaagaaaa

SEQ ID NO: 254902 - DNA, 453 bp, Homo sapiens
acaccgagaagagggctcactttattgagaaaacagaaggttgagtacttggtaccaagatggagcctggggtaggcaaaaagcctgaaaacaaagctttaagcttccttttttacatgcccgcctccctgcccctaattggggcagctcctattacagacccccaggcattcttttccctgtctctgggcaaatgcccagtagattttaccaacagatgtctgtttctgggacccaggaacatgagggaagtgtctcagttcttttccaggatggcagagccttcagaaccatcaactcctacccctccatcgtgcagaggcccagagagggacagagacctgcccaacaccacagcaatgaagtggacaatgaagattcaaaaccacatttgcggtctcctcattccgagaggagattctagatgagccccgttacaggagtgtatttgca

SEQ ID NO: 254903 - DNA, 409 bp, Homo sapiens
actgttttcatacttcaatggcagggttgagtaggaatgacataccacatgaaaaagccctgtacagaaaatgcttgccaatccctgctttataccataaccagaatgccctaatactcaaatctaatcatgtgactccccactccaatgaatccctacagtaaacattgctgtctccctacccaatagtgagtccctgctctgtcttgctggaggaacacatgtctatttggatatttgccatgccaatatccctaccaacccaaaagaagaaatgattatcctaagctcatcatagtaattacatttgcttccccagtgcctggtttaggaatgagcatgtggtaggacccagccaataaaatgttacaggaagtcaactgcacgtttccgagtcttctccctaact

SEQ ID NO: 254904 - DNA, 321 bp, Homo sapiens
ctaaatcccaaacacagtatttttccacacttctttattttctgaaatacacaaggctgttcaccctggcctggggagggttgtggagcctgtgttgttggagcaaaggttgttaactattctgagtgttatctcttttttctatctatcacatatacattgaaacgcttccatccttttcctcaagccaatgcccccactctccgaggagactctgctctgagttcggtgtgtggagttgggtgacgtttggaaagacagcatgctacacataatgtaaatgtaactacttatgtttccagaaataaacttcagtatttt

SEQ ID NO: 254905 - DNA, 288 bp, Homo sapiens
gaggcaaggaaacagagtaagacagaagataggaacagagagagagagagagagacagagagacgcagaaaaagaaagagagagacagacagacagaaaaagacagagacggacagagagagacagagaaacagagagaaagagagaaagacagagagagcgagagagggagagagagagaaacagaaaggcagggagagagacagagagagacagacagatagacaggcagagaaagagagtaagacagaagataggcacagagagagagacagagagacacagaaa

SEQ ID NO: 254906 - DNA, 233 bp, Homo sapiens
gttggagagtttggccagattctggggctaggaagaaaaactgctaagtccactgtaaggaacaaaccccttttcattctaaaggcagtgacaataacatggttagatttcccaagaatggaattcagaaaattcacaagatttagaaattggacagaaggttcatgattcaaagaactggcttgacattatacttcttttgaaaaaagtctattttattaaatatgcttatg

SEQ ID NO: 254907 - DNA, 2144 bp, Homo sapiens
  misc_feature (1114)..(1114): n is a, c, g, or t
  misc_feature (1484)..(1484): n is a, c, g, or t
cccagaagatggaagccaatgccagctcagcaaaacaacagatgagtggtccagcctgagtagaggatctcaggccaggaagacttagttttttccatcatattagtcactcatttatcatccaaattctgaaagtgctgttaataaggcagaagttggccttagattcggatttcctagcacatgctgtccccctgtactgggaggtgctggctgtgttctaggcctgcctcatgggtatcattctggattcttgggccttccctgtccctcatcctgggaaccgcttttgttgcgttgcatgtttttctcttttttggttcagttccttgttttaagcagtggatctttcagtagctttctgaggaagagtctgtgggagttaaatttctcacatccttgtatgtttgtaatcgcttcattctaccctgattttttagagatagctgagctgggtacccttattctttagagatagttgagctgggtataaattcacgactggaaatagttcccctcaccatttcaaagacatttttctatttttatcttgcttcccatgttgaagacattcaacattgtgattccaaaatcattgtaggagacctgcttttttatctctggaaacttttaggatcttctcattatccctagatctggaattccgtgtgtgtgtgtgtgtgttctcatcatgctgggtatctgcagagggaggctttgattttgaagcaaatttccttcattcttggaagctctacttgtagcacaacttggataacttctcttgtgaatttcatgttttccctggaacttgggctagttccatggcccctggtgtgtgtgtctttttttctgttaatatttgcttattttgttcaacttatggagagattttctctacttttatcttctaaccccttctgttttcttgaattttaaaattttctgctgtcatttaaaaaaattgtccaccagctgcggtggctcacgtctgtagtcccagcaatttgggagcctgatgcgggtagatcacttgaacccaggagttcaaaaccagcctgggcaacatagcaagaccctgtctctacaaaaagatacaaaaattagccaggcntgagccactgcgccaggcctcattttagctttctgcagctccctctctcttcccggtcccccctccttctgcttgctggtgctgtgcccttcctctggttagaactccttaggcgtctggggaccctgaatgaagggaaccttatcaagccgatgggagctctgtgcactcatgagtgtttgtcatagcgggtgggcaggaaggttttgttagggggctgcccagattctgcaagactcacatccttggggatatagtaccagcatctggcgtttgggaagagggctgggctatcaccctttggggggcctgtccaacctcctccctgcgctcagtgtctttcagtctggagcctctctctagggtgaanctcccagctcctgccagctgggccaccctcagcctgttcagtgttgaggtctccctcagccctgcctctggaggtgcttggggcctctccagcacgagccttggcaggattctcttaggaaaaccacctcctcctcgtgggtatcacctcctcctaggagatcaaagcccgttcctgcacgttcatcccggcatctctccggaaatgccacggtctcccactgccgccctcccctttcccattctttgtgtccttcagggttgacacctgcgtccctcctttgctgtggttgcaggagggtcttgtgcatgagcgggcgcaggtgcatgtgctcagctgtcttgtgtcacccaaagtcagctagaaatgggagacccaggccagagacagtggctcacgcctgtaatcccagcactttgggaggctgaggtgggcggatcacctgaggtcgggagttcgagaccagcctgaccaacatggagaaaccccatctctactgaaaatacagaattagccgggcatggtggcgcatgtctgtaatcccagctacttgggaggccgaggcaggagaatcacttgaacccgggaggcggaggttgcggcgagccaagatcatgccattgcactccagcctgggcatcgacagtgaaactctgtctc

SEQ ID NO: 254908 - DNA, 1349 bp, Homo sapiens
tcagacaagcttcttagtttgccatgagtgacacttttgcctgccctggtgtctctgccaaaaatatgaagggtttcagaacccccaccccggcctgcttccctcccagacttggagtgggtctggggctgacaacagtctcatgccagatagcctgagcagccaccagtgccatcaggtctgacactgcggcccctgccccggagggaaaaacaaggccctctctgggggattttctgccagcttgtgaaaacaggcctggagtcagccagcgcccccatgcttagacacttcgtgtggttttcaaagtgcttttatgttgctagctcatatgatcttccccaaaaccccataagggagggcaggaagtttgagcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtgggacaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcaatggcacgatctcggctcactctaacctccgcctcccgggttcaagcgattcccctgcctcagcctcccgagtagctaggattacaggcacccaccaccacgcctggctaattttttgtatttttagtagagacagggtttcactatgttggccaggctggtctcaaactcctgacctcgtgatctgcctacctcggcctcccaaagtggtgggattacaggcatgagccactgcacccagccaactagtctt

SEQ ID NO: 254909 - DNA, 1164 bp, Homo sapiens
agcgtatgatgctgagaagaattgacaaaaacaagaaaaaagaaaaaagaaaaacagtaaagtttaagaaagtaaacaatcagccagcgcccccatgcttagacacttcgtgtggttttcaaagtgcttttatgttgctagctcatatgatcttccccaaaaccccataagggagggcaggaagtttgagcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtgggacaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcaatggcacgatctcggctcactctaacctccgcctcccgggttcaagcgattcccctgcctcagcctcccgagtagctaggattacaggcacccaccaccacgcctggctaattttttgtatttttagtagagacagggtttcactatgttggccaggctggtctcaaactcctgacctcgtgatctgcctacctcggcctcccaaagtggtgggattacaggcatgagccactgcacccagccaactagtctt

SEQ ID NO: 254910 - DNA, 649 bp, Homo sapiens
aagttaaaaattcatttgattaaaaaaaacatttattatctactccatgccaggccccttgacaggttatgagatcacaaagtccagttggatcttgttgaggtacagcctgagaggagaacatgaataggctggaatttccttcattgtgttcgttctctgaggatgacttatctgtcctccaaagtgaccacctcccacggatcgagagcctgttactttctactatccctgcagctgtgctttccacaggacagttcgcctttccttcctttcctctgtggattcttccatctgattttcagccgaatgtaggtagattctgcatctaaaagaaatctttgtttttcctttttctttttttttaatacatgatttaaaaggcgaaagatttatatgatctgaagagaaaccagagtagaaagacatgatttaaaattaactttttcttaattgttgaaatagtttatgcttattggtaaatacttggaagatctataagagtataaataataaacataaaaattacctataattctacaactttgagatcacagttgttaacgtctttgcttctagtctgtttgaacttcctgtctgctttttgtctcctatcagccagtcatgcttggcagcgcttacaaaacac

SEQ ID NO: 254911 - DNA, 297 bp, Homo sapiens
gaactaaaaggaaactaaaaacccgcatgacacagttaactttggggcttaagatgagataaggagtgatggcgcttgccagtaatcccagctattccagaggtcgagctggaaggatcccttgagccgagtgcgaggctgcattgaactattaccacaccactgcactccagcctgggcaacagagtgagacctcatctctggacaagtgttatttgtgacagcacaatgtttgatacaacccaaatgttgaatgaaagtggaccagctaaataaaccatgaacatttactcaatg

SEQ ID NO: 254912 - DNA, 501 bp, Homo sapiens
aaaatagtgcttatattttctttagtggcctgtgcacattattcactgaggccatatagaagtaataccccacattcttatagtacatcctctgattgaagcttaccagcctatagagtagatgaaacacaaaatcttctaactgagaagctcactggagaccacccgggctactgtttctcaaactgggatttggagactccaaagaattgatagaccattcttggggggatctagggcttgtcctaggagactttatgttttccctttccattttgatgtctcttgatttcagggtccatgtttgcatttctgtttaaaatcacatcgaggccgaatgaactcttaaagtcacagcatttaacttttaatctagtttctgaaactgtggtgtgggaatccctgagggttattcagatcgctggggacagtaactggggacgcaacatctagcaagacactttattttctgtgctcatattttaatggggtacaggtaga

SEQ ID NO: 254913 - DNA, 337 bp, Homo sapiens
atacctgctgtaaatatctggaaaatactgtttccctgggtcagtgtacagagccctagaatcagctgttttttgtcatgcacacacatttatcagttataaatgtagatttagaagcaataattaaaactgtaaagcatccacttggaggactagatattccaaaatgttctttgctatgctttcagaaagaattttttaacaaggctataaagtgctgtgtgtgtgtgtatgtgttttatatatgtgtagtggtgaaatgaaaaatgtttcctcacttataaatgtttccacggctgttaggtgggtagaccttaataaagaagcatgaaagaga

SEQ ID NO: 254914 - DNA, 401 bp, Homo sapiens
cctgctttgaccccttattctcttttattactgctcatttctctgctacccttcatagcaaaacttctcaaaagagttgtctaaattaaatgatttcacttccctgtggcccatttcctcaacccactccaaagaagtctctgtctccacccctcctctgaaactgcagttgtccaggtcaccagtgatttcatgttgccaatacagtggtcacctctagtccttcttttcctcaacctcccaatattggacatagctgatttgtctctataccaagaaatacttggttctcttgtttctaggacagtatatgttttttttcctgccttaatgattgttgcttcttggtcctctttgttggcttccccttgtttgcatctattaagttgctttcagctgca

SEQ ID NO: 254915 - DNA, 229 bp, Homo sapiens
tttgtggtgagagcctctccttgtatcatagtaagtttagtatcacccttggcctctaccaactagatgccagtagcacccctccagctgtgacaaccagtccctagacatgccacataccctgcaagggtgggggaagcaaaatcatccctggtggagaacaagtaaaggaaacagcatgtgcaacagcatggagacaaatagtacagggcaggagaaggatttggtt

SEQ ID NO: 254916 - DNA, 484 bp, Homo sapiens
gaggggatttacattctgtagaggatccctttcccttccccggtgtttttctgatcctgaagagattagctaagagtctagtaccttttattaaaggtctgaataggaaatatttgctatctgttgcctctaagggcagccacctatgagacttcatctacataagaacctaggtctctacaaccccttatcttaacccagactctcctttcaattaatttcagccttttagataataactctttcagccaattgccgatcagaaaatctttgaatccacctgtgacctgtaagcttctgcctttccaggccaaatcaatgtatacttcacatgtgtcggttgatgtcttatgtctccctaaaacatataaaaacaagagcctttaacccaactaccttgggcttgtattctcaggacctcctgaggctgtgtcctgggtcatgatccttaaccttggaaaaataaatctctaaattgaaaaga

SEQ ID NO: 254917 - DNA, 1005 bp, Homo sapiens
actagaggatacagtcccttctctaaatccttcctttttctctttctgagacaggttttgatctgtcacacagtgctggagtgcagtggcatgatcacaactaactgcagcctcaaactcctgggctcaagtgatcctctcacctcagcctcccaagtagctgggaccacagccacaagccaccacccttggctaattgtttttattttttgtagcgatgggagtctcgatatgttgtccaggttggtcgcaaactcctgggctcaagtggtgatcctcccacttcagcctcccaaagttctgggattacaagcatgagccatcacgcctgaccaagtgatgtcttaaaaattctaaggaaaatagtttcaatctactctgctctactcagcaaaatagcaaacgtcaaggtaaagataatttcagacacacggggactcagatttacctctcacgcattagttcttagatcatttttggaatgtgatctccattttggagaaataggaagacgtggacctacctggctgacaagagcgctgccacaggccaccaggagggccatgctagggcaatcgtgacagtcaagccacactgagcaagatggtggagagtccttagaggaagtcaagggaaaaacggaacaggagattagctgagagttttgtacatttgaaaaataacactgataggcctcagccaagtctaatacagcatggggacaagtttaaggtagataaacagaaaactaagcaaaggtggcggggcggaaagaaacaattgtccatcccaggaaaaacagccaggctttactgagaaagggaaccatcagccttagtacaaagtcataatgaacactgactatagtttcatcagcaaattgccatctaattgcatagaaagtccattggaaaggaagagtgagaggtatagagacctgaggcctcatctgctgtcgtaggaagctgcagttactccccaaaatcaagaaatcaagaatattta

SEQ ID NO: 254918 - DNA, 499 bp, Homo sapiens
gcatgcacagagctgccctcccttgtgtccaagcaccaccctccccttgctgggctaactcaatggactcccataggcaggtcttgaaaggcaaatcctagggactgagggctcccaggaaaaatcacccatgtaggctttccggggatttatatacccttgtccaaaggaggcatgcccacacaggtaagaaaatttgtagtgaggatgtggcttttcctctttttatattcagagcttctactgctacagagcccaactattcattttgccttgaaaaacctccaacgtatttttcctcacaacatttcttttagcttccaagccttttcatttcccagtgggctcttcaaattccctcctgcctcagaagcatccctctgcaccaaaaagctcttgctctttcaggattgaagacaagcctttccttaagagtttgtgtgttcttccttacttggaaaaatacattatttccaaaattatctatctgttggttaaa

SEQ ID NO: 254919 - DNA, 663 bp, Homo sapiens
tggccaatgggcaccatacgttgagtagcagtagtctagatgattagcgtctccaaatctggctcctgcctttatttagtcttggttcctctcaaatccaccctccccaaacctctttgggttcacatgcaaatagaatcttaaacccaatactggcctcccattcccctcaggatagaggtcttggtgtggcttgcaaggcattgccataatcttcagctttgtcttttacactactttacgcctctgatcaatggtccatccatatcgaacctcttagctcccttaattctccaacctacttacactgttatgctaaactcttactcttcctactgtctggaaaaccctgctataatcttgtctttctgatgagcacctgctggcattttaattctgccttagagggcagaattgtatttccacaattctggttcatattataatgcccaaaacacagtatgagcttaataaatatttgtgaaattaatatggtacccaataaataattaaagcactcttctgtaaacattatagcacttaaagagcaatcatattttaaagatattttagtctgttgtcctcaagggaatgtgtccatttctacttctttggaagtggtcaattaaactacctgcttgtactgcctcgaagttgtttttt

SEQ ID NO: 254920 - DNA, 427 bp, Homo sapiens
acattggtatgatttatattcctaaactggttacttacaattgcttctctcagtaggaatactgctctgtcagattccttgcaagttttcagcatgcttgtagagtgcacaagcaaatgcctaggaagattttctaacatattttgttgatagcccattagctaacattttaaaacacaacttcaaagtgtttataatatttgaaatttagtaaaattagcatatctgttttggtttggatacattattctaattattgttggacaacctagttcatgattttatttgtccaaaaatggcttgtttggttttaaaaaaattaatgtgttatgagatcttgatgttattttttaaaaaacccaaaaaagaaattacttttcatttaaagagaatctgcttcctgcttaagtggctaatattttaatta

SEQ ID NO: 254921 - DNA, 389 bp, Homo sapiens
gctgttggctacgaccgcggtcacttcacttcagccctactcctggcctggggaaatgggcaggccccctagtagctcggggtggggagacgggtggagaggaaggaggggcgaaaagggaaggcgcgaaatctacaaatgtttaagccagctggaactccgatgcctctttgccttttagggaaattgactcgactcggaactcgaggacctttcacaagagaccactgggttagggggcagagctggtaatagaatccagcgctccgaaccctgaatcatgtcctctttttgctgctgaggctcaggccacagcaccccaaattatgactgtagaataccaaaatatgctatcccaaaatacacttgtttggcacatttcaagctgg

SEQ ID NO: 254922 - DNA, 176 bp, Homo sapiens
ccgcgctgtgaggactcaatccaagaaagagaggacaaaggaaaaaacccatcaaactagggtcagcaaagcctattacatacacaggataaaagaatacgatttgatcttcatttctcaacacaaaagttgacatatattgcatacaatacattaaaaatgttgacaattgagaa

SEQ ID NO: 254923 - DNA, 261 bp, Homo sapiens
tcatctgtctcttcttccctgtgtgcagggagctatgaaggagcccacttaggaagccaggatttaaggtgacaggagcatattgcaggtggggctccacctgccgggcagtgacggctgggggtcaccccgaaatctctgcactcagggctgtcagacggacgttacgcggtatgtgaactagagacactaagagcctattattctgttttgcattttaaaggaggtctctgaggaccagctgatgctttcaaaccactt

SEQ ID NO: 254924 - DNA, 6846 bp, Homo sapiens
  misc_feature (636)..(636): n is a, c, g, or t
  misc_feature (651)..(651): n is a, c, g, or t
ctgtgcaacggggtcaacgactgtggtgacaacagcgacgaaagcccacagcagaattgccggccccggacgggtgaggagaactgcaatgttaacaacggtggctgtgcccagaagtgccagatggtgcggggggcagtgcagtgtacctgccacacaggctaccggctcacagaggatgggcacacgtgccaagatgtgaatgaatgtgccgaggaggggtattgcagccagggctgcaccaacagcgaaggggctttccaatgctggtgtgaaacaggctatgaactacggcccgaccggcgcagctgcaaggctctggggccagagcctgtgctgctgttcgccaatcgcatcgacatccggcaggtgctgccacaccgctctgagtacacactgctgcttaacaacctggagaatgccattgcccttgatttccaccaccgccgcgagcttgtcttctggtcagatgtcaccctggaccggatcctccgtgccaacctcaacggcagcaacgtggaggaggttgtgtctactgggctggagagcccagggggcctggctgtggattgggtccatgacaaactctactggaccgactcaggcacctcgaggattgaggtggccaatctgganggggcccaccggaangtgttgctgtggcagaacctggagaagccccgggccattgccttgcatcccatggagggtaccatttactggacagactggggcaacaccccccgtattgaggcctccagcatggatggctctggacgccgcatcattgccgatacccatctcttctggcccaatggcctcaccatcgactatgccgggcgccgtatgtactgggtggatgctaagcaccatgtcatcgagagggccaatctggatgggagtcaccgtaaggctgtcattagccagggcctcccgcatcccttcgccatcacagtgtttgaagacagcctgtactggacagactggcacaccaagagcatcaatagcgctaacaaatttacggggaagaaccaggaaatcattcgcaacaaactccacttccctatggacatccacaccttgcacccccagcgccaacctgcagggaaaaaccgctgtggggacaacaacggaggctgcacgcacctgtgtctgcccagtggccagaactacacctgtgcctgccccactggcttccgcaagatcagcagccacgcctgtgcccagagtcttgacaagttcctgctttttgcccgaaggatggacatccgtcgaatcagctttgacacagaggacctgtctgatgatgtcatcccactggctgacgtgcgcagtgctgtggcccttgactgggactcccgggatgaccacgtgtactggacagatgtcagcactgataccatcagcagggccaagtgggatggaacaggacaggaggtggtagtggataccagtttggagagcccagctggcctggccattgattgggtcaccaacaaactgtactggacagatgcaggtacagaccggattgaagtagccaacacagatggcagcatgagaacagtactcatctgggagaaccttgatcgtcctcgggacatcgtggtggaacccatgggcgggtacatgtattggactgactggggtgcgagccccaagattgaacgagctggcatggatgcctcaggccgccaagtcattatctcttctaatctgacctggcctaatgggttagctattgattatgggtcccagcgtctatactgggctgacgccggcatgaagacaattgaatttgctggactggatggcagtaagaggaaggtgctgattggaagccagctcccccacccatttgggctgaccctctatggagagcgcatctattggactgactggcagaccaagagcatacagagcgctgaccggctgacagggctggaccgggagactctgcaggagaacctggaaaacctaatggacatccatgtcttccaccgccgccggcccccagtgtctacaccatgtgctatggagaatggcggctgtagccacctgtgtcttaggtccccaaatccaagcggattcagctgtacctgccccacaggcatcaacctgctgtctgatggcaagacctgctcaccaggcatgaacagtttcctcatcttcgccaggaggatagacattcgcatggtctccctggacatcccttattttgctgatgtggtggtaccaatcaacattaccatgaagaacaccattgccgttggagtagacccccaggaaggaaaggtgtactggtctgacagcacactgcacaggatcagtcgtgccaatctggatggctcacagcatgaggacatcatcaccacagggctacagaccacagatgggctcgcggttgatgccattggccggaaagtatactggacagacacgggaacaaaccggattgaagtgggcaacctggacgggtccatgcggaaagtgttggtgtggcagaaccttgacagtccccgggccatcgtactgtaccatgagatggggtttatgtactggacagactggggggagaatgccaagttagagcggtccggaatggatggctcagaccgcgcggtgctcatcaacaacaacctaggatggcccaatggactgactgtggacaaggccagctcccaactgctatgggccgatgcccacaccgagcgaattgaggctgctgacctgaatggtgccaatcggcatacattggtgtcaccggtgcagcacccatatggcctcaccctgctcgactcctatatctactggactgactggcagactcggagcatccaccgtgctgacaagggtactggcagcaatgtcatcctcgtgaggtccaacctgccaggcctcatggacatgcaggctgtggaccgggcacagccactaggttttaacaagtgcggctcgagaaatggcggctgctcccacctctgcttgcctcggccttctggcttctcctgtgcctgccccactggcatccagctgaagggagatgggaagacctgtgatccctctcctgagacctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacagacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagatggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttggtaacatgaaaaagctctggggggtagttggatctgggtgtctggtccattgctggcagtggacattattcttgccctaagagacactgccttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggggagaatttctaggggaagtttcctgagttgaaacttctcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcatgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatc

SEQ ID NO: 254925 - DNA, 5193 bp, Homo sapiens
  misc_feature (1)..(1): n is a, c, g, or t
  misc_feature (32)..(32): n is a, c, g, or t
ncgtctctagaggaccccttaaagctccttcnttacgtatgccaagtcattatctcttctaatctgacctggcctaatgggttagctattgattatgggtcccagcgtctatactgggctgacgccggcatgaagacaattgaatttgctggactggatggcagtaagaggaaggtgctgattggaagccagctcccccacccatttgggctgaccctctatggagagcgcatctattggactgactggcagaccaagagcatacagagcgctgaccggctgacagggctggaccgggagactctgcaggagaacctggaaaacctaatggacatccatgtcttccaccgccgccggcccccagtgtctacaccatgtgctatggagaatggcggctgtagccacctgtgtcttaggtccccaaatccaagcggattcagctgtacctgccccacaggcatcaacctgctgtctgatggcaagacctgctcaccaggcatgaacagtttcctcatcttcgccaggaggatagacattcgcatggtctccctggacatcccttattttgctgatgtggtggtaccaatcaacattaccatgaagaacaccattgccgttggagtagacccccaggaaggaaaggtgtactggtctgacagcacactgcacaggatcagtcgtgccaatctggatggctcacagcatgaggacatcatcaccacagggctacagaccacagatgggctcgcggttgatgccattggccggaaagtatactggacagacacgggaacaaaccggattgaagtgggcaacctggacgggtccatgcggaaagtgttggtgtggcagaaccttgacagtccccgggccatcgtactgtaccatgagatggggtttatgtactggacagactggggggagaatgccaagttagagcggtccggaatggatggctcagaccgcgcggtgctcatcaacaacaacctaggatggcccaatggactgactgtggacaaggccagctcccaactgctatgggccgatgcccacaccgagcgaattgaggctgctgacctgaatggtgccaatcggcatacattggtgtcaccggtgcagcacccatatggcctcaccctgctcgactcctatatctactggactgactggcagactcggagcatccaccgtgctgacaagggtactggcagcaatgtcatcctcgtgaggtccaacctgccaggcctcatggacatgcaggctgtggaccgggcacagccactaggttttaacaagtgcggctcgagaaatggcggctgctcccacctctgcttgcctcggccttctggcttctcctgtgcctgccccactggcatccagctgaagggagatgggaagacctgtgatccctctcctgagacctacctgctcttctccagccgtggctccatccggcgtatctcactggacaccagtgaccacaccgatgtgcatgtccctgttcctgagctcaacaatgtcatctccctggactatgacagcgtggatggaaaggtctattacacagatgtgttcctggatgttatcaggcgagcagacctgaacggcagcaacatggagacagtgatcgggcgagggctgaagaccactgacgggctggcagtggactgggtggccaggaacctgtactggacagacacaggtcgaaataccattgaggcgtccaggctggatggttcctgccgcaaagtactgatcaacaatagcctggatgagccccgggccattgctgttttccccaggaaggggtacctcttctggacagactggggccacattgccaagatcgaacgggcaaacttggatggttctgagcggaaggtcctcatcaacacagacctgggttggcccaatggccttaccctggactatgatacccgcaggatctactgggtggatgcgcatctggaccggatcgagagtgctgacctcaatgggaaactgcggcaggtcttggtcggccatgtgtcccacccctttgccctcacacagcaagacaggtggatctactggacagactggcagaccaagtcaatccagcgtgttgacaaatactcaggccggaacaaggagacagtgctggcaaatgtggaaggactcatggatatcatcgtggtttcccctcagcggcagacagggaccaatgcctgtggtgtgaacaatggtggctgcacccacctctgctttgccagagcctcggacttcgtatgtgcctgtcctgacgaacctgatagccagccctgctcccttgtgcctggcctggtaccaccagctcctagggctactggcatgagtgaaaagagcccagtgctacccaacacaccacctaccaccttgtattcttcaaccacccggacccgcacgtctctggaggaggtggaaggaagatgctctgaaagggatgccaggctgggcctctgtgcacgttccaatgacgctgttcctgctgctccaggggaaggacttcatatcagctacgccattggtggactcctcagtattctgctgattttggtggtgattgcagctttgatgctgtacagacacaaaaaatccaagttcactgatcctggaatggggaacctcacctacagcaacccctcctaccgaacatccacacaggaagtgaagattgaagcaatccccaaaccagccatgtacaaccagctgtgctataagaaagagggagggcctgaccataactacaccaaggagaagatcaagatcgtagagggaatctgcctcctgtctggggatgatgctgagtgggatgacctcaagcaactgcgaagctcacgggggggcctcctccgggatcatgtatgcatgaagacagacacggtgtccatccaggccagctctggctccctggatgacacagagatggagcagctgttacaggaagagcagtctgagtgtagcagcgtccatactgcagccactccagaaagacgaggctctctgccagacacgggctggaaacatgaacgcaagctctcctcagagagccaggtctaaatgcccacattctcttccctgcctgcctgttccttctcctttatggacgtctagtccttgtgctcgcttacaccgcaggccccgcttctgtgtgcttgtcctcctcctcctcccaccccataactgttcctaagccttcaccggagctgtttaccacgtgagtccataactacctgtgcacaagaaatgatggcacatcacgagaatttagacctggattttaccatgaacctcacatcttgtactccatcctgggccccctgaaactgcttattcgtgattcctcaccagcgtagagctccacctcccctttccccagtaccctcagtgcctgcttctcagtgctgatgcagctgatgacccaggactgcgctctgccccatcacagccagcatgactgcttctctgagagaacttgcccatcaggggctgggacatgggggtgtgggtaaagacagggatgaaggatagaggctgagagaagaaggaagaatcagcccagcaggtatgggcatctgggaaacctccagcctcaagtgtgttggtaacatgaaaaagctctggggggtagttggatctgggtgtctggtccattgctggcagtggacattattcttgccctaagagacactgccttttcagcagcagatactggtgagatgggggtggctcaggctgttcttcctcctcctagaatgtctggagctgtttctacattcagataactgggtcccctatcacaaggctactggctaataggaattccctcctggtgccaccactggccagtacctttcctaagtctttgctcaaattaaccaggttgtgagccagtggcttgagtgaatgttaggccttgggggctgagtctctgaaaagtctaagaagctctgcctagaccaaatatggtatacctcctgacccctctctccctcatgtcctgggattctggggaagagacctagaaacaagctttcaaagaaaaaccagaagttgtcataaatggtcagaaagaacgatcaggttggagacttgggaaacccagggcctaaagagaagtatccatgagggtcaaacttcctgttgaacttcctatgttctttctcaagtgctcagggatctaagttagtggacagcaagcctgtggctacggggtggtgatgttcctcttccagctgtcccctcagctaaggggcttagtttccatgtgggatgccatcacttggttcatgctcattcacacaaagggcacgtgtctcagcctggtatcagggaaattgagacttatttttgccctaaaacgtctccctagctgttcttcgtggggtttttttgtttgtttttttgcctaatttgctttttctgaccaagccttgtggcaccagcaatctccaaagtcctgtggtgggagggctgaataaataaaaatacaaagaggtgggtaaggagtaggaaggtagagagcaccactgatgaggccctcctagcccatggcagacccagacctcttctcccccaggaattagaagtggcaggagagaacaacaggggctgggaatggaggggagaatttctaggggaagtttcctgagttgaaacttctcctgtggttactggtattgagaaatcagctaccaaagtgaaaaaggacaagatcaattcttttctagtcagttctaagactgctagagagagataccaggcccttagccttgctctcagtagcgtcagccccagttctgagcctccccacattacacttaacaagcagtaaaggagtgagcactttgggtccttagactcatgtctggggaggaagagcaagtagaaaagtggcattttcttgattggaaagggggaaggatcttattgcacttgggctgttcagaatgtagaaaggacatatttgaggaagtatctatttgagcactgatttactctgtaaaaagcaaaatctctctgtcctaaactaatggaagcgattctcccatgctcatgtgtaatggttttaacgttactcactggagagattggactttctggagttatttaaccactatgttcagtattttaggactttatgataatttaatataaatttagcttttcttaatc

SEQ ID NO: 254926 - DNA, 650 bp, Homo sapiens
  misc_feature (1)..(1): n is a, c, g, or t
  misc_feature (32)..(32): n is a, c, g, or t
ncgtctctagaggaccccttaaagctccttcnttacgtatgccaagtcattatctcttctaatctgacctggcctaatgggttagctattgattatgggtcccagcgtctatactgggctgacgccggcatgaagacaattgaatttgctggactggatggcagtaagaggaaggtgctgattggaagccagctcccccacccatttgggctgaccctctatggagagcgcatctattggactgactggcagaccaagagcatacagagcgctgaccggctgacagggctggaccgggagactctgcaggagaacctggaaaacctaatggacatccatgtcttccaccgccgccggcccccagtgtctacaccatgtgctatggagaatggcggctgtagccacctgtgtcttaggtccccaaatccaagcggattcagctgtacctgccccacaggcatcaacctgctgtctgatggcaagacctgctcaccaggtgagtgaaagcatcacagatctagatgcagcctctctgggagggggcaatggctctcttccttccttgcagatgggctccaatgtggtctgagaaaccatgagtcctgctgcttctagaggcccaggggagagactcacggcttttagaaaag

SEQ ID NO: 254927 - DNA, 277 bp, Homo sapiens
caacggcagcaacgtggaggaggttgtgtctactgggctggagagcccaggtagggaacaaggccccatggagaggggcagagccatgccacatgcgcagcaacggtgggaggaataggccagtggtttgcaaaccttaggcagcaggacatctttttcttccagggaaatcttagttggagccctaatatagaaaacatttgttaatgtatatcaattttataggttcaaatataacatttgctcatgattgagctcaatcagtgagaataatgag

SEQ ID NO: 254928 - DNA, 506 bp, Homo sapiens
ttggtcaggctggtcttgaactcctgacctcatgatccacttgcctcggcctctcaaagtgctgggattacaggcgtgagccaccacgcccggctgaatatttttattttaaaaaaaatctttgggtgttaggttcagaaatctgtgttttaacaagctctcctgattcttacgcacactaaagtttgagaatcatcgccttaaattatggttgcctatgtttgggaagtcttgctctttcaagaaatccaactgatcacatccttgaatttcttcttgcagttcaagtcactaaatttccgttgtgcatctgtcacaaaatatcttttgagcccctactctgtgctctgctggcgcataccaggctcttgtgttggccatggaaggtaagagggtgaatgaacaagactagaattaatctctgtatcccttcttgataggtacagaccggattgaagtagccaacacagatggcagcatgagaacagtactcatctgggagaacc

SEQ ID NO: 254929 - DNA, 184 bp, Homo sapiens
ctggcatggatgcctcaggccgccaagtcattatctcttctaatctgacctggcctaatgggttagctattgattatgggtcccagcgtctatactgggctgacgccggcatgaagacaattgaatttgctggactggatggcagtaagaggaaggtaagggtggcagtaagaggaaggtaagg

SEQ ID NO: 254930 - DNA, 460 bp, Homo sapiens
ccttcatctcttgtcctcctgcccccgtccctgccccccaggagccttggtagaggttttgtgtagttgccaggcctgggcccaggggacatggcagaccacgtccagactgaggtcttcctggactttccccaggcctcccgcatcccttcgccatcacagtgtttgaagacagcctgtactggacagactggcacaccaagagcatcaatagcgctaacaaatttacggggaagaaccaggaaatcattcgcaacaaactccacttccctatggacatccacaccttgcacccccagcgccaacctgcaggtaaaaaactgcccaccgggtgagccaaagtagcctcatggttgaggtggcctctggtgcctctgagaaccttccttccccttagagttgccatttcttctgatggggaaatccagcagggcactgacatgggctaattcctccctct

SEQ ID NO: 254931 - DNA, 584 bp, Homo sapiens
acagaagggagatctcttgacctgcctggtgttcccagatgtgaatgaatgtgccgaggaggggtattgcagccagggctgcaccaacagcgaaggggctttccaatgctggtgtgaaacaggctatgaactacggcccgaccggcgcagctgcaaggctctgggtaagggctgttggcacttggctgggtgggcagagggccgagcatggaggaaggccaggtactctggtgctcagggatttgcagagaggtagagagatttctgtcacagtaaaatgcagcaacagttgcattctgagccccaagaaaaatgctgctggggtggagtggggtggggaggggtggaggaatatagtttaaaggttgccactcttctggtactgatgctgacagcttggggcatgtccttgtgagcaagtggctccatcggtcagctgaagacctgctgatgggtaccaggggcggctctgaaacccagtgggtatcccatgtttatactgtttcccagggccagagcctgtgctgctgttcgccaatcgcatcgacatccggcaggtgctgccacaccgctctgagtacaca

SEQ ID NO: 254932 - DNA, 642 bp, Homo sapiens
agagacctaaatttgaaaagcaatactttaaaatatttagaagaaatatctaaaaaaatagacttgttgatttgagaaaacaaaatatttctttaaaatgattttttatttaaaaagcaagcacaaattattaaaatattgattactttgcttataatgacataatttacatatatttgtgcttataaataaaggacaagctacagacaggaagacacatttccaaaaatcacaaaaactaggtttgcaattgagaacttgaaaaaatttctgagtcgattaagaaaaaaacaaaaggtaaatcatacattgcaaatattataattagacagttaacagtaaagaaaaacaaatagtcaataaatgtattatgctgaaatttattactaattttactaatcaggtatcatttcacacctatcagaaaaaagacctgggcatcttggccagtattatgagaaacaagagaaattcttacttccccatgagaagtttgaataatatagtatatattcaaaagcatgtgttctagaattagtccttttctgtttcaaaactgttataccccttagctttatatgctttgagcaagctacttatcttgctatgagacaatgctctatgtgtctcctgcatttctgc

SEQ ID NO: 254933 - DNA, 425 bp, Homo sapiens
gaaagatagttctccccccaccccccaacacagttttctggcttctgtggtcttccttttattttctatcagatttagaagtcccaagatccccttatgtcctactcaaattaagacttgtttctcttctcctttctgtattgtgctttcaactctgaggccctgttttagctttggtgtttattagctgaataaaaagataaagtgagagagcttagagttttaatagggaacatttcttgaattggattgatttcatcatcaattttactttcttaagtattaactaattactagctgtggattcccaggcaagtccactcactttcttcatctgtaaaatgaactacctactcagcaaggatccttctgtggtatatcagcattccttattattattatttgtttttgttagtagaaccatg

SEQ ID NO: 254934 - DNA, 326 bp, Homo sapiens
cggcacgaggaagtcccaaaggctaagccatttgaagtagaaaaggataaaacataaggcttaggatcattgggagagatatttttttctcctcctttttcccttttctctcccaggaattcttcagtagactcaattgaagccttgagtttgaggttttgtattctcagatggtaagcacacctattaaaaaagcaatgtattcatgttaactccctggcaccagcagggcctgtgtattcactgctagcagtggacaccatgccaggagaacctgactcctggtgcaaaaggattaggaaaaaaaaaaaagtcaaacaatgcca

SEQ ID NO: 254935 - DNA, 658 bp, Homo sapiens
ctgccccccagccccccagtctggccagtcgcaactatcctcaggcatattgctgaaggaatgatgcttgcttgctgcagataggtcccctttggtgaaaggggggagtagccaagtgagatagtgctacccccgtgcctgagtccagcagttctgcagagccatgctgctgccccacccaaggcctgctgggcagtgtccctgggagtggtaggcagagggacacccagtgctgagtccagggtctggtaccggatagtgggggctagggcagtacatgtggggtatggggtggtgggggttgcaaccctcccaaccaacacccactttctccagacgcatgccccatgtcccgacacaggccagcacacttagctggtttctatctccaccctctctttttcattcccttgacacgtgtgtgttgcttttggtcttactgaagagtcttcccattcatgtatcaatattttgaaactcttagtggatatcttattaaaagagagggggaaaatcacctatgaatctctggtgcaatagagtagcctcagtcttcttgatataagttatttgttaattctagaatcattattagatcatgcttatgtagttggtgttggccctcttagcccctaattgctcctgccataggcagagt

SEQ ID NO: 254936 - DNA, 508 bp, Homo sapiens
aggctgaagtggggggatcgcttgagcccaggaattcgaggctgcagtgagctatgattgtgccattgtactgcagcctgggtgacagagcaagtccctgtctctacaaaacaacaaccccgcccccaaaccatttgatacagcaggcatgtgaaacaaaagaatatctgtatgttccaaggactcatattctagatgattttaaaaaatttaaggggccgggtgcggtggttcacgcctgtaatcccagcactttgggaggacgaggcaggcagatcacgaggtcaggagatcgagaccatcctgactaacatggtgaaaccccatctctactaaaaatacaaaaaattagccaggtgtggtggtgggcgcctgtagtcccagctactcgggaggctgaggcaggagaatggcatgaaccccggaggcaaagtgtgccagtgagccaagattgcgcccctgaactccagcctgggcgacggagtgatacttgcctccaaaaaaaaaa

SEQ ID NO: 254937 - DNA, 556 bp, Homo sapiens
cttttgcttcacttcacaacccaggaattcctttccctaaaggggaaagtgtgatcatgggagacagtgtttcttggtggttcaggatgggatctctggagacaaactgtttgggttcaagtccagcacggctatttactggctatgtggcttggacgggttaacctgcactgaaaggttttcctgaggtctgtgataatttgtggaaagtgctccattctcatcattacacagcagattacttttgctgtcttctctgttctgtttcacatcccttctcctccacatgtattcctatgccccagctgtgtttaataataaggatagctaatatttactcagcccttactctaagcgcctttcatgtaattaactcatctaatcctcgcgacaaacctatgcaataggtgctgttttattcccattttcaagtgaggaagctagatgctgaatgctaagtaattttcccaacataccatggccaataaatgatgtagcagggattttaaatgaggcattctggcgccagagtctgtgctcttatatttatgcaaaa

SEQ ID NO: 254938 - DNA, 843 bp, Homo sapiens
atttgcagggaattactctttatcctccagcactaaaaactgctttcagtgctgagctctcaagtgaggaagcaggtgctcagagagagtgctatttcctgggctggggctgtgccacccagaaatcgttcttgggtgtcacagtgggtgaggcagacagcgtaggcccaatttcagcctccagctctagggaacagagaccactgccacctatacttctctactcacttgccttgttcgaattcgacggtttctctggcagatgggtgattgggtggggagaggatgatgccacttgcccgggggcttcttgccaggaactgaagaatcaccaggaggaagaacaacaatcggaggaaaaactccagccacataagaagttaaatgtgccgcaaccaccagtggcgaaattgtggacatcacaggagcaaccgtagacttcaaagggtaccgcatctcgagactggctactctctggtcatagcagatagtgtgtgaattgccacaggcacaggtgtggccagggccacagccaccacaaccacagccaccacctcagccaacacaaccaagtgctcaagcccgttgtactcagcacacctccaaatgcaatctccaggattcccaaaggccaggtcaccagcctacttcagcggggatctactaagctggagggcaatctctgtatcaacaacagattccagggtgggcagaaaatccttacagactctggactggagcctgggagtgggaggtggtaaggagaggagccctttgcttccatcccggccctgtagtgtagaatccatatctaccaccctaccctctctgactctcccaagt

SEQ ID NO: 254939 - DNA, 394 bp, Homo sapiens
gagacggagtctcactctgtcgctgaggctggaagtgaaactccatctcaaaaaataaaaaataaaatgaaaataaaattaagaggtagacgctaggcttgagtccagaattagaaatctccagagctagggtgttttctaagaagcccctttgcgttctgggggctcagacctcagtgaggcttagtaggattttgtattttctttcattctgactcagcacagacatttatgggggagatggagagaggagagattaaggagaaaaaggtaattccggagacctaagtggggagagatgagcagaggaagggtcagatgatgatgctggaaccctctatggggtttctccatgtcggtcaggctggtctcgaactcccaacctcaggtgatc

SEQ ID NO: 254940 - DNA, 251 bp, Homo sapiens
cggattcaagcgattctcccatctcagcctcccgagtagctgggattattgacgcgcagcaccacgcccggctaatttttgtggtttttgtatcttctgtcttctgctctttagtaccgcatagagccacagaagactagtgagtcgaacaaacggcccctcttgcagcagttgttgatcacagggctgcccccggtactcatcctgtgatcaacaactgctgcaagaggggccgtttgttggacatacta

SEQ ID NO: 254941 - DNA, 1681 bp, Homo sapiens
tgattaataatagtcagatataatcctatccgtttcctatctctagtaaaacttttcttattctaattattttctttgctgtactggaacagcttgtgccttcaggctcttgcctgggcacctgggtggcttgcggcccacaagataagatatattgcgttgaactataatttatgttgattgctgaatgatttagggcgggggggtgggcaccccctgaaattctgccctggaggagtggcctcaccctaaccctggccgtggctaataataaggcccacctcttagggccgtggagtgaaataagttttccaggtaatgcgcagtagagccctcagccctccgctgaagttgcgttaggaaggaggaagggagaggtaaatgctgagcccgcaggcggcagtctgtgcctcggagagaaactttatcccaaccttgctgggggccttgacgcccaccttgccccaagagcaccccggcagtcacccctgccctctggggtcctgccaccccgagcccgaccttcccccttttcccccgcgccgggccaatagcctcctaactgcgtcgtgctcatcacctttgcgtcgtttcttcgctccacaaacgtttactgagcgccttccacacgccaggcgccagactcgcgcggggaaacagggataagcactgaggaggggtcccagccctcagcgatgggatttcagagcgggagataaagggttgcccagaagggtggtgagtggaatagctgatataaacaacgggggcgcgatgaaatacacaggagggctgctagtcacatatggggcgggtgccgagggcccttgactaagggaggcttcctgcacgggtgacacccaagcggagtcctgacgacctgcgtcagaagtagccaggcgaggaggaggggaaaggaatccacgtcccgagcagagaggcagcgttccctacacagcacaggacacggtccgcgcacagaagccgcaggagacgcaggcacaggggctggggagaatccttgctgggccctcgccgcctccctctgccgggtgtctggtgccagcctcctgcctggcagaggaactccagcccctgctcccggaagcccctccaggccttcggcttccctgactgggcatgggcccctcgtcccctcgggtacggggccggtctccccgccctcgggcggcgaagtaaaggctgagcccactgctcccaccacctctgtctgtccccaccccgacctggggcctcataccatcccactatcatgggtagtgcctaccactgggaggcccggcgccggcagatggctttggaccgaaggagatggctgatggcccagcagcagcaggagctgcagcagaaagaacaggtgcatgggataggctgggttcttcagggtcctctctggagcaggaagggaatggagaatggagagagatccctaggaagctgcctactatttggtgaatgctgtttgctgggggtaggaggaaagcaaggtcatttggcgttctctcagatagactgtgtctgtgttggggggaccactatcagctgactcaatttccctcttgtaatagtctaggggaaggcaagggtactaggcctgggaggtttaaagatgttctgtccaatagggtaacccccagcctgtatgctatattgagccttg

SEQ ID NO: 254942 - DNA, 1904 bp, Homo sapiens
tgattaataatagtcagatataatcctatccgtttcctatctctagtaaaacttttcttattctaattattttctttgctgtactggaacagcttgtgccttcaggctcttgcctgggcacctgggtggcttgcggcccacaagataagatatattgcgttgaactataatttatgttgattgctgaatgatttagggcgggggggtgggcaccccctgaaattctgccctggaggagtggcctcaccctaaccctggccgtggctaataataaggcccacctcttagggccgtggagtgaaataagttttccaggtaatgcgcagtagagccctcagccctccgctgaagttgcgttaggaaggaggaagggagaggtaaatgctgagcccgcaggcggcagtctgtgcctcggagagaaactttatcccaaccttgctgggggccttgacgcccaccttgccccaagagcaccccggcagtcacccctgccctctggggtcctgccaccccgagcccgaccttcccccttttcccccgcgccgggccaatagcctcctaactgcgtcgtgctcatcacctttgcgtcgtttcttcgctccacaaacgtttactgagcgccttccacacgccaggcgccagactcgcgcggggaaacagggataagcactgaggaggggtcccagccctcagcgatgggatttcagagcgggagataaagggttgcccagaagggtggtgagtggaatagctgatataaacaacgggggcgcgatgaaatacacaggagggctgctagtcacatatggggcgggtgccgagggcccttgactaagggaggcttcctgcacgggtgacacccaagcggagtcctgacgacctgcgtcagaagtagccaggcgaggaggaggggaaaggaatccacgtcccgagcagagaggcagcgttccctacacagcacaggacacggtccgcgcacagaagccgcaggagacgcaggcacaggggctggggagaatccttgctgggccctcgccgcctccctctgccgggtgtctggtgccagcctcctgcctggcagaggaactccagcccctgctcccggaagcccctccaggccttcggcttccctgactgggcatgggcccctcgtcccctcgggtacggggccggtctccccgccctcgggcggcgaagtaaaggctgagcccactgctcccaccacctctgtctgtccccaccccgacctggggcctcataccatcccactatcatgggtagtgcctaccactgggaggcccggcgccggcagatggctttggaccgaaggagatggctgatggcccagcagcagcaggagctgcagcagaaagaacaggaactgaagaatcaccaggaggaagaacaacaatcggaggaaaaactccagccacataagaagttaaatgtgccgcaaccaccagtggcgaaattgtggacatcacaggagcaaccgtagacttcaaagggtaccgcatctcgagactggctactctctggtcatagcagatagtgtgtgaattgccacaggcacaggtgtggccagggccacagccaccacaaccacagccaccacctcagccaacacaaccaagtgctcaagcccgttgtactcagcacacctccaaatgcaatctccaggattcccaaaggccaggtcaccagcctacttcagcggggatctactaagctggagggcaatctctgtatcaacaacagattccagggtgggcagaaaatccttacagactctggactggagcctgggagtgggaggtggtaaggagaggagccctttgcttccatcccggccctgtagtgtagaatccatatctaccaccctaccctctctgactctcccaagt

SEQ ID NO: 254943 - DNA, 2318 bp, Homo sapiens
tgattaataatagtcagatataatcctatccgtttcctatctctagtaaaacttttcttattctaattattttctttgctgtactggaacagcttgtgccttcaggctcttgcctgggcacctgggtggcttgcggcccacaagataagatatattgcgttgaactataatttatgttgattgctgaatgatttagggcgggggggtgggcaccccctgaaattctgccctggaggagtggcctcaccctaaccctggccgtggctaataataaggcccacctcttagggccgtggagtgaaataagttttccaggtaatgcgcagtagagccctcagccctccgctgaagttgcgttaggaaggaggaagggagaggtaaatgctgagcccgcaggcggcagtctgtgcctcggagagaaactttatcccaaccttgctgggggccttgacgcccaccttgccccaagagcaccccggcagtcacccctgccctctggggtcctgccaccccgagcccgaccttcccccttttcccccgcgccgggccaatagcctcctaactgcgtcgtgctcatcacctttgcgtcgtttcttcgctccacaaacgtttactgagcgccttccacacgccaggcgccagactcgcgcggggaaacagggataagcactgaggaggggtcccagccctcagcgatgggatttcagagcgggagataaagggttgcccagaagggtggtgagtggaatagctgatataaacaacgggggcgcgatgaaatacacaggagggctgctagtcacatatggggcgggtgccgagggcccttgactaagggaggcttcctgcacgggtgacacccaagcggagtcctgacgacctgcgtcagaagtagccaggcgaggaggaggggaaaggaatccacgtcccgagcagagaggcagcgttccctacacagcacaggacacggtccgcgcacagaagccgcaggagacgcaggcacaggggctggggagaatccttgctgggccctcgccgcctccctctgccgggtgtctggtgccagcctcctgcctggcagaggaactccagcccctgctcccggaagcccctccaggccttcggcttccctgactgggcatgggcccctcgtcccctcgggtacggggccggtctccccgccctcgggcggcgaagtaaaggctgagcccactgctcccaccacctctgtctgtccccaccccgacctggggcctcataccatcccactatcatgggtagtgcctaccactgggaggcccggcgccggcagatggctttggaccgaaggagatggctgatggcccagcagcagcaggagctgcagcagaaagaacaggaactgaagaatcaccaggaggaagaacaacaatcggaggaaaaactccagccacataagaagttaaatgtgccgcaaccaccagtggcgaaattgtggacatcacaggagcaaccacagccatcacagcagcagccatcagtgcagccaccatcgcagccaccaccacagccatcaacattgccacaggcacaggtgtggccagggccacagccaccacaaccacagccaccacctcagccaacacaaccaagtgctcaagcccgttgtactcagcacacctccaaatgcaatctccaggattcccaaaggccaggtcaccagcctacttcagcggggatctactaagctggagggcaatctctgtatcaacaacagattccagggtctcatgaacccatgccaatctagccccatcagaaacactgggtattcacaactcaagtctaccaattacatacagcagtggtgatccagagattgaacccaggaccccatggccatccccaaaatgcagatgagcaaccacatcttctcagcatccagcaatatctccactccaaaagccacccactctagaagaggaggctgccaggaataaaatccaggtacagattttgctgagagagaagaaaagagaacgtgggaccacgtgtcacatggagcagcctgtcagctcagaagatgcctgcaggtcccagtttccttaccccacagaactctttccttccatcaggtgcccccaaaatgtcactcccaccccttcccacccttcaggtgagtgtagcagcatggctgcactatcactctgacctccactcacttggcccaggcacatgctggacccccattcaggagacagacaaaacattcttcttcctcagcaatgcaggctgaagagcccaaggtcacatattgtaaagattaaccaaattccagc

SEQ ID NO: 254944 - DNA, 2054 bp, Homo sapiens
tgattaataatagtcagatataatcctatccgtttcctatctctagtaaaacttttcttattctaattattttctttgctgtactggaacagcttgtgccttcaggctcttgcctgggcacctgggtggcttgcggcccacaagataagatatattgcgttgaactataatttatgttgattgctgaatgatttagggcgggggggtgggcaccccctgaaattctgccctggaggagtggcctcaccctaaccctggccgtggctaataataaggcccacctcttagggccgtggagtgaaataagttttccaggtaatgcgcagtagagccctcagccctccgctgaagttgcgttaggaaggaggaagggagaggtaaatgctgagcccgcaggcggcagtctgtgcctcggagagaaactttatcccaaccttgctgggggccttgacgcccaccttgccccaagagcaccccggcagtcacccctgccctctggggtcctgccaccccgagcccgaccttcccccttttcccccgcgccgggccaatagcctcctaactgcgtcgtgctcatcacctttgcgtcgtttcttcgctccacaaacgtttactgagcgccttccacacgccaggcgccagactcgcgcggggaaacagggataagcactgaggaggggtcccagccctcagcgatgggatttcagagcgggagataaagggttgcccagaagggtggtgagtggaatagctgatataaacaacgggggcgcgatgaaatacacaggagggctgctagtcacatatggggcgggtgccgagggcccttgactaagggaggcttcctgcacgggtgacacccaagcggagtcctgacgacctgcgtcagaagtagccaggcgaggaggaggggaaaggaatccacgtcccgagcagagaggcagcgttccctacacagcacaggacacggtccgcgcacagaagccgcaggagacgcaggcacaggggctggggagaatccttgctgggccctcgccgcctccctctgccgggtgtctggtgccagcctcctgcctggcagaggaactccagcccctgctcccggaagcccctccaggccttcggcttccctgactgggcatgggcccctcgtcccctcgggtacggggccggtctccccgccctcgggcggcgaagtaaaggctgagcccactgctcccaccacctctgtctgtccccaccccgacctggggcctcataccatcccactatcatgggtagtgcctaccactgggaggcccggcgccggcagatggctttggaccgaaggagatggctgatggcccagcagcagcaggagctgcagcagaaagaacaggaactgaagaatcaccaggaggaagaacaacaatcggaggaaaaactccagccacataagaagttaaatgtgccgcaaccaccagtggcgaaattgtggacatcacaggagcaaccacagccatcacagcagcagccatcagtgcagccaccatcgcagccaccaccacagccatcaacattgccacaggcacaggtgtggccagggccacagccaccacaaccacagccaccacctcagccaacacaaccaagtgctcaagcccgttgtactcagcacacctccaaatgcaatctccaggattcccaaaggccaggtcaccagcctacttcagcggggatctactaagctggagggcaatctctgtatcaacaacagattccagggtctcatgaacccatgccaatctagccccatcagaaacactgggtattcacaactcaagtctaccaattacatacagcagtggtgatccagagattgaacccaggaccccatggccatccccaaaatgcagatgagcaaccacatcttctcagcatccagcaatatctccactccaaaagccacccactctagaagaggaggctgccaggaataaaatgtaatttttttcctgggaagaaaaaaacaaaaagaaataaaaaagaaagagaaaattgaaaagaaaaaaaaa

SEQ ID NO: 254945 - DNA, 1593 bp, Homo sapiens
cggattcaagcgattctcccatctcagcctcccgagtagctgggattattgacgcgcagcaccacgcccggctaatttttgtggtttttgtatcttctgtcttctgctctttagtaccgcatagagccacagaagactagtgagtcgaacaaacggcccctcttgcagcagttgttgatcacagggctgcccccggtactcatcctgtgtctctcgtccaaatccccgctcctccccagctatcacctctgccgatgctggtggtttccctgggtaccgggaaccaaactctcattccccaggaacctaagtcagggttcctgcacattcacagttatgggtggccctgggagtaacacctggcacccaaacagatcaccagagtccacacatagtccacctgccctccctgcataagatcagctcttcttcctcccgatgatagatcagggtcaatgatccctgccaagatggcgactgctccagcctgctggtccaacctgtccagccacagctgtagcttgaaggcttgaagttcaatgggaccctctcctgctttctacaaactggttcctttatttttatttatttgggacggggtctggctctgtcacccaggctggagaggaagaatgggggaaagaagccagagagaaaagactttactgctgaattgtccatggggcccattgagactcaaagctaaggtgggaaggtcttctatctgatcaggacccaggagagaaaggtactttgcagatgttccctgggagccttgggaaaaatgcctccctctctcaacaaagcaggcggggcctgcccagttgccctggcagtaaccacattgtgaggtggttccagttataggcagaggggtctgagtgggaagagacagaggtggtgggagcagtgggctctgcctgtccccaccccgacctggggcctcataccatcccactatcatgggtagtgcctaccactgggaggcccggcgccggcagatggctttggaccgaaggagatggctgatggcccagcagcagcaggagctgcagcagaaagaacaggaactgaagaatcaccaggaggaagaacaacaatcggaggaaaaactccagccacataagaagttaaatgtgccgcaaccaccagtggcgaaattgtggacatcacaggagcaaccgtagacttcaaagggtaccgcatctcgagactggctactctctggtcatagcagatagtgtgtgaattgccacaggcacaggtgtggccagggccacagccaccacaaccacagccaccacctcagccaacacaaccaagtgctcaagcccgttgtactcagcacacctccaaatgcaatctccaggattcccaaaggccaggtcaccagcctacttcagcggggatctactaagctggagggcaatctctgtatcaacaacagattccagggtgggcagaaaatccttacagactctggactggagcctgggagtgggaggtggtaaggagaggagccctttgcttccatcccggccctgtagtgtagaatccatatctaccaccctaccctctctgactctcccaagt

SEQ ID NO: 254946 - DNA, 1085 bp, Homo sapiens
gagacggagtctcactctgtcgctgaggctggaagtgaaactccatctcaaaaaataaaaaataaaatgaaaataaaattaagaggtagacgctaggcttgagtccagaattagaaatctccagagctagggtgttttctaagaagcccctttgcgttctgggggctcagacctcagtgaggcttagtaggattttgtattttctttcattctgactcagcacagacatttatgggggagatggagagaggagagattaaggagaaaaaggtaattccggagacctaagtggggagagatgagcagaggaagggtcagatgatgatgctggaaccctctgaggaagaatgggggaaagaagccagagagaaaagactttactgctgaattgtccatggggcccattgagactcaaagctaaggtgggaaggtcttctatctgatcaggacccaggagagaaaggtactttgcagatgttccctgggagccttgggaaaaatgcctccctctctcaacaaagcaggcggggcctgcccagttgccctggcagtaaccacattgtgaggtggttccagttataggcagaggggtctgagtgggaagagacagaggtggtgggagcagtgggctctgcctgtccccaccccgacctggggcctcataccatcccactatcatgggtagtgcctaccactgggaggcccggcgccggcagatggctttggaccgaaggagatggctgatggcccagcagcagcaggagctgcagcagaaagaacaggtgcatgggataggctgggttcttcagggtcctctctggagcaggaagggaatggagaatggagagagatccctaggaagctgcctactatttggtgaatgctgtttgctgggggtaggaggaaagcaaggtcatttggcgttctctcagatagactgtgtctgtgttggggggaccactatcagctgactcaatttccctcttgtaatagtctaggggaaggcaagggtactaggcctgggaggtttaaagatgttctgtccaatagggtaacccccagcctgtatgctatattgagccttg

SEQ ID NO: 254947 - DNA, 461 bp, Homo sapiens
cacctctgccgatgctggtggtttccctgggtaccgggaaccaaactctcattccccaggaacctaagtcagggttcctgcacattcacagttatgggtggccctgggagtaacacctggcacccaaacagatcaccagagtccacacatagtccacctgccctccctgcataagatcagctcttcttcctcccgatgatagatcagggtcaatgatccctgccaagatggcgactgctccagcctgctggtccaacctgtccagccacagctgtagcttgaaggcttgaagttcaatgggaccctctcctgctttctacaaactggttcctttatttttatttatttgggacggggtctggctctgtcacccaggctggagtgcagtggtgcaatcactgctcactgcagcatccacctcccagcatccatccaccctcctgcctcagcctctggaatag

SEQ ID NO: 254948 - DNA, 1414 bp, Homo sapiens
tgattaataatagtcagatataatcctatccgtttcctatctctagtaaaacttttcttattctaattattttctttgctgtactggaacagcttgtgccttcaggctcttgcctgggcacctgggtggcttgcggcccacaagataagatatattgcgttgaactataatttatgttgattgctgaatgatttagggcgggggggtgggcaccccctgaaattctgccctggaggagtggcctcaccctaaccctggccgtggctaataataaggcccacctcttagggccgtggagtgaaataagttttccaggtaatgcgcagtagagccctcagccctccgctgaagttgcgttaggaaggaggaagggagaggtaaatgctgagcccgcaggcggcagtctgtgcctcggagagaaactttatcccaaccttgctgggggccttgacgcccaccttgccccaagagcaccccggcagtcacccctgccctctggggtcctgccaccccgagcccgaccttcccccttttcccccgcgccgggccaatagcctcctaactgcgtcgtgctcatcacctttgcgtcgtttcttcgctccacaaacgtttactgagcgccttccacacgccaggcgccagactcgcgcggggaaacagggataagcactgaggaggggtcccagccctcagcgatgggatttcagagcgggagataaagggttgcccagaagggtggaactgaagaatcaccaggaggaagaacaacaatcggaggaaaaactccagccacataagaagttaaatgtgccgcaaccaccagtggcgaaattgtggacatcacaggagcaaccacagccatcacagcagcagccatcagtgcagccaccatcgcagccaccaccacagccatcaacattgccacaggcacaggtgtggccagggccacagccaccacaaccacagccaccacctcagccaacacaaccaagtgctcaagcccgttgtactcagcacacctccaaatgcaatctccaggattcccaaaggccaggtcaccagcctacttcagcggggatctactaagctggagggcaatctctgtatcaacaacagattccagggtctcatgaacccatgccaatctagccccatcagaaacactgggtattcacaactcaagtctaccaattacatacagcagtggtgatccagagattgaacccaggaccccatggccatccccaaaatgcagatgagcaaccacatcttctcagcatccagcaatatctccactccaaaagccacccactctagaagaggaggctgccaggaataaaatgtaatttttttcctgggaagaaaaaaacaaaaagaaataaaaaagaaagagaaaattgaaaagaaaaaaaaa

SEQ ID NO: 254949 - DNA, 841 bp, Homo sapiens
atttgcagggaattactctttatcctccagcactaaaaactgctttcagtgctgagctctcaagtgaggaagcaggtgctcagagagagtgctatttcctgggctggggctgtgccacccagaaatcgttcttgggtgtcacagtgggtgaggcagacagcgtaggcccaatttcagcctccagctctagggaacagagaccactgccacctatacttctctactcacttgccttgttcgaattcgacggtttctctggcagatgggtgattgggtggggagaggatgatgccacttgcccgggggcttcttgccaggaactgaagaatcaccaggaggaagaacaacaatcggaggaaaaactccagccacataagaagttaaatgtgccgcaaccaccagtggcgaaattgtggacatcacaggagcaaccacagccatcacagcagcagccatcagtgcagccaccatcgcagccaccaccacagccatcaacattgccacaggcacaggtgtggccagggccacagccaccacaaccacagccaccacctcagccaacacaaccaagtgctcaagcccgttgtactcagcacacctccaaatgcaatctccaggattcccaaaggccaggtcaccagcctacttcagcggggatctactaagctggagggcaatctctgtatcaacaacagattccagggtgggcagaaaatccttacagactctggactggagcctgggagtgggaggtggtaaggagaggagccctttgcttccatcccggccctgtagtgtagaatccatatctaccaccctaccctctctgactctcccaagt

SEQ ID NO: 254950 - DNA, 1984 bp, Homo sapiens
tgattaataatagtcagatataatcctatccgtttcctatctctagtaaaacttttcttattctaattattttctttgctgtactggaacagcttgtgccttcaggctcttgcctgggcacctgggtggcttgcggcccacaagataagatatattgcgttgaactataatttatgttgattgctgaatgatttagggcgggggggtgggcaccccctgaaattctgccctggaggagtggcctcaccctaaccctggccgtggctaataataaggcccacctcttagggccgtggagtgaaataagttttccaggtaatgcgcagtagagccctcagccctccgctgaagttgcgttaggaaggaggaagggagaggtaaatgctgagcccgcaggcggcagtctgtgcctcggagagaaactttatcccaaccttgctgggggccttgacgcccaccttgccccaagagcaccccggcagtcacccctgccctctggggtcctgccaccccgagcccgaccttcccccttttcccccgcgccgggccaatagcctcctaactgcgtcgtgctcatcacctttgcgtcgtttcttcgctccacaaacgtttactgagcgccttccacacgccaggcgccagactcgcgcggggaaacagggataagcactgaggaggggtcccagccctcagcgatgggatttcagagcgggagataaagggttgcccagaagggtggtgagtggaatagctgatataaacaacgggggcgcgatgaaatacacaggagggctgctagtcacatatggggcgggtgccgagggcccttgactaagggaggcttcctgcacgggtgacacccaagcggagtcctgacgacctgcgtcagaagtagccaggcgaggaggaggggaaaggaatccacgtcccgagcagagaggcagcgttccctacacagcacaggacacggtccgcgcacagaagccgcaggagacgcaggcacaggggctggggagaatccttgctgggccctcgccgcctccctctgccgggtgtctggtgccagcctcctgcctggcagaggaactccagcccctgctcccggaagcccctccaggccttcggcttccctgactgggcatgggcccctcgtcccctcgggtacggggccggtctccccgccctcgggcggcgaagtaaaggctgagcccactgctcccaccacctctgtctgtccccaccccgacctggggcctcataccatcccactatcatgggtagtgcctaccactgggaggcccggcgccggcagatggctttggaccgaaggagatggctgatggcccagcagcagcaggagctgcagcagaaagaacaggaactgaagaatcaccaggaggaagaacaacaatcggaggaaaaactccagccacataagaagttaaatgtgccgcaaccaccagtggcgaaattgtggacatcacaggagcaaccacagccatcacagcagcagccatcagtgcagccaccatcgcagccaccaccacagccatcaacattgccacaggcacaggtgtggccagggccacagccaccacaaccacagccaccacctcagccaacacaaccaagtgctcaagcccgttgtactcagcacacctccaaatgcaatctccaggattcccaaaggccaggtctcatgaacccatgccaatctagccccatcagaaacactgggtattcacaactcaagtctaccaattacatacagcagtggtgatccagagattgaacccaggaccccatggccatccccaaaatgcagatgagcaaccacatcttctcagcatccagcaatatctccactccaaaagccacccactctagaagaggaggctgccaggaataaaatgtaatttttttcctgggaagaaaaaaacaaaaagaaataaaaaagaaagagaaaattgaaaagaaaaaaaaa

SEQ ID NO: 254951 - DNA, 1500 bp, Homo sapiens
gagacggagtctcactctgtcgctgaggctggaagtgaaactccatctcaaaaaataaaaaataaaatgaaaataaaattaagaggtagacgctaggcttgagtccagaattagaaatctccagagctagggtgttttctaagaagcccctttgcgttctgggggctcagacctcagtgaggcttagtaggattttgtattttctttcattctgactcagcacagacatttatgggggagatggagagaggagagattaaggagaaaaaggtaattccggagacctaagtggggagagatgagcagaggaagggtcagatgatgatgctggaaccctctgaggaagaatgggggaaagaagccagagagaaaagactttactgctgaattgtccatggggcccattgagactcaaagctaaggtgggaaggtcttctatctgatcaggacccaggagagaaagtgcctaccactgggaggcccggcgccggcagatggctttggaccgaaggagatggctgatggcccagcagcagcaggagctgcagcagaaagaacaggaactgaagaatcaccaggaggaagaacaacaatcggaggaaaaactccagccacataagaagttaaatgtgccgcaaccaccagtggcgaaattgtggacatcacaggagcaaccacagccatcacagcagcagccatcagtgcagccaccatcgcagccaccaccacagccatcaacattgccacaggcacaggtgtggccagggccacagccaccacaaccacagccaccacctcagccaacacaaccaagtgctcaagcccgttgtactcagcacacctccaaatgcaatctccaggattcccaaaggccaggtcaccagcctacttcagcggggatctactaagctggagggcaatctctgtatcaacaacagattccagggtctcatgaacccatgccaatctagccccatcagaaacactgggtattcacaactcaagtctaccaattacatacagcagtggtgatccagagattgaacccaggaccccatggccatccccaaaatgcagatgagcaaccacatcttctcagcatccagcaatatctccactccaaaagccacccactctagaagaggaggctgccaggaataaaatccaggtacagattttgctgagagagaagaaaagagaacgtgggaccacgtgtcacatggagcagcctgtcagctcagaagatgcctgcaggtcccagtttccttaccccacagaactctttccttccatcaggtgcccccaaaatgtcactcccaccccttcccacccttcaggtgagtgtagcagcatggctgcactatcactctgacctccactcacttggcccaggcacatgctggacccccattcaggagacagacaaaacattcttcttcctcagcaatgcaggctgaagagcccaaggtcacatattgtaaagattaaccaaattccagc

SEQ ID NO: 254952 - DNA, 695 bp, Homo sapiens
gttactttcacttcagagaggctcacattgattaagtgctttctgtgtgccaggaactttacctgtgctatcctaattaatcctctttagcaactctatgaatctgtcattgttgtttgactggggagaacattgtaactgcaaaaaatttaagtaacatgaccaagagcacaaaactagcatgtggcgagtcaggattgaaacttggtcttctgagtcaaaagccactggtctttgttttgtatctatggggacccaaattcactaaggttatgccacttatgatcatttgaaaggatgttggaggcaaagacatttagcaagctgggttcttgaatgtattgcttgccctgtgtatctcatactttgggaagcaggatttagaagcagaaagatcaccataagcaactggcaggtcatatggactacaatgtgaatggcacctccgggacttgcacaaggcataaggcaagggccattttctagggatctaattcccaagtgtcttctctttaactcagtgccttcccaacatctataaccatgaccatccaaaagacaaaaggcagaggggcagaagagataaaggctggaggcacttttatcatattaggagaaaatttagtgtgcagcctttacccttcttctggagaagtttaggtctggcagtcttatctcatattttcatattctaa

SEQ ID NO: 254953 - DNA, 416 bp, Homo sapiens
atgacagtgtttgaaggggccaatgaataatttcctatgttagggaaaggatacaaaaagcacgaatcataaaaaggttaatttatctatgctacaatgaagaatatctgttcattaaaatatattactaggccaggtgcagtggctcacacctgtaatcccagtgctttggaaggctgaggtgggtgaattgcttgagcccaggagtttgaaaccaggctaggcaacatggcaaaaccctctctctacaaaaaatacaaaaattagccaattgtggtggcacatgcctgtggtcccagctactcaggaggctgaggtggaaggatctcttaagcatgaagaggttgaggctgcagtgatccatgcttgtaccactctactccaaccttggcaacagagtgagaccctgccttaaa

SEQ ID NO: 254954 - DNA, 523 bp, Homo sapiens
gtagtcacatctaatcaggtttatgtgattagccctatttcttcagggcagctccatttcattagttcccaattactcgttaaacaaccttgacaatgagttacacatgcttagtcatttccatggaactctcatttatcttgcatcaatataggtaaatatctaactattcctcagttgctgctgcaaatcagaggtctagtcttcagccatttccagagaggaggccaaagaaacagctgttagtcctttttcggtatataaaatgctcaggatagtgcctgacacgtagtaagcaaacaaaaacttcacagaatcattgaatttgttttttcaaaattgacaaataaagtgcatattctgatattgtaatttaaaaaaataatagaacaaaggaatccactgcttggttgtaatatcttttcttcattgataattttcaaaatgattgttgctaaaatcatatgcctctgtcaaattcctttcacgtcaaataaaattaaatcctatgatgtccttgaaa

SEQ ID NO: 254955 - DNA, 399 bp, Homo sapiens
aattgatgatcccctcaggggatcaataatgagtagtgagattgaatcagcaataaaaaaattttcaaacaaaaaaaaaaaagctcaagaccaggtgaattcacacgtgaaatctactaaacattcaaagaagatctggtaccaatactactgaaactatcaaaagattaaggagggaatcctacctgactcatgctatgaagccagtatcactctgatatcagagccaggaaaggacacaacaaaaagaaagagatagagatcaatatctccaatgaactgagatgcaaaaatcctcaacaaatactagcaaaccaaacttaatagcatatcaagaagataactcaccacaatcaagtaggttccattccaggcatgaaaggatgattcaacatacac

SEQ ID NO: 254956 - DNA, 431 bp, Homo sapiens
cattgtttcttagacaagaacaatgaatcactgagcacaaatggcttaatctccaggcacagcctctagtgttgctccagattcaaactaacatttgatgacaatataagacattcatctcttgtgaatctattgtttagtgtgggttttaatttgttgcaatagttataagccacaacaaatgcaggttttcagagaatcagaaatggagtaagaatggaacactgtatgttctagatcacaggccatttatgtatgtatgtatccctactataatgttgatgatgcttacataatttctttatatgtagaaaagatacttcaaatttcagatagatgatcacaccaacaaatggcaaatgttgtatttctgtcaaaacattaaatttggcatgcttggtgtttcttcaacatggaatgaccatcaagtt

SEQ ID NO: 254957 - DNA, 331 bp, Homo sapiens
tgacccagagaaacattgctgggtaaactgtttcctagaaaccaagaactggctgggcacagtggctcatgcctgtaatcccagcactttgggaggccaaggtggacagatcatttgaggtcaggagttcaagaccagcctgaccaacatggtgaaaccgggcctctactaaaaatacaaaaattagctgggcgtggtggtgcatacttgaatcccagctgcttgggaggctgaggcagaagaatctgcttgaacccaggagggcggcagaggttgcggtgagccaagccactgcacaccagcctgggtgacaaagcaagactctgtctca

SEQ ID NO: 254958 - DNA, 252 bp, Homo sapiens
gaagaccagctcaggaggaggcctgattctcatgcaggcttagagcacagcatgcatgggttggactgtgcagatcagaaggggtgggaatgctgttcttacaggcttaggttttctctctttattcctccatccttgagcccctggaggttcaaaaaagcaaagataccagttattaggaaaaataaagacattctgtgtttgtaagtggctgagttgaatctgtccaaaccagcttatacttgtgcaaac

SEQ ID NO: 254959 - DNA, 275 bp, Homo sapiens
cacacaccatcacttctacattattctgttggtcacacaggccgccccgaggcagtgtgggaaggatctacacaggacgtgaataccagaagtgagaatcactggaagtcatgttggaggctggccactatccccttctcgctaaacctgacattatcactctcatatttcatgttccaccaagcaccaaaagatttcagattcccagaacctatagggctgtgtcttccatctttgtgttcctcatgcctgcaagatcttttcctctcttttgt

SEQ ID NO: 254960 - DNA, 439 bp, Homo sapiens
tgcagaagtttgtaaatttgatgaagttcagtttataaaaaaaaaaaatttttatgtattatgtttttggtgaccaatctgagaaatctgtgcataatccaaggttttcttctagaagttttatacttttaggctttacatttaggtctattatgtattttgagttcacttttacatatggtatgagatgtggatcaaagcatttttttcatgcaaatattttattgttgcagcaccatttgttgaaaagactattctttcttcactgaattgtctcatcaaaaatcagttgtccatatatgtatgaatctatttctgaacttttattctattgatttgtctattttgatgccattactataccatcttgattactgtcactttataagtcaccttaaaatcagataatgttggtcctccaactctgttctttttcaaa

SEQ ID NO: 254961 - DNA, 739 bp, Homo sapiens
ttaccgatactcttccgcggctactggcaatctagcactagtggattccccgggctgcatgaattctgcacgagcttatttacctgcttatattgttttagcacatgttttagttcacctctgctgggtttagtggtctttcagatcatattacctgatttgaataaaatgaactttgctaaatagacagatggctcacaaagattcctgcaaagaaaatgcagattgaagtttcagagtcagcagaagattgaagtaataatacaaatacacgtgaacagccagaaagaaacagagtggatacttctatttatattatgaacttgtcagtcaaatgcataatataaaaacaatggtgatctcatcagattgatgaagaagcagtaataaaaaatagcttagaattactaaaaatactatttaaaatatggacttatatacactgttgagtacattgtacctgaaggtatttactaatgatattatgggctaatcttataaattgagatatttaaaaactaaatattcagaatataaagacagacttattgatgtttttcagtgattgtcagtcataatccagtaccttaaaattttattaaggttaataatacatttttagaagttccttttgaggtttaggaataaaagacaaaaagtcataaactcttgttcttcttgtttggtaacagtggctgaaatgatatatagataaataatttgagtttggtgtaaaact

SEQ ID NO: 254962 - DNA, 759 bp, Homo sapiens
tcctatttactgcctgcctatctgaactccacccattcttctagggctacaaacccttccctgactgccctagccctcactgatttaccttgcctatgactctgaatatacttatagcctattacatggtctaggacttctttatgccattctgtgatacagatgagtactgtaccacttacagcttcacgtgtgtgccctcaaaggaaagcttcatgtttgtttcacatttaatgcttataactgtgctaagcacaaaactcatatgcaaatgaatatcaagtttttctacaaatcattattgggagagcacaaggaacacagagtacctatatgtagtatagtcggaaggcagcaggactgtgtgtcacagcgcaatgtgccactatacagccatgtgagcatgttaaatctcagccttccaatccataaaatgaagatggcatctacctcagtagagttgctgtgaagatgaggcgcagggaattaaagaatactaaatgtggaaatcttccttgaaaaatgcatagtgcaaaatcaaactgaagtactattattcttctccacgactattacactgtagcagcccataaaaccataagcttgaattttctttttaaatatacaattttgtgagaaggaaaagcaaaagtctagattaatcttgtacagatagttagtatgttatgttaaaatggacatatatgttaaatgtaactgaagtttatccattagtttctaattgaattttctagtgat

SEQ ID NO: 254963 - DNA, 652 bp, Homo sapiens
ttctaaaccttatttgtggctctattttatattttttcagccttatttatgtttttccttatgagaatttatcccttttaatattttatacatcattctaaacaagacataactcaatcatcaatcaaaaatcactgcactgtataatacccaacttccacagtgacgaccctgagtcattaataaattattacactgccgattttctgctttgatggaaaagaagtacacaagatattttaagcctatttcatcacaaatgataaggggttttttttggaggggacggggaaggaggagacagggtcttgctctgttgcccaggctggagtgcagtgtcataatcacagctcactgcagcctcaacctcctgggctcaagtaatcctcccaccttctgggattaaaggcatgccccaccacacctgactaattttttttaattttttttgtagaggtggagttttgccttgttgcccaggctggtcttgaatttttggactcaagcaaccctcccacctcagcctcccaaatatcaaggattacaggtgtccaccaccacacccagctaatttttgtattttcagtagagacagggtttcaccatgttggccaggctggtctcgaactcctgacatcaagtgatccacccg

SEQ ID NO: 254964 - DNA, 341 bp, Homo sapiens
ttagtttttttttttcttcaaaagaaatcacaacttcaaaagttaattaagagcattgatgataggcagacttcaaaatcatggaaggcttaatttctatcttttgctgctattctagtttatgtatttcagacacattgcaggtttcagaagtccaagttttcctacttttatattatgtgaaggtttgtttattagaatgatatgattttataaaagaaaattgaaccaatatattatattatatagtataaagcatatgacaggtatggatatttagacatcttcactttccttttagtcaaattaaagaactatctacaaattgcttttatctaaaa

SEQ ID NO: 254965 - DNA, 984 bp, Homo sapiens
gatgattggcttgggttgcttttaaaatatttaaaatattggcttggggatggccagtgccctctgtggaatgtttcctgagaaggggtagctaaagaggaacctctgcctatccatcatcatgtctctgggtttcattgtcaccctaaagccactctcagatgtctttgtgcaaggcaggcagggcaaggccagcctcagtcttcccagtctcctttatattttatactgcaataccaagttcagccagagttcatgtttctgaagtttcttaagcatttggaaagttacttcaaaatttggatcaattttaaagaaagtaactttgaagttgaggaatcactggggaaagtattgatggccaaggatcctgtcttaaatggccaaatatgatctaaagaacagtaacagggagcaaaatgaaaagggaagggtgagagtatggagaagtcagaaaaatgagtctgttaatgaagaaagaatgaccctattaaagccaccaaactttgatttccttgtgtgggaaatcatttttccaattttcactgtggaggtatgtgttaccagcgcctcagggctaaagacagagagtcttctgttttccctgggacgtttgaatgacctgtgtctgccatggggcccagtgctctccaccagcaattgctgctggcctcggcgctgacaggtcaacactggcgctgaaggaggcccttgttgctccaggggctgcccacgtgagcacaagagttagaggtttttgtgtttttgtctgtttgttttagttttcattagtacctcctgcagaggctctgataatcaaccgaaggagttctccataaaaaattcctacctcttactcaacacgaggctcgacattaaaggaacatcatctgaggtttagagagaaacatacattgtccatcataaaaatgaactttttgggtaaatggtgatttttctgttgctttaaaaaaatacatacaa

SEQ ID NO: 254966 - DNA, 275 bp, Homo sapiens
aggtcccctgatttcacgcctcccgtagcttctctcctgctctggtcttgatggtaatctcctttgagggtacaaaactgctttgaagacttgaattgcgtttgaactggaaattagcctcagaacaacctggtctataaatgagcacactgaagttagattgttcccttattcccagagatggaaccagaattaggcatcagtgaggattagcagctgcagagtcataaacagggacccagttccacctcagtgttggtaaatcatgctctgtg

SEQ ID NO: 254967 - DNA, 1174 bp, Homo sapiens
ccaccctcctcggcctcccaaaatgctgggattacaggcgtgagccaccgcgcctggcctctttttctttggcatgagccacggtgcccggccaattactgagaattcctgcctttttcacaggattattttaaggatcaaatgaaaagttctgtgtgaaagaagaatgaggccatgaagtgatacagaaaccaaaggtgatatatttattgcctttcccactcaatgtagttcgttttttgttttgttttgttttgtttttttgagagatggtttcactcgacttactgtgaccaggcgttgcttgggtactgctgctactatggaaataaacaaagacaaatccttaccctgagaaatgttgccagcctaatgctgaggttaaggaagggaaggggtattaagataggagagggcagaggcaaggaggagggcccaaagagatgagggcaaagaagagcaagggagccgggcactgtggttcatgcctataatcccagcactttcggaggccaaagcagacagatcatgaggtcaagagatcgagaccatcctggccaacatggtgaaaccccgtctctactaaaaatataaaacttagctgggcgtggtgacacacacctgtagtcccagctactccggaggctgaggcaggagaatcgcatgaacccgggagacggtggttggagtgagccgagatcgcgccactgcactccagcctgggtgacagagcaagactccatctcaaaaaaaaaaaaaaaaagaaaaaagaaaagaaaaaaaagaaagaaaaagaaaaaacaaaaaaccagaagagcaagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctga

SEQ ID NO: 254968 - DNA, 1153 bp, Homo sapiens
tgcgaaagcgatacccataccaaccaccgcgcctggcctctttttctttggcatgagccacggtgcccggccaattactgagaattcctgcctttttcacaggattattttaaggatcaaatgaaaagttctgtgtgaaagaagaatgaggccatgaagtgatacagaaaccaaaggtgatatatttattgcctttcccactcaatgtagttcgttttttgttttgttttgttttgtttttttgagagatggtttcactcgacttactgtgaccaggcgttgcttgggtactgctgctactatggaaataaacaaagacaaatccttaccctgagaaatgttgccagcctaatgctgaggttaaggaagggaaggggtattaagataggagagggcagaggcaaggaggagggcccaaagagatgagggcaaagaagagcaagggagccgggcactgtggttcatgcctataatcccagcactttcggaggccaaagcagacagatcatgaggtcaagagatcgagaccatcctggccaacatggtgaaaccccgtctctactaaaaatataaaacttagctgggcgtggtgacacacacctgtagtcccagctactccggaggctgaggcaggagaatcgcatgaacccgggagacggtggttggagtgagccgagatcgcgccactgcactccagcctgggtgacagagcaagactccatctcaaaaaaaaaaaaaaaaagaaaaaagaaaagaaaaaaaagaaagaaaaagaaaaaacaaaaaaccagaagagcaagggaaggctcacagggctgaatcttgaagaatgggggttctcagggttacagagaaggggaggacattctggacagaaatggaatgtgtgaagatattgtgtacttggagattgcagatgtcgtgtggggctaaacattcttgttcagctgcaagaacatctgaaacctgggaaggctgtgggaaacataaagaactagatgtataatattttcagtttttttttaaattagtaactattaatagagtagcacaaattaattgggtgcttgttctggaccagatactgtgctactactgtgctaggtcctttgtttttttagacatggggtctcactgctgttgccgaggctga

SEQ ID NO: 254969 - DNA, 393 bp, Homo sapiens
ttctttttccaaccctttcatcatctgtgtgggcttccttcctttttatttctctgcattccctttcagatgtggagatcataactgggcatggatagccagcatgagtcaagcagtgatgagtaaaataagaaacttacctcagagtttctaaactaattttctatttatgaaccccagtaatgtgcttgcttaaaacacaacgagaatggtggctcgctatcatatttcacttgtaggtctgctatggtacaaggtgtgttttttctgctacatttcaattctcgcacgtggccagcctttaccttgtatgctgtgtcttatattccagaacatattattttgcaaaatgacaggaaagacttgcataagtatgaaggatattttgatgtg

SEQ ID NO: 254970 - DNA, 1237 bp, Homo sapiens
tgagtgttttacagccaagaaaattcttactaatctatcttagggaaaaaaaaaatgacagctcatgccactgattatcaggagccagtcagcttccctctgtgccctgtgtgccctctgtgccgggcctgccccctcccactgcctggccctcctcagaggtgggccatccttccactgccggggctgggccgggctgtgtcagctcgtgctggccactttactgctccacttgagatcccctgacgtggcaacttgggttctctgacctgcgccctggtgcttgcctggccgacagggcactgtcctggcatggggtctccttggcatttgggtctcaccaccacccacacctcaccttcctccagccctgcagttctcacaccggcaccaggagcctggtggggcggtgcagatgggaaagctcttagccccatagaacgtgctggacagtgcagacctggaggcctgctgaggcaccgggtgccagcctctccacagtgtgggcagcagggtggggtctatatgtatttacatccatctctgtccacatacaccattcctaaggaccggagggtgcgtctcctaaaatgacggccacccctcgcatgcacccaccgtcagcacgctggaaagcggctgcagggaatcccgtgtcatctgtgtccaggccgtgttcccagctccagaattgtttcacaagtgtctctcatagctggtttttttcagactggaatccaaggttcatattccatctggttattaatgtctctctagcttttcttaagatataatgggcacgtagtaaactgcaccacttgatgattctgacccatacaaacactcatgaaaccatcccgaccgtcacggcagcgagcactcaccccacgcacacactcatgaaaccatcccaaccgtcacggcagcgagcactcaccccacgcacacactcgtgaaaccatcccgaccgtcacggcagcgagcactcaccccacgcacacactcatgaaaccatcccgatcgtcaacggcagcgagcactcaccccacgcgcacactcatgaaaccatccctacagtcacggcggcgagcactcaccccacgcgcagggacttggccttggtgatgatcttcaggctctctaccactcccgccacactctcatgctccatgctgctgtactcgccctctgtgttctcccggacaatgaggatgtctatgtccttgtgccgagtcac

SEQ ID NO: 254971 - DNA, 534 bp, Homo sapiens
atgcacccaccgtcagcacgctggaaagcggctgcagggaatcccgtgtcatctgtgtccaggccgtgttcccagctccagaattgtttcacaagtgtctctcatagctggtttttttcagactggaatccaaggttcatattccatctggttattaatgtctctctagcttttcttaagatataatgggcacgtagtaaactgcaccacttgatgattctgacccatacaaacactcatgaaaccatcccgaccgtcacggcagcgagcactcaccccacgcacacactcatgaaaccatcccaaccgtcacggcagcgagcactcaccccacgcacacactcgtgaaaccatcccgaccgtcacggcagcgagcactcaccccacgcacacactcatgaaaccatcccgatcgtcaacggcagcgagcactcaccccacgcgcacactcatgaaaccatccctacagtcacggcggcgagcactcaccccacgcgcacactcatgaaaccatccctacagtcacggcggcga

SEQ ID NO: 254972 - DNA, 475 bp, Homo sapiens
caaaaaatttttgtgtttataaatttgtctataaaatgattatgaatatcatatacatgtaaatcatgccttaagtcattgtgggacaaatagtgacaaaatgaaatgaattgccaagactttgaaaatcaaacttcataaaattctaaagtaaaggaaggaaaaataaacacaaattcttggttgttacctctgggggaaaccaaaggagatgcaattaggtagtgacacagaggagccttcaaaggtataaggaatattctattttttaaactggatgataaatacacacgtatttgttttattatttttctccagaacttacacttacatatgcgttccacatattagtttatgtgtatgatatatttctgaattaaaaagcttgaaagaaagaaaatcaatcttcagttaacattctactcataaagtcaactgttccctattctccaggaacaaatgtagctaccgaata

SEQ ID NO: 254973 - DNA, 350 bp, Homo sapiens
acactttttaacttcttcataacttattttctttgtctctaaaacaggccaaattatactgtgccactttgtgttatataatgaacgtgaagtatttgatttataataactacttaagagacaacaaaccttttccctcaccgtcctgcatagccattctattcctcagaatataggccatcataagacaatggaatatgtcccaagagacagattggactgaaatatgcccctataacatatctgtcttttgatttaattctgtttaaaattaacaaaagggagtctgttataaaagcttcttttgaacaaaaaatgcaaatgttatttaatgaaagcgattatcgttt

SEQ ID NO: 254974 - DNA, 647 bp, Homo sapiens
ttcttgtatatagaaaaccctaaagactaaaaaacataaaaataaaaaacaaaaacaaaacattattaaacactgatgaaagaaattaaacacaaataaaaggaaaacatcccatgttgtttgttgggaagaattaatattattaaaatatctgtactatttaagtgatctacagatttaatataatcctatcaaatttcaatgtcatttttcacagaaataggaaaaaccaatttttaaattcatatggaaccacaaaaaactccaaataaccaaagtagtcttgggaaagaagaaaaagctggaggcattgcacttacttactttaaaatatattacaaagctacagtaatttaaatagtatgatattggtataaagacaaaaatataaaccaatgtagcaaaatagagaccctagaaataaatggatgtaaatattttcagttgatcaacaagggtgccaagaatacatgggaaaaattatagtctcttaaacaaataatgctagggaaactgaatttccatatgcaaaaggatgaaattggacccctatcttacacgatatatgaaagtcaactcaaaatgtattaaagacaaatgtaagatctgaaactgaaaaacttctcaaagaaaacacaagggaaaaa

SEQ ID NO: 254975 - DNA, 302 bp, Homo sapiens
ggccagaaacagtagacttcactggttaattctatccaacacttaataacatataccaaatttctaaaactagaagaggagggcacacttccctacacatcctgtgagtacattactatcaagataccaaaaccagacaatattacgaggaaagaaaactacatactgatattgcttatgagtatagacacaaaaatcctcagcaaagtattaacaaaccgaattcaacaacatataaaaagaattgtacggcatgacctagtaagatttatcctaggaatgcaaggttgttttacatttga

SEQ ID NO: 254976 - DNA, 446 bp, Homo sapiens
gtgtgttccagtgtggactgacgcaggacagcagagggcgtttggtacatgatgtgtttgagcaaggatgtgccagggaagatgggagttaggggctgaaacatactcagctatcctgtatctaaattgcgtgaaatcaacagggctcctccttctcattaccaatatttatcttcctgatttatctccctgtgccccaggaacacatccctccaccttttttctgcccctgctttccaagatcacatcctgggtggtttcctttattgcagtctttgagctctgtttcctattctgaaagcataatgcccaggaacacagacttcaccacttaccggagtttaaaaaccaacagcaacaacgaccttgggctggttgcttaacccctatgcctcagtttccttacatgtgagatggggataataaatgagacgttatgtgtaaag

SEQ ID NO: 254977 - DNA, 447 bp, Homo sapiens
caaaggtatgtcttttgacttgtctagatggaccccataatgcagaagaacgagtcttggccatttgcatactgacacttgggctagcaggccagaaggttctacaataggcctggcctcaaatatatttcacttgtaataagcaccatatggggtcctgccttggagctgagtcatacaagagtgcctagagtgccttttaaaggcctacagccatccaactcttagggaagggagtccgcattggacttgggtgctctgggaagtggtctggttcctggatcaattgttgatgaggtatatatttcaatcatgttttcccacggactgtggggaaggcggtgagggtggctggagacagggttggttggggagaaggggctgctgttggttgaacattagttacacagagctgcgtgctataaattctggctcactgaatcctca

SEQ ID NO: 254978 - DNA, 2163 bp, Homo sapiens
ctaatcttccagttgccccctattgactttaaaccaaagctttgattcatgaccactgggatccagccagcgggggatttcttttcctgatggactgtacccaggatctcacatttgcttaagcagctcccacaattgggttcttataaaaggacacagaagagacaagctcagttttctctgaaggagaaggactgcacttagaactgcattttggtgacctctgaaattcagtacggcagtgaatgagcttctgaccttgaggtgaacttaacaaaattatttttggaaaaatcgttgtgggaaccattaaaagaactccaggaaacatgaattctggaatcttacaggtctttcagggggaactcatctgccccctgtgcatgaactacttcatagacccggtcaccatagactgtgggcacagcttttgcaggccttgtttctacctcaactggcaagacatcccatttcttgtccagtgctctgaatgcacaaagtcaaccgagcagataaacctcaaaaccaacattcatttgaagaagatggcttctcttgccagaaaagtcagtctctggctattcctgagctctgaggagcaaatgtgtggcactcacagggagacaaagaagatattctgtgaagtggacaggagcctgctctgtttgctgtgctccagctctcaggagcaccggtatcacagacaccgtcccattgagtgggctgctgaggaacaccgggagaagcttttacagaaaatgcagtctttgtgggaaaaagcttgtgaaaatcacagaaacctgaatgtggaaaccaccagaaccagatgctggaaggattatgtgaatttaaggctagaagcaattagagctgagtatcagaagatgcctgcatttcatcatgaagaagaaaaacataatttggagatgctgaaaaagaaggggaaagaaatttttcatcgacttcatttaagtaaagccaaaatggctcataggatggagattttaagaggaatgtatgaggagctgaacgaaatgtgccataaaccagatgtggagctacttcaggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacaatgatatctttctgtatgaaattttgagaagcatgtgtattggatgtgaccatcaagatgtaccctatttcactgcaacacctagaagttttcttgcatggggtgttcagactttcacctcgggcaaatattactgggaggtccatgtaggggactcctggaattgggcttttggtgtctgtaatatgtatcggaaagagaagaatcagaatgagaagatagatggaaaggcgggactctttcttcttgggtgtgttaagaatgacattcaatgcagtctctttaccacctccccacttatgctgcaatatatcccaaaacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcccaggaagtcctcttccttgtgccttaacatacaggacaaataggctctattttatgtcttgaattgccttctaatgttatcaaaactcatttattgtgttactattaaatatgctgaaaacgctaaaagtatacgtattggttctttattaaataatttttgaaaaatcattattcatgatcatggcatacagtatattctcttttttttctttatttatgactgtcactgagtgaaataatagatgacagacatgtctgaatgaagtaaaaatcaatggaagacagtcgggatcttttgcttcatgcaaaaaacttggagtgaagtctcaatgataactgggaaatgtttttcttcctctttatctaactatattacacttatccatcaggtttcattgtattaatctatcctttgaggtaata

SEQ ID NO: 254979 - DNA, 647 bp, Homo sapiens
ggcagagacaggcctaataacttgtcctgaattatgagactagaacatgagagagccctcatttgaatagggaagtcggaactcagggactctgatctgataaccactctatattgcccctcataccagaacatgagggtcctccttccacacgcatgcacttcccactgtgtacgcctcaccatggccaaacagggggagcttgaccccatgaaatgctcaaggaatcacactccgttacagggttagagggactaaatttcgcagcatggacacagatgcatggcatgccaagaacaagacatatttttaacatatcaggttttttatgacatgaaccaataaggcctgagatatgtgaaattagctaaacagtaattgtcacaagtacaaaaagcatgcagatacttgttttggtaccactccagcaactaatttggaagaaaaagccatgaacaaccaacatacctgtattgaaatgccagagtctttcttggaatatgaaaacccagcaaatctctatggaggagacaacagttcaatcacttaatcccagaacactggtaactacttgttagtaaggatcttagttgtatttgtttgattttcagctacccaaatccctctgcagcttttgctctatctcc

SEQ ID NO: 254980 - DNA, 483 bp, Homo sapiens
atttatttgtgtgcttcctcattcttgtgaagctagggcaccaaccaggaaagaatgaatcctgtgagttggaatgtttatgtgtcagaagggttggaacccataaatagaaatgtcttttctggtcattataattggataccaatgaggaaaggaaaaggtgggaggaagggagatgaattgaaaacattaaaggaaaagacaaaaaagttgcatcctgaaacacttgcagaaactcagcaacaaatagttccagaaaccgaggttctattccttatacttttacttattcaaaatctgtacaaatcttgcttagctcccctctccttgacaataaaatatgtactgagcagctcctcaggtttcagtaacatgacacatattcaggatggaattctgagcaaaaacagatgatgtaacatgatatctggtattgtggcataaagcttcaggcaagaagagaatcactaacacataaaattg

SEQ ID NO: 254981 - DNA, 1228 bp, Homo sapiens
  misc_feature (1117)..(1117): n is a, c, g, or t
  misc_feature (1218)..(1218): n is a, c, g, or t
  misc_feature (1228)..(1228): n is a, c, g, or t
aagtgctgggattataggcatgagccaccttgcctggccttacttatatcttctttaatgtatttcagtaatgttttgtagttttcagtgttcaagttttttgccttcttagttaagtttattcctattttgttcattttgatgctattgtaaatggaattgttaattttaggttcatatatagaaacatagttgacttctgtatgttgatctggtactccacaactttgcagaacttacttattggctctagtagctttttagtaggttccttaggctttcctagataccagatcatgtcacatgcaattagaggtagttttacttcttccttttctttctgcatgcattttatctctttttcttgcctaattattcttggctatgttgaataggaatatcaggagtggccatctttgtctttttggtattgaggaggaaaatgttcagcctttcaccattgagtatattagctgtgagatttttgtaaaggcttttcatcaggttaaagaagtttccttacatgtcttgtttttcagtttttggttgttgttttttttttgcttttttgttttatcataaacagttgttagagaccttttatgtttcattcgtggtttttctttttttgataggtgagttgtggacagctgagtgctagttaaatatagtacatagaaagaatcttgaaaagaaaactagtttgaataagccaaagtagaaacttgttgactcataaaattctagaaaaaatgagtatcttaaattgcactaaagaggctgggcatggtggctcacgcctgtaatgccagcactttgggaggctgaggtgggcagatcacttgaggtcaggagttggagaccagcctggccaacatagtgaaaccccatatctactaaaaaattcaaaacaattagctggacatggtggcatatacctgtaatcccagctgcttgggaggctaaggcacgagaattgcttgaactcggttggtggaggtttgcggtgagctgagatcatgcccctgcactccagcctgggtgacagggtgagactgttacccattaaaaaaaaaaagaaaaaaaagaaagaaaaagaaaaattgccaggactctngctgttctctttgattcttctggtattactttcatactcagtgcagattaatggcgttgcaggttggtctttattacacccaaggtttatatcttgagttnctgctgtagn

SEQ ID NO: 254982 - DNA, 480 bp, Homo sapiens
cgtgtttcccattatagtgtcttacaggtttttcaaattaagttctgcacttcagaatggttgaaattataggggaagcgatattccagaaaataccctgctggttttatttctaatgcaaacataaatgaggaatgggaggaaatcttctgaggtagtgagtcttagatgtcagctcattctgtattgattgcaattaatacaaataggcaaaatgtgttctcattacagtgagaatatgattaaagtttgtataaaaggttgaaacttgagttatttgctgggaagcaaattcctccaagcaaaataataaaagctacaatattattaagtttaacatatgccaaggattgtttttatgtaaaagtcagtatactacagccctctggccaaatctggcccactgctcagcctcaatacactccagttgctctattcaatgcctgtttttgtaaataaagttttaatggaacacaacca

SEQ ID NO: 254983 - DNA, 488 bp, Homo sapiens
aacaaaacaaaataggatttaagccctggtaacctgacgccaaaggccacagttgtaaccactgtgctgtgctgccattcttagacactacatgtatgcaatagggattaacaagggtggcgagaagttaccaatttttgttatatgtaccacaggcacttaaagtaccttatctaatcttatctaataaaatccagtgaagtaagtattagctccatttcctacatgaagaaactgaggttcagagattgaaggcaattgttagttagtggcagagctgaaacccaaacacagacctgtctggctccaaagcccgaggtcttttgttatagctctttgcttcaaacaactcatttgaaacttgtttctaggccgggcacggtggctcacgcctgtaatcccagcactttgggaggccaaggtgggcagatcacgaggtcaggagatcgagaccatcctggctaacatggtgaaactacgtctctact

SEQ ID NO: 254984 - DNA, 424 bp, Homo sapiens
aggatttaagctcttaggaaccagaggttaaaaggtagtcagtatacactactatacatactagcatatatgctaatatatgctaacatttatagaatatatgtatatatactatagttgtagtcagtaaagaaattttaaaacacaacataatgaacaaaaacaattagctaatctgtatctatgtatctaaatccgtaggcatttattgttttattaagagtgaggaaaccttagatgggtgcagccagaagctaaaaacaatcttatcatagtgaaagatgcatcagaggtactgaaagcctttaacatctccactagtatttctcatcatctttgaaatcagaaaaaacaattttgcttccctttaggaacgtcagcccatacagttgtcagggtcttcacggagttgacctctgtttaa

SEQ ID NO: 254985 - DNA, 330 bp, Homo sapiens
aggactatttgccttcctagacttggtactcccttgactccctcagtcccagccaggagagtgtcattttaggccattgtcacactaggatgtaggaggtgataaagacagcttagttaggcttaggaccaaggctgtgtgagaaccaaccgaagacagacctgcaatgtgtcatctggtacttacggcctctgtttgccaggggctaagtgtgataatgggtcagaaagtataaggtttacaaagtagctgagatgccacctgggacctactattaaaagccagggcagaatcctacaactaggaggtcataacagtgcttggaaggcc

SEQ ID NO: 254986 - DNA, 389 bp, Homo sapiens
atgtttttacagaatatcacatttactaggaaaatgtaagtaacataacattaggtaatattgaatcatccagaaatatcatagaataaaggtaaagttgacataattcttagataatccattggtcttggaaggactcttatagagatctgtttcaggctttacctttaggaccttcaggaacacttgatcacttttctgtgcccttaagggtcctttgggaataatgtttgagaagcaccaaccagctgtaccctctggggagtgataacagaaggcagagtatgagcatggccttgaatagtaagcaggaattctgcaagcaacaggggtgggaatgggccatagctttctgagaacaatgtgctcagggcagcattttttgaaga

SEQ ID NO: 254987 - DNA, 598 bp, Homo sapiens
ccacattgttttgtagtttcactgtagaggctcagacatctgttttaatctgtccctaagcatttttttggtactgtaaacgatactttcagaaagttcatcttgcaatgatttattctatatgaaaatacaattacttttggtgtatagaatttggatcctgtgaacttgctaatctcacctattctggcaaaattttttttttttttggcagattccttaggattttaagtacacaatcatgtcattggtgaatacaggcagttttacttcttccttccaattgtttttgtcttttctttttcttacctattacagtggctgtcaatacaatgttaaatgtctttattttttatctcaaggaactatagattttctacctctagtagtttcagtagtttgcatcttttaaggacttcatatgttccagtaagttgtgaaatgtattggtataaaagtttatagtatttgcgttaaaatgtctgtaatatgtcatggagtctccctttcctttcttgttacctgaaccttgtgttctttggttcttctctaactagaggtttataaattaaatttgtttgaagaacatttaatttca

SEQ ID NO: 254988 - DNA, 590 bp, Homo sapiens
cggtgtgctcccttgctaagacatgaataaactccagctttgcctatctgtgagatttcgggtggtgtatttcagggcgctgacatttggcaaaagtaatagtataggttacatccgaggagggaactgagagaagaaatgtggaaggtgtctcttaggacctttgaatttttacgtgggcgtgtattgtctattcgaaaataaatgctaaaacaaaacaaaaagtttaaaagcaggacaccattgtgtaatctcctttctgaccagaaggtggcgcctccacctttcctggggctggggaaggggaaagctgtagagaggggagaaaggtcccagtgaaacaacaggggcctacattgagagtggaaattttacctcctggcaagaaaggtccagaatctctcttcacaataatagctaatatttattgaatatatattaaatgccaattaagatttttaaaacaggccgggcacagagtctcaagcctgtaatccgaggactttggaaggctgcagccagtggacagcttaagtctaggagtttgagaaaagcctgggcaacacggtgaaaccctgtccctatttttt

SEQ ID NO: 254989 - DNA, 700 bp, Homo sapiens
ggggtctcaatatattgcccaggctgaatttgatgttatttcaagttgatttttgtgtgtttggaagtttgtcttgctcctcaactactatgcaggtagacagtcatcccccagagattcactagattgccatatagaggcactttatcatttccctattgttcctaatacagaattgtagagctggaaagtaacttcagttttctaaatctattcctaaacaggatatcactaacttctttagaatcatttctcagtatacatcaacttattgagaactgtctaatactcaaagaaatgaaatcttgagttcagtaagctgtgttccaagcaggaatcattttcacttaccaaaatatctcctattacctcaagctatccttgttgaggaaagctgaaaattaaattttaagtatcaagtctagaccatagagtgctttggtgggagtattttgattatatacctcctacccatcagaagcaggcagctaatattgtgaactgagcatttttgtcaaaagtcacaggcaagagactagagaagaatgagaaaggtcaaatggaccttgtgtggctgactacatggatcttgttcttggaggtctgtcacagaagagcacatagaggtgaagaaccagacagactcagtcagcatccttacctagagatggcacatctctattaggaccaatgcaatacc

SEQ ID NO: 254990 - DNA, 90 bp, Homo sapiens
catgcgtgattctgcatctttgtttatgctgtcccctctgcctgacagcccctttcaattcactgcttggctaatttcaatcagccttta

SEQ ID NO: 254991 - DNA, 392 bp, Homo sapiens
cactgctgaattgagaggtgtgtgatattaggttgttccagtatttctgatgggaagtgtgatcacttaattaaggtggtgaccactggatctctcctttgtaaaatagggtttttcttgacacttagcaagtaatctttgggggtgacgctttggcaacttccaaatatcctgtatctcaacaacgtcttttttgttttttttttccttcactctgcagcccagcctggagtgcagtgtcaaaagcacggctcgctacagccttgacctcctgggctcaagtgatcctcctacatcagcctcccaagtagctgggatcaaggtgcactaccatgcctggctaattttttaattttttggagagacggagtttcaccatgttgcccaggctg

SEQ ID NO: 254992 - DNA, 462 bp, Homo sapiens
ccaatagaataaggcaaaagttacacttctagtttcctggttccaagccttaggagactcttcacttactcttcctgtgtcatggaatgcctgctcttggagccctggaccaccatgtaaaaagtccaactaccctgctggagatgcaatgtgaagcagtgatgagattacatggagagagtgaaaggcccaactgagcccagccttccactttgccctgctgagatgctgggcatgtgagtacaactcacttggacactccagaccagaccagccaccagctgaaggtcactaagtgactccagtcagtgccatgtgaaatgaaagaattgcctagccaagacctgccagaattcttattcatcagctataatatggttgttgagtaagccactaagttttgttacagtgcttgttaacgtgttacaatgatgtaataaaagtttctgaactgatttacta

SEQ ID NO: 254993 - DNA, 442 bp, Homo sapiens
ggagaagctgaaaattggttggtataaagagaagtgatttgtagaaacaaagtgggaagaatgttcatagacatcaaactcttcaacaatgtgaaagaaactttagtttctaaaggtcagtaggatagaccattttttgttttatatattactttttggcccaacatttattcaaccagtttttaatggaaaattccccattgtcaagcactgtgtcatgtattcgagctataaaagtcagtgtatttgggccgcagaagtcatcatgacagacgtagttcctactctgtggatgtacaattcatagattttgaggcatatctttgcccagacatgagaagactatcattttgtaaccgaacaatcagcttgaagccaaaacatacattttatcttatatttgcttctttgttttagcacccagccattataaattccacac

SEQ ID NO: 254994 - DNA, 225 bp, Homo sapiens
aacaaacaaagccttcatgtcagtaattttgtagacacgctcggggctaggtttgtggtaaaaccctgagaagctcccagtttagttcaattaaacgctttctccttgagaagatgacccttttctgttgaaagctgcactgagtcagcttgtgggtctttgagaccccaaaattcatagcttctctaggccctgggggctgcaccaggtggctttggggttgtt

SEQ ID NO: 254995 - DNA, 301 bp, Homo sapiens
aaagtgttgaaaaatcaatagatttgtcaaaaagctcaatcggcattagaactctcaacaacaacaaaacaaagagtattttacaggcttccaagaagctggcaggaggataaaaacagaatctggtcacatcaggtttggtgttaaaccttaacccagagaacattactgtacacaaaagtcctttgttatatttgggattctattttaattaaaaatagctaagcataaaaaaactttctaacctttttgtttctgagaagcctataatataaacataaaaattatacactttttgaca

SEQ ID NO: 254996 - DNA, 542 bp, Homo sapiens
agggcctttgaggataatttggtcatgagggcaaacccttcatgattggattagtgcccttataaaagaggcctggggaagcctgtcggttcctctttgctcttccaccatgtgaggacacagcaagaaggtgccatctgtgaagaagagagccctcaccaagaaacaaatctgctggcaccttgatcttggacttcccaacctccagaactctgagcaataaatttctgtttataataatttataaattgcccagtccaaggtattttgttataccagcccaaacagaccaagtcaggaggccagggaaatgtctgtgcctggatattcaagggagaccagctacggtgctttcaggggactcctccaaagccatgactggctgtctccagttttcctaattgggaaatgagccgcccaaggtcagacactgacacagcgttatcttagctcacattttaaaataaagatttcctctgttctaggtacaagagaataactgttccacgtgaagtatacttagaatagtaattaacttgatg

SEQ ID NO: 254997 - DNA, 209 bp, Homo sapiens
  misc_feature (122)..(122): n is a, c, g, or t
ggattgtctacaggaagtacatattcactcgcttcttcagggtctccagacctgtgggcaggcgagggcagcccaggtctagaacatgaccttgagaatgagaaggcttaaagctggaatcngtatgaacaagctcacttggacaacagacctgcagccacctgttccaatctggcttctatcagcaatcaaggtaataacttacaaga

SEQ ID NO: 254998 - DNA, 391 bp, Homo sapiens
gagtctgctaaaagttaaaaacattacatgagaactccttaaccattatgaaggattctttctactcttgagattcataattctgtgggttgctatagtcagtatttaccagcatgtctcccatctcacaatttggtactcttaggattctttggttcagagaatgggttcagattcccattctgtcaccagctgtgcaggccttggtcaagttacttggtcaagtctcagtttactcatttataaaatagggaaaataatacccacctcataaagattttagtattaaatgagataatatacgtaaaatgtttagtatggtaccatgagtagtgtattagtattatagtctttttgaaagtttgcttgctttaagggcgtgatgttttca

SEQ ID NO: 254999 - DNA, 118 bp, Homo sapiens
gaatgtgaacacagacacagattgtgcaaattggggtgcggctgttgagatgacaactattgtttctttagggagaagttctccaaaaaattcctccctgacctgtttgaggggatag

SEQ ID NO: 255000 - DNA, 416 bp, Homo sapiens
gctcatttcttgtcaactcttcttgctcctgaggtcaaggcaggtactgatggcaaatactgaggacagagggaggatcaagaagagaacactgaatggcctacagcaacctacagaaagactgccttgggatggaacgaacacaaactttttattcagaaggcaagacagtgcctccgatcaacagcttaacatctctaaggagactacctgctggcctgagccctgccctcgaatctgccacataacatggcctcctactgctgacacagtaaaatggaatgatccatctgtaaaaggtccataaggaaaaaagggaaggataaatttcaagttttaatttttatctaataatcttggcttggcaaaataaattcatagtcaggcttgatcaaccagcctgaaatttgaatatc

SEQ ID NO: 255001 - DNA, 419 bp, Homo sapiens
aacgttcagacgttgttagacatctaaatattcaacgttctacctgtataatgttacttaatatttttctttaagccaagtttaagttctttaaacttaaattcatctcaaggaaatctgtcattaccttaaattaaaaccagcatcatgatacactgtaaatgtagagtaaatgtaacactaaatataagtttagaaccaagtttgttaaattctacctagaaagatataagacagtgtagaagaaagctgccatttatattaaaaagaggaaaaggagcctctttcttaagacatctctggatgaatgtttaagaaactgatggttattgcctctgatgaggggaattagttggcttgaggacgaagtggatggaagactttttattatctttacccctttgtgtccttttaatttt

SEQ ID NO: 255002 - DNA, 426 bp, Homo sapiens
gggggtggttcctcgagggtgtgggcataggtaggaaaagggtggatgatgggaatgacacagaagaattagagggagtgacactgtgtataccttttgaatcgttctgacttttagaatcatgtgcatatttcatgtactagattaaaaattttttttaatgagaggaaacccaaaatagaatacaaacagaaataagtggcactaatagttttacaaatgatttatatacttccactgaaaagatgggggaactaacctaagaaactttggaaaacagtgtttttattgcatcctcaaaggctaaaaatgaaaagacgtatatacacatatcataccatgactagttggtcaatttttcacaagggtatgggtcactgattctgaaactattttacatgccttctggaactgagcaaatcagtc

SEQ ID NO: 255003 - DNA, 657 bp, Homo sapiens
  misc_feature (455)..(455): n is a, c, g, or t
gagatattagacaggaaatagaaaaactaactgctaattctcaagtgaaaaaactaagatggttctcagaatgtttatctcctccaggtggcagtgacaatttatggaacttggttgctgtgataaaaggacaggatgatagcttacttcctcagaactactgcaaaggaataatgcacttgaaacatctgattaaatttagaacatctgaagctcaagaactaacaacagtcaagatgtctaaatttggtggtggtattggtgtacctactaaagaggaaagactgaaggaagctgctgaaatccacttgagattaggacaaattcagagatactgtgaacttatggttgaacttggagagtgggacaaagccctgtcaattgcaccaggagtctctgtgaaatactggaagaagttaatgcagaggagagctgaccatttatccaggaagatnaggatgatgtcttccatacttgatatccattggggatgtgaaaaagcttattcatttttcatgtgaagaggcaacttaaaaaactctgttgttcacaagctgttgtgaaggaatattgaggccttacatggtccggcgctaaagagcttctattttgatgatatctccaaggaaactttattgtactcctgccaaatcatta

SEQ ID NO: 255004 - DNA, 402 bp, Homo sapiens
gcgcaaaacagaagagaggacgtacgcctctaagagcagaaagtcatgtgtacgtccatacataggatatacggaatatgaaatgttttggagggcccagtattcatgttttcgtacaataatctatatgtgataagcctgtatgaatttctttgatttcaataggatttttataagtcaaactctgaatgctccttaaaatgcacatatttcaacacactgcctttaaaagtttatgacagttaatatgtgggctatttactgcttatttaaatgttgaccaaattgtctactgtatctgactaatcatcatctcttttcattttggaagaaaaattattcaaataatttttaagacccaaatgactttggatttttgcaaagaggatgacagacagttta

SEQ ID NO: 255005 - DNA, 3018 bp, Homo sapiens
cggcaaaaaggagggaatccagtctaggatcctcacaccagctacttgcaagggagaaggaaaaggccagtaaggcctgggccaggagagtcccgacaggagtgtcaggtttcaatctcagcaccagccactcagagcagggcacgatgttgggggcccgcctcaggctctgggtctgtgccttgtgcagcgtctgcagcatgagcgtcctcagagcctatcccaatgcctccccactgctcggctccagctggggtggcctgatccacctgtacacagccacagccaggaacagctaccacctgcagatccacaagaatggccatgtggatggcgcaccccatcagaccatctacagtgccctgatgatcagatcagaggatgctggctttgtggtgattacaggtgtgatgagcagaagatacctctgcatggatttcagaggcaacatttttggatcacactatttcgacccggagaactgcaggttccaacaccagacgctggaaaacgggtacgacgtctaccactctcctcagtatcacttcctggtcagtctgggccgggcgaagagagccttcctgccaggcatgaacccacccccgtactcccagttcctgtcccggaggaacgagatccccctaattcacttcaacacccccataccacggcggcacacccggagcgccgaggacgactcggagcgggaccccctgaacgtgctgaagccccgggcccggatgaccccggccccggcctcctgttcacaggagctcccgagcgccgaggacaacagcccgatggccagtgacccattaggggtggtcaggggcggtcgagtgaacacgcacgctgggggaacgggcccggaaggctgccgccccttcgccaagttcatctagggtcgctggaagggcaccctctttaacccatccctcagcaaacgcagctcttcccaaggaccaggtcccttgacgttccgaggatgggaaaggtgacaggggcatgtatggaatttgctgcttctctggggtcccttccacaggaggtcctgtgagaaccaacctttgaggcccaagtcatggggtttcaccgccttcctcactccatatagaacacctttcccaataggaaaccccaacaggtaaactagaaatttccccttcatgaaggtagagagaaggggtctctcccaacatatttctcttccttgtgcctctcctctttatcacttttaagcataaaaaaaaaaaaaaaaaaaaaaaaaaaaaaaagcagtgggttcctgagctcaagactttgaaggtgtagggaagaggaaatcggagatcccagaagcttctccactgccctatgcatttatgttagatgccccgatcccactggcatttgagtgtgcaaaccttgacattaacagctgaatggggcaagttgatgaaaacactactttcaagccttcgttcttccttgagcatctctggggaagagctgtcaaaagactggtggtaggctggtgaaaacttgacagctagacttgatgcttgctgaaatgaggcaggaatcataatagaaaactcagcctccctacagggtgagcaccttctgtctcgctgtctccctctgtgcagccacagccagagggcccagaatggccccactctgttcccaagcagttcatgatacagcctcaccttttggccccatctctggtttttgaaaatttggtctaaggaataaatagcttttacactggctcacgaaaatctgccctgctagaatttgcttttcaaaatggaaataaattccaactctcctaagaggcatttaattaaggctctacttccaggttgagtaggaatccattctgaacaaactacaaaaatgtgactgggaagggggctttgagagactgggactgctctgggttaggttttctgtggactgaaaaatcgtgtccttttctctaaatgaagtggcatcaaggactcagggggaaagaaatcaggggacatgttatagaagttatgaaaagacaaccacatggtcaggctcttgtctgtggtctctagggctctgcagcagcagtggctcttcgattagttaaaactctcctaggctgacacatctgggtctcaatccccttggaaattcttggtgcattaaatgaagccttaccccattactgcggttcttcctgtaagggggctccattttcctccctctctttaaatgaccacctaaaggacagtatattaacaagcaaagtcgattcaacaacagcttcttcccagtcacttttttttttctcactgccatcacatactaaccttatactttgatctattctttttggttatgagagaaatgttgggcaactgtttttacctgatggttttaagctgaacttgaaggactggttcctattctgaaacagtaaaactatgtataatagtatatagccatgcatggcaaatattttaatatttctgttttcatttcctgttggaaatattatcctgcataatagctattggaggctcctcagtgaaagatcccaaaaggattttggtggaaaactagttgtaatctcacaaactcaacactaccatcaggggttttctttatggcaaagccaaaatagctcctacaatttcttatatccctcgtcatgtggcagtatttatttatttatttggaagtttgcctatccttctatatttatagatatttataaaaatgtaacccctttttcctttcttctgtttaaaataaaaataaaatttatctcagcttctgttagcttatcctctttgtagtactacttaaaagcatgtcggaatataagaataaaaaggattatgggaggggaacattagggaaatccagagaaggcaaaattgaaaaaaagattttagaattttaaaattttcaaagatttcttccattcataaggagactcaatgattttaattgatctagacagaattatttaagttttatcaatattggatttctggt

SEQ ID NO: 255006 - DNA, 272 bp, Homo sapiens
ctactgcctaaattggcaaagcactccatcgatcagtgataaatgtggtccttgggagactgcttttatgtttgtttcactcatgggaaaatggccacaacccttttgtaagattcctcggctgctgctctccccaggttacaatcatagtaactgctgcttctgggatgcctcgctgtaatcctcatgttcaatgatggctcaatggatatgtgcttgaaggagagtgagtgatggggagtctacagttatgaataaaatatattcaagtc

SEQ ID NO: 255007 - DNA, 694 bp, Homo sapiens
tagagctagtaaaggtacctaagcttctgggcaggacaccaacagcaaccactccaggaggcgacatttaagcagagattggaatgacaagaaaaagctggtcacaccaaatacagaggaagagtgagcttggcaagtctagggcctagaagaaggtcaataggcctgcactgtagggggtgaagctctagagagagtggtatcagagaccaatcacacagaactttgtcagcccagaaaggctttcaaaagacattggtggttttaaatcggggcacatgattgaattctggatttttctgatgtgagcccatctctggcctgaagttgccttccatttatagtgtgatactagtgtaaacaaaaattatgggaggccattttttaggctgagctctagcactaggccgcaacagaccagtccaaaccaaaatgaagtcactcatgctaaatgccacgtaatcaaactgaaactttaaggaaacagatacgtccccacagccctatatttgctgaaaacaggagagattccagtctacctgagttggcataataatgaagtcccctctgtttaacccttatcaaaaaagtaacctgaaattgaccaatcacctttttttcttgttctgttttcttgtccccaccttgcaaaacccaccattctgccattgcccagagtgggggtggcggtggg

SEQ ID NO: 255008 - DNA, 794 bp, Homo sapiens
tcaggtcaggatgggcaccgtgcgcccacctcgcccctcgctcctgctggtctccacccgggagtcttgtctcttcctcctcttctgcctgcacctgggcgccgcctgcccacagccctgccggtgccctgaccacgcaggggctgtggctgtcttctgcagcttgcggggccttcaggaggtccccgaggacatcccggccaacaccgtgctcctgaagctcgatgccaacaagatctcccacctcccggacggggccttccagcacctgcaccggctcagggagctggatctgtctcacaacgccatcgaggccatcggctccgccaccttcgcgggcctggccgggggcctgcggctgctggacctgtcttacaaccgcatccagaggatccccaaggacgccctgggcaaactcagcgccaagatacgcctgtcccacaaccccctgcactgcgagtgcgccctgcaggaggccctgtgggagctgaagctggaccccgactctgtggacgagatcgcctgccacacctcagtgcaggaggagtttgtggggaagcctctggttcaggctctggatgcgggtgccagcctctgcagcgtcccccacaggaccacagacgtggccatgctggtcaccatgttcggctggttcgccatggtgatcgcctacgtcgtgtactatgtgcgccacaaccaggaggatgcccggaggcacctggagtacctgaagtctctgcccagcgcccccgcctccaaggaccccatcggcccggggccctagcgcctgttcc

SEQ ID NO: 255009 - DNA, 146 bp, Homo sapiens
gaaaaagaaaaacctcacatgggtaaaactgttaggaaggctcttatctcttcactggtcatgaaatcaacttagtggattatgactagtattttttaaaaagtgatgtagaatagggctgggcgtggtgtctcacgctggaaatc

SEQ ID NO: 255010 - DNA, 422 bp, Homo sapiens
ctaactcggggtataatagtagtcttttatattcttgaagttgattttaacagaaaatatgatacatgttatttttagcacctatagtaaatattttgaatttatcctagaatttaagtatttctagagtgttaaagatcatgaggcacaaaagctctattgaacctagcaatttagtttgatcccacccacttgttctaatctcttgtgctcaatattctactcacagatcaaaatcaatgacctagaaaagatgaacccaggcatcaatgtagacagacagtataaaacaagaatggaaggctaaaatggtatgctaaaatgaatacatttcatttacatatactaaagatgaacacagactaattttgtatgttgtcatatgaaatttcttagtgttagtgtgtcctctgttagcctct

SEQ ID NO: 255011 - DNA, 3771 bp, Homo sapiens
cagtctgctgagtctaggctgttttcctcagcactgactgcatggcagctgtgtgctcagcccgcacaggcaggctgtgttgtggggtccagaggggctgatacatgtaaagttgatggaatatcctgctcaatggtgaatacgacctaagtgttagctgctgttatctcctttaatccatacaagaaccctctgagggaggtattatccccattttacagaggaagaaactgaggcccagagcggggaagtggcttgctctgggtcacacagcaaggacttgctggagccaaagcttctggcccaggggcagtgcccttccaggcagaagcagctgaaagccttgttctggcattgcagcccagtgtggaggggcgagacttggggtgctgagagggcctggctcccttcttggtgggctgggagcctcagtgtctggcaggtggctgtgctgggcttgtgcatttcccagccatgtctggttcagcccacagaccccggggctgccctttgcaggtgtgagtcaatgtgggaacccaggacattacggatagcccctgggctgccctcaccccagcattttgggtgtcccttgtccctgtgtcactgtcactcccctcaccaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttccgactgctgtacggtataaagcacagcaggatccaagccttgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggtttgggggggggggggcggggggctagcttctcacagcaggaggcctttgcccccacagcccctccacgcctgcctcagggcctgagaagccaccacttgtatcccccttgtggttagagtcctgattttactgcaaaggtgttcatgttccttgtgaagtgtgggctcttaggaagcctgtgggctcctctgagcagttggcctttgtagctgcaacagcagccacctgcaggttgggtgaagtgccctgacactgctgtagcccccttctaacttctaaccgaagacaagacagacacccatgttcataaataaataaaagtaagcctaagc

SEQ ID NO: 255012 - DNA, 520 bp, Homo sapiens
ttaagttcataacagttcagaatcttgcaagctcacttcaggtataacctgtgtctccaaccctgcagtatttggatattgctgtttaaacagtagatttggcatagatgatggtggcacaatggttgtaaaggaaaagaagcagaacacctcagtttgttcaattctctcattggggttttcagttgtatccagaatttaaaacagtaaaatttaagagtgtgaacagcaacattcacactttgtttagtaagtacaaagttgtgctcatacaggaagtttactgactttgaataataactttaaaaacaaaatttactcttttctaagtgttaattatttgttttaaaatttaagaatgaatcaagaaataaaacattacaccagtggtatgatttagtaattgtctgacttatactttttgtagacattttagttttatttaaattggcattctgatttttttactggtcttgagtctatacacaaaagttgaataaaagaaaagtttcactgacta

SEQ ID NO: 255013 - DNA, 410 bp, Homo sapiens
actccatcaccatgcctgagagtgtccaatcgtctctgcgggggccacatatttttgtattacactgtatttgaaataacaacaacaacaaaaaacccttcaagattcataaaattggacaactgtctttgtaacacttctagtggtaaaaccagtaaggatggctagtttgcaacccatctgagcagcctctctggtttcatagatatgttttctctctgacattgaatggctttcaacttgaaacggaatgctacatcacaaagataaacaggtttgaaaggaaccggttttccttgtaatcctaaacgttcaagtctgcgcattaaaagacattatctgaagaagggtgcacaagcttcctgttggccgccagaagggttctctgcaggacacagatcaagtaccac

SEQ ID NO: 255014 - DNA, 307 bp, Homo sapiens
tgaattcctcaccgactgccattatgttggtgtgtgggaggcagatacatgcaattgcctccctcaagtgtctgcaatgttgctaagtgttcactccccaacagattttttttgaatacctagttagtgcagggtacaaaatttgcaccctgtctacaaatgacagcggtaacaagaaacagcgtggtcagtcttacaaacaatggggccaatcatgtgccaagggatgagcattgagcaagacatgattttgaaaactcaacaaattcaaagctggtgtgaacggctctgcttcctggaagccatt

SEQ ID NO: 255015 - DNA, 513 bp, Homo sapiens
tcattcacaaagcctccatgagtataggagctcacactaaagcaatagttaacatttataactttatagagtgctaactcgtttgttacatcattagatctgtacatcagttcttttgtgagaatattaaagctcagagaatttttaactttttattttgaaattatagcaggcttgaaagttgcaaaactagtacaaagatttcctatatacctttcatccggattctccattgttaacattttaccatgtttgttttatcattctccctctgtataatatgtactaatttgttctgagctacttgacagtaggttatagacatgatgaatacttcagtgtgttatttcctaaaaacaaggaaattctcttatacaaccacaattataatatcaagatcaggaaattaacacagatatagtactattatcttatttaaagacctgtaaattttgctagttatcccacagtatcatttattttaaaaataaataaaaaaatgtatttttcaga

SEQ ID NO: 255016 - DNA, 377 bp, Homo sapiens
cacacaaatagggacagttttactttctttccaatttttatacctttatgactgttattgtactatcccagaccttcagtgacatgttgagtagaactgctgcaagtagacatccttgccctctttaaatgtgaagtggggggaaatgttcaatgcttcaaaacttaagttaactgtaggttttttaataggtgtccataagactgagtaaattatttttttagtttgctgaacgttttttgtttttattgtaaatgagtagtcaagttagtaaaatcttatttagcatctattgagataatcatatagtttttcttttttattttctgaatatggtaaattatgttgattaaaaatttttttgttgtaaaatgtaa

SEQ ID NO: 255017 - DNA, 687 bp, Homo sapiens
cctcaaatatttatctattgagttgcatacaatggaattacactctttaagttatttaaaaatgtacagttaggttattcttgactatagtcagcctgttgtgctatcagatagaaggtgttattcattctttctatttttttgtacccattaaccatctccaccttcctcccaaaccccaccacccttcccagtgtctggtaaccattcttcttctctctgttcatgaattcaatatgttatcattctcagtctctatggaaaaaacacaggtagagagtagataccttcaatcctactttcctaagggttttctaattgtgttggggtggaacaggtgtacttcgttttgaactaaactaaattaacccaatttcttctgggtcactcttttatatacaggcctgacctactttatgaattctgacaacagtcatgagtgaatgtgtatgcacctatgcagtttgtatgtggagggggaagtaaactaacatttaccgagtcaagattcatggcaaataattgtatttatttgggggacaagactagggaaaagcaaatgagacacttgctttaagctcaaaatttaagggggtgccaaaaaactcagtaatcacaacaaatcatagtttagtgcaatatttttaaaaaatcaaatcaaggccaggcttggtggctcacacctgt

SEQ ID NO: 255018 - DNA, 286 bp, Homo sapiens
actcaaaactctgaaacagctttgcagtgtttccaatgaaaagagaaacactattttgatgttacaaatataagaagtggggggtctgaggcactttacttttattatttcatttcactaggtataagaaagatggtcaagtgggagcttatgatttggggataaattagaatcagtttcattattataatttttatcttgagaaatgtattaactatcatttattatcttgagaaatttacatctcaaagctagaaatttacatatctgaaaatcacctaactgt

SEQ ID NO: 255019 - DNA, 430 bp, Homo sapiens
tcaacccacttgatcttcctgttctcatcccacatctttctgcaagtcttctctaggagctggctacagggtcttcccagaacagagcccacagttcaggaaaccctgcctcatctccagtgcgaggacggtgacagagaaggggcagagcagactgagatgaaacaagttcaaacagcttacgaaaacctgggaatccaagcagatatctgtccacaaaagcagacaacgtcaactgtatccgattcacatttagaatgcatacatgtttttataaatgtacatagctctacatatgtcaaatatcagtgttaaatttttttagtatgagaatcctgttaaaggtaatagctcatggatcctactgctatatatatttctggactaataaagaaagaaataatcgtattgaaagcagatattgtacagt

SEQ ID NO: 255020 - DNA, 581 bp, Homo sapiens
tgtactattgctttttcactgaattaaactgatttttacagagtgactgctataatcataacactgggctagactactgtgattaatacaggtaagtaaagacggttttaaaattatgaacagaacttagtcctagttcacagtctctaaactggtaggggtgtgtgtgtgtgtgtgtgtgtgaaactacgtgacaaggattatttacacaccattatagaagtcacactaattaaatctaatgaaagacatgtattcagttttgatattttccgtaagagtcaggcaaaagttcccaacaaacttctaaatctataatcaatccaaaggaaattataaacaataggctttgtatagagagagtaggtggatcatattaggcaataatcacatagttgatttcttactataaattatgatttatgtatcataaatagcatacaaatgtttgttaaatgaatgagatcttacaaactattactgggaaaatctttaattggcagctcttctctgatacggggactccaagggtccttggaacctggggactggggacttcctgattattttcaagtagaagt

SEQ ID NO: 255021 - DNA, 275 bp, Homo sapiens
gttttggcttctgtgtgtgagttttcaatacaatgtttcaaaggccagagcagctttccctcctcctcagggagtgagccagcatccaggtgtctctgaagaacaatacctacccttgactccccaggtggctttgtgatgctgagcctcacaaagacagggaggtcttgtggaagggaagccctcagccctcagccctcagccctcagggtgctgactggggtgagctccaggaaaagcttgcctaattctcacctagaaaaacagagctcttc

SEQ ID NO: 255022 - DNA, 405 bp, Homo sapiens
atcgctatcctgataatatcctgtttgagctatgctttggtatatggaactacactaagctttttaaaagaccgtcattaaattaatattcattgtatgactttaatttaaaaaatatagaattctgttaatatcaacaatattattcatcataatctatcttttctcaacttcagcagaactagcagcaattgcattaaaacttttctagcccttacaacattgaccatgattttgttagttccacgtctctatcatcaacattatcacattctatcacaaatgtttatgggactgcctgaaatatgcaccatgtgatgtgcgatgtaaggcttaaaattaaggcccaatattatgtgctgcctcaacatttagtgaaatccgcagggccatgaatggcctaac

SEQ ID NO: 255023 - DNA, 462 bp, Homo sapiens
aagaacttggtcaagatggggaatcttgggtcaggaaaatttggagacttacttgaagagaatatttgaaaaagattcaaagattttgaactatcagggtagagggaaattgtttctggtggttaaaatggtaggaagtggctttcaaatctgaaaaaatctaaatgttttaaggtgttccaggcactgtggttaacaatttatattccttttcttatttagtcctcccaacaaccctgccaaagaggtattattattcccctttgaagtgaggaatcttagtgcattcaaaaacattcatctactatttattgagcacccatatttctaagtgctgataatgtagttgtgaacaagacagcttatattttagaggagacaggtcattagcaactcaacaaataagtagcataattttcctaggaaaatatgttgtgcagaaggtaaggctaggttacaggt

SEQ ID NO: 255024 - DNA, 304 bp, Homo sapiens
ctccatgaaattttttttaactaacaaagaaacaaaacataatcatagtaggctaaattgcccagcggtgaataatatatccagaggcataaacaaagtgtgtcgatttccaccaagcccagcataacatgggctttcctctttatggtccaagatggctactttccagccgtcctgcctgcactccagccagcatgagtcctctttgttccagctatcctgggtttcttttggttaactaggaattgaattaatgaaattcaattagtaaattaaagcattaagttaataaatgtttgaatta

SEQ ID NO: 255025 - DNA, 286 bp, Homo sapiens
gagtctttgtcacctgcctgaatgctcctgatgcctcctaggccactggggagagctgtgcttgtcccacgctctggcacagagtgtctgtcccgagtgcttcctctaaacctttcctgtgcagaagctgggacaaattctgtgcatcctggtgcagaacacacctgttcagaaagtaactgggtggtgaggagtttcctttgcaaataccatttgtggccatcaagaatcactaaatgacattttcttccggaatgtacatattacaattcatcttcaaaaggca

SEQ ID NO: 255026 - DNA, 440 bp, Homo sapiens
agagccatcagcacagtcatctccctaataagccttgagagtgttgtcaaagacacttctggatataagtaagaaaccattgagactgagttgtatggttaaacagcacagtttttagggagaggcaaaggcaactctgtgttcagctcttagttctgacacttatgaactcagatttaaattccctgagcctcagtttccctgtctgtaaaatcaggataaaaatttcttgctcaaggccaacaaaaacaagcaatggggtaaaggactccttattcataaatggtgctgggatagctggctagccatatgcagaagaatgaaactgaacccttacctttcaccatatacaaaaattaactcaagatggattaaatcgaaatctaagacctcaaactgtaaaaatcctagaagaagtcgacgcggccgcgaatttagta

SEQ ID NO: 255027 - DNA, 583 bp, Homo sapiens
gatcatttttttattgacacactttttctcaaatatgacttgaaattttaagtctcaagggaatcggttttctgttaatcattaccatagttagtattattaataatataaagaagtttgttagtatgtttacttcactttaaaggagctctaaaaggcagaaacatttgaataagttatatattaagtttttcaccaacattttgacaattaaaaaatttaattacataagttaaggcaagccgctctcttgacagtacctcccatctctaccctcactgccttcacctcagaagagccaggtctatttgggacaggtttacaagggcactaaggaaaagaagattgtggtttacgtaattgctttacaagtagatttggattttggctacccacgctctaaacttgggcatgattgtaaagttatataccaaataatattttgcagtattaactgtgcatttgttataacattattattgagtttacttaatatttttcccagtgattcctactgcttgagttttatagatgtcttcattgtttagactctgaattagcttacattcctaaacagaactgt

SEQ ID NO: 255028 - DNA, 455 bp, Homo sapiens
aaatatttagttaacattatttttgaaggagtagcttaaaatttatcatttaatttctaatacagtaaatattggtaagtataacccacataaacaaaagctcattgagtaccttaatttttaagaatgtaaagggatcctaagaccaaaaacttgagaactgctctaggtcatgcacagaggtggctttctatattttgactttgatctaataatacattaaagtcaggtaaagagataactactcaacattgtcttaataaaacatagacatgacattaaaattctggcttatacagactacagtaggaaaaaagctgatataaaaactgcaggagctcacatctggaaaagcatagtaaaaatgcccaaatctagcaaaaagccatacagttaaccctccatatctgtgggtgctgcatccataaattcaaccaagaatcgaaaatatttgg

SEQ ID NO: 255029 - DNA, 494 bp, Homo sapiens
cgagcccgggagggcgcgacaggggcgaggcgaccccagtccagaggctgacttcctcaccgccctgggtcccaatcctgatctgggctaccctatctgtgcttctggtgaggtgggcccagaaccatcgtgtgaataatgattgacctcagctagtggttctcatggagtgattgattttgcttcccagaggacatcagcaatgtctggagacatttccagttgtcactacttgagaggaagcgtgatcggcctctagaagggagagaccagggatgccgctgctcaatatcctataatgcacagaacagcttctacgacaaagagttattccaccaaaaatgtcagtagtgccaaggttgagagaacctgctctagggtaatcagtgtggtcccaatctccctgtcagtaactgattcaactcacataataatcttatgggagtgtgatgtaattctagccaataaaatgcaatgggaagttggccgagata

SEQ ID NO: 255030 - DNA, 578 bp, Homo sapiens
atggggcgtccttactcccagtctttccagatgttcttcccactcctcaactgctcctggctcagaaaccctgcacacctggaagaaagtgagaaccagtttttcaacaaacacattgcacagacttattgtgaaccccgggtggaatcaagcatcggaggaagagaacgtgggtcttgctgtgtccctaggctggagtgcagtggtgcagtctcaattatgccagatggctctgaggtccaagtaaaagataatatttgcaaccaactcactggagttgaccatcaaaactcttttccaggtggaaaagcaccctgaatccagcttcctgctatgaatgaatactgagcttgggttggtggaaattgattttcgagataaagaatccagccaggactgtgaagccccagggaatggctgcacttcaagtcagaaggagcctgggtccctgaatcatcatgtggaaggctctccacccagttcaatggtgcaatggaccacaagcaggaacttaatttagaatgtgcttattttgttagattttgtaattaaaaaatggatcccactctgactgaaaa

SEQ ID NO: 255031 - DNA, 676 bp, Homo sapiens
atggggcgtccttactcccagtctttccagatgttcttcccactcctcaactgctcctggctcagaaaccctgcacacctggaagaaagtgagaaccagtttttcaacaaacacattgcacagacttattgtgaaccccgggtggaatcaagcatcggaggaagagaacgtgggtcttgctgtgtccctaggctggagtgcagtggtgcagtctcaattatgccagatggctctgaggtccaagtaaaagataatatttgcaaccaactcactggagttgaccatcaaaactcttttccaggcacactcaggcatcgcagaaaataatatgtattgtggaatccctcacttgatgaataatctagatgatcagaaatgtggcactattttggctttcaggtggaaaagcaccctgaatccagcttcctgctatgaatgaatactgagcttgggttggtggaaattgattttcgagataaagaatccagccaggactgtgaagccccagggaatggctgcacttcaagtcagaaggagcctgggtccctgaatcatcatgtggaaggctctccacccagttcaatggtgcaatggaccacaagcaggaacttaatttagaatgtgcttattttgttagattttgtaattaaaaaatggatcccactctgactgaaaa

SEQ ID NO: 255032 - DNA, 406 bp, Homo sapiens
aaagccacatgtggactccagccccatgcctaccaaccgtcttgtcactgtcactcggagctccttcctgcccagcggatgtgtccaccctctccttcttcctctaatgttcttcctgtcattgttcccatacgtaactccctcccatcctgtgttccagtgtagatgagcccattgcagcaaagcctttgtgtaccagcctctcatagagaatccagccaggactgtgaagccccagggaatggctgcacttcaagtcagaaggagcctgggtccctgaatcatcatgtggaaggctctccacccagttcaatggtgcaatggaccacaagcaggaacttaatttagaatgtgcttattttgttagattttgtaattaaaaaatggatcccactctgactgaaaa

SEQ ID NO: 255033 - DNA, 675 bp, Homo sapiens
gcaatacacctacctattagtctttattgaaagagtggatgtttaattcccattaattcatacttctataacaagtcagccaatgtttagaggaatttcagtggagaagaaatagctttatgaggtggtggctgagaaagtcaacattgacttttcacttgtttccttcctaagtgacattttggcaggagtaatgaatgagaaaattccctgttatatttaaaagttgacatttttagggcaatttgagttttctatatattatgcatgtttatttcttataatgtcttacaattttaatagaagaagttaaaaagtatgataggctacaagtatattactgaattaccaccacccgtagaagagactatatagaccacttcaagatcctggtctaaaccattgggcttagccttttttctctgtccttgcttctgtcttcccttctagaagagtttccactacgatttgaatatatggcatatgtttagcaatctctctgtctgtattggtctggtttaatccctagatgcttcctttggaagcataactacatgcagcacacaggccaacaccacatcacccttgaactcaccccaaaactcatccagaatctcagcttatgtatagcacctcaagcctatgatgttacaaaagggtctttctgagatagat

SEQ ID NO: 255034 - DNA, 125 bp, Homo sapiens
cccccccaccactccccaaccccagcgttcaaatgactcctgtcttcagctcaaatgttacctcctccaagaggccttccctgattttcctgtttcaagtagtcttccctgcactctgtcattat

SEQ ID NO: 255035 - DNA, 178 bp, Homo sapiens
actctcttacccaagctggagtggaatgtgatcatagctcactgcagcctcaaggctcattcctaggcttaagtgatcctcttttttttttttttgctagagataggatcttgttatgttagccaggctggagaaatttcaacaatattttgaacaataaaaaaaaaataaattaggt

SEQ ID NO: 255036 - DNA, 396 bp, Homo sapiens
aggaactattgtgcctgatctaaagctagctggttcctgtctgttcccagcctagttcttcaaaacttcccttcaaatccttgaaccccccagcatcctttcaatacattatcttttttcatgggcttgcaagagtaggtgcttgtaacaaaaccacctcagctaatgtgggtccatgatgccaatcacctcattctaattgtagtggcagcagatataactctggaatttagagactaagccttctacgcaatggagctgacatggtatttggcacattctaagggacaaggctcatgttcagggatggggcctactgatttgtatggaaatgacaactcatgcctgcaaagtggaaaatcaataaaaattattctgcaaccccacaaaaagtcc

SEQ ID NO: 255037 - DNA, 576 bp, Homo sapiens
caggctaattgtttatatgctaattgtttatatgggttagtcttaactcttttttcgacaattttataggatcttagcatgctcatatcatgtctcctactatttgggtctcttcctactgtcatattgcttggtacattgataggtgctagtacctaaagccttacctaaagccgatgaaactgttagcttagttggcttcttccaggtttgtctttatttggtcaccctgaaagcctaagtgtcttgcaaatactatctactaggtttgttgaatatctcattttgttttctataatcaataacaatgtaagcttggatgcaattttttaaaagtactttaaaaaccttaactctcagtttggatacttgtcccctagctgacagaaataccttggcaaagtagctaaagtcagccctgaagctgaaatcagctgaggctggatagtttaaatcatgcttttcctcttctcaaaagatgatagggaccaaatcaaaatctcaacagtaatttaaattgaactttccaagtagatttctagaattcatatgaaaaagtataataatttggagaaa

SEQ ID NO: 255038 - DNA, 410 bp, Homo sapiens
  misc_feature (359)..(360): n is a, c, g, or t
  misc_feature (391)..(391): n is a, c, g, or t
  misc_feature (405)..(405): n is a, c, g, or t
gctttatttacctcatgctcaatggccagagaatctacatggaaacccttaagttcagcgtgactttcaccatttttaagcacgtgcagcaaaagttcacctgtgtccagccccactgtttggcctgggcacacctaccgactctaccattgtaacatcagaatgataccatttctgtaaagtgacatctttcagttacctggtggcttttccatatatgcaacctcgatggcctgggtaatgtcacaagtgtttgtaaagttgaacgtgaagatttaaacctccttgatttccatgattgtgtagggttttctgggtcaagttgagttattgaacgtttccacaaatcacctccggcnnaggatccaaaattcctcaagttagtattatnatcaaccccgggantcccg

SEQ ID NO: 255039 - DNA, 299 bp, Homo sapiens
ctctgctgccgggccacacccgccaaccccgctcttggagcctctgaggtccggctgggcgtctagctcgcagttgaccccccgggagaggatcggcgcatccggccgcccgccagctccagacgccgggctccgcagcgccgctgtcctagcaccagggcccggcaagcaggggaacgggaccgccgggaccgatcaaggcgcgggcgcccagcaagagccgcgcccggggtctgcgcgccgctcagcgcgctcgcctttccgcccgcgccagggctggctgcgcgcaccctgagcgc

SEQ ID NO: 255040 - DNA, 584 bp, Homo sapiens
tctatgtttctcctaaaatatggtgtcaggaactgaacacagtattccaggaggagtcagatcagctgagagcagaaggaagctacttgtcactagctatccccatcccaggaatcttccattccagctgctaaatgtaatataaattcccatgctgcatggggatactgcttttcaatgacacgttaggttagtgtcaaagaataaaaagaaatacaagagacccacaagttcaggaaacaatcttgacttatcaattcactgcattctaaatccttatctatcaaattagcatgcacccaccgctcctaaggcttgtaggaaataacattgtcaactttaaagaatagtcataaattttattatctttcacaaactcctggttggttcttttagaaatgtgtgtttagggagaaaaacaaaggtattgatgataggtcagaattatgttctttgatgtcccgagaatgtgggaacttatctcccacagaattcaggtgggttttttatttgtttctgaaattatatcatgtttccactttggtagtaaaaacaataaattgatttcttttggaaattgtcta

SEQ ID NO: 255041 - DNA, 466 bp, Homo sapiens
gacttccttgcctgatatctcagatcatgaagctacagttctctccctgctttagagaaaaaaaaaaacagactttttgcaaaaatcaattattgaacatattcctatattctagatttataatgaagcatttttgtacatattcattaaaaagagcaattagaacatttttctctggtttatagtaactaggatggcaacacatatatatcttggaagtattttgtggtatgattcttcaacataaaattatttttcaaaacttcttagaagtctccaggtactcaggaataaggtcattttaaattattccttattgactataagaaaaataattaggcaagatcacaaaataaatgtttagactgtttctcctgtttcctgattttcaggttattttttatcccaattttattttgctgtatagtcataaatttcatctttgaaataaagcatataatcactt

SEQ ID NO: 255042 - DNA, 405 bp, Homo sapiens
gatagtctcttcaacacatggtattgagaaaatcagatatccatgtgcaaaagggggaaactggacttttatcttacatcacatacaaaacccaactcaaaatggattaaagatttaaacataaaatctgaagctgtaaaactcctagaagaaaacataggcgaaaagctctttgacattggtcttgtcaatgatttcatggatatgacccccaaaacacaggcaacaaaaacaaaaataagcaaagttacatcaaatcacaaagcttctcacagcaaaggcaacaatcaacagagtgaaaagaaaacctatgaaatgggagaaagtatttgcaagcgatgtatgtgataagggttgacatctaaaatatgtaaggaattcataactcaatagcaaaaaaaaaaa

SEQ ID NO: 255043 - DNA, 386 bp, Homo sapiens
aaaggctccaggcttcggtatcatcccgtggagagtgacggtgcctgcttcgcgcagtctgtctgagaatcaagtgagatgagagacacaaagtatctaaaaatctacttttctaccggtgcactttcaggtttattcaaattacagagaatgccaggcgtgattctccagccgagtctatgaaaaacaagaaaaagaaaagcttagcacttcttaatgtgtgcgcagccagacacaatgacaggcttgatgttttctctgtgaaatgagttatgagtcatctgactcatctgacaagggaatctgttgagatggaaaaaacaaaatatatgagtgatcagtgatgcaaataaagcaacaccgtcacgggccttgccctggaaaaa

SEQ ID NO: 255044 - DNA, 351 bp, Homo sapiens
tatttatttttttgagatgggctttcactgtattgccaaggctgacctcaatctcctcaagcagtcctcctgcctcagacttctgagtagttggaccacaggtgtgtgtgtgccatcacacctggcttaaaaggccctaattttaaaagaatgggcattgttgtgtaaaatgtaatttatagcaaagttgctatgccatgcaataagtttattcaaagctctccagctaaattagatttcttttttgaaagctgactgataatagaagtaataagtctgcaatcatttttcttttttaaggagatacataattgggtagttgagattattttccatgtatccattgctttt

SEQ ID NO: 255045 - DNA, 532 bp, Homo sapiens
  misc_feature (318)..(318): n is a, c, g, or t
  misc_feature (365)..(365): n is a, c, g, or t
  misc_feature (416)..(416): n is a, c, g, or t
  misc_feature (425)..(425): n is a, c, g, or t
  misc_feature (435)..(435): n is a, c, g, or t
tggccagagtgagtccccagcaccgcaacatctgcaggagatgatgctggtggaagaggtttcccaagcctttgaagggaaaggtgagaactgcctaaaaaatacagcacagagaaagcaagatttctgcaattcatggcttgatacttgatattccagggaatttttttttttttgtctgagactatggggcaagaaaaatgccagcgttcaaacctgggagaatgataagtgttcagcgtctgcaggggctgcctttatctgctcttctagcccaaatgggagttgtttcgcttttttttttttgagactgggtancaagagtgaaactctgtctcaaaaaaaaaaacaaaaaaacaacttcntgtctgggcatagtggctcatgcctgtaatcccagcactttgggaggccanggcaggtgnattgcttgancccaagagtttgagaccagcctgggcaacatgatgaaaccccatctctattttgaaaacagaaacagccaggcacggtgactcacgcaatgctagca

SEQ ID NO: 255046 - DNA, 527 bp, Homo sapiens
gtttcccagattcgtcacaatgcctattgtcctgtccttctctttcctttttcttccccattttgccatctgtctcttatgatttataaggggaaaaaaacttgttttgttagaggggcaggttagaagtcattgtataatttgtaggctttgtaatgattgaatgcaagcgtggaaatttaggctgaactctctatcaaaaggaaaaatgtggaggaaaagggaaaaatcaggagggaggattgcctcatgtattatttatttcgaccttttaggggagaaggaactcccccattctttcaagagattaaaaataaatcaacagtctgaaaacctaagcagacacggagcattatccggatcagccacacacgtgttcccttctatttattataaagaaatttttcatgggaaaatatgtattttttgtatattctacagagtttattctagtatgtatttacatcttgaagaacaagaaagttgttcttgtgattaaactataaataaactatctaattttcata

SEQ ID NO: 255047 - DNA, 693 bp, Homo sapiens
tccataaccttagtgtagtcttatttttcttagtgggtacctgtgatctctaatatgctttgctatctctctttttgttttatatctttaaaaaaatctctatgttttatttttttctggaaggaaacaggctcacttggaatatttacctagattctctctttcacaagaacacgcagtattttgtattcattatctcattatctcttccctggttgtgtctttagaaaagaaacaatggataacagagggtgagtttcagtaattttctcagctcacagagacctaataggacaaatactccaggaacgtatgccttagttcctgcagatgacaatatatgctaactgggattcaagctctaacaaacaggcaagaccaatgtcaaactaataaccataacgtggaagcacattacagtgattttggctatccaactaaatgtaataaatatcaaatgcccaccatttcagaagaattataataaggaatatagcatctttaacccatttctcatttgcctgaagaatacttgcagacagcatttgtggcttaatgtttaccctgaggtaacttgtggcttactgtcctaaccttatccccaaagtttgccatgtatctcacttttattattatttttgcataggtctagcatattgactttggaaacaaaagacatcattctatttgtag

SEQ ID NO: 255048 - DNA, 445 bp, Homo sapiens
ttgtggttttcttctaatgtctttgcctcactaatagcaggataatactcaccttataaaatgaattgggaaatgtcactcttctattttctgacagaatttatataatattaatattattccttgtttaaatatttactacaacttaccattaaagccatgtagaaacattttaaatcaccacatcatcttatttgttagatatatatcgatttcaataaaacaattattgtatcaatctttgtaatttgtgtcattcaattaatttgcccattttatcaaattgtaacatttattgtaatcaagatgttcataaaacatcccaatatcctggcaatatctgtaggatttataaaaatgttctcctttcttgtttgttatcgataatttgtgggtttcttttttccctttctagtctacctagagtttattaaattcaggggct

SEQ ID NO: 255049 - DNA, 688 bp, Homo sapiens
atttaagtattgaagataaaattgtatcccaaaactcatttggcccatttgatgtctctctcagcataagctaaacaggattgaaatgtcattaaacccaattcagctgctaatttgttagtgattgtttggtcataaagaacagtaatacagccaaactaacttaagcaaaacacaaaatgaaatttactggaagaaaactggacacaggccacagaaggctatgtgggtatctataggaactcaaactaggaactggcatgtcagggccaaattaccttccacgtctctgtggggctcggcctcttacctcctctcatctttgcagtttccaaagaaaccgcacacagcctcgtctagcgttcaggactcacaactccaagtctcctcctctgaaccttttaccagtacttgttaaactagacctgtgagacctctgggctctgcaggggtgccacagggcatccccaaatactcaagaatttatctaaaccagcaaacatgtagaccatctggagaatcccttcctgtcttatcttggctttgtcagttgaggttccgtgtaagagaggcatttgaaaaagaggttctgctgtctattttgtgcttccatggaactggtattgagaaggattgattaaaacaacaaaagagtaaaaactctaagttgtgggatgatagtttggat

SEQ ID NO: 255050 - DNA, 703 bp, Homo sapiens
gaataaacaggttgcagagctctcttacattgttggctaaatgaaaaatggtgaaaccaaattgaaaaacagtttgatagttgactagttctttctcacactgctaataaagacatattcaagactaggtaatttatcaagaaaagaggtttaattgactcacagttcagcatggcttgggaggccccagaaaacttgacaatcatgacagaagggggaaagggaagcaaacatgtccttcttcacattgcagtggcaagaagtgctgagcaaaagggggaaaagcctcttataaaaccattcagatcttgtgagaactcactcagtatcatgagaacagcatgagggtaaccgccccccatgattctattaccttccaccaggtccttcccgtgacacatggggattatgggaactacaactcatgatgagattcgggtggggacatagccaaaccatctcagtagtttctcatagaattaaatatactctttaccctagagcccagcaattccactcctacacacttactcaagaggaatcaaaatatatgtctgcaaaagacttgtacaagaacggtcaccgcgacttgattcataatgggtaaaaaccggaaggaaccccaacattcgttaaaagaacagatgaaaagattgtggtagaatcacataacagaatgcaaatcagcagtagaaatgagtgg

SEQ ID NO: 255051 - DNA, 434 bp, Homo sapiens
accgtgttagccaggatggtctcgatctcctgacctcgtgatccgcctgcctcggcctcccaaagtgctgagattacagacgtgagccttagcacccaggctttttttttcattattactgttttttaggggctttgcagcaaaacccagagggactgctagacagattctggaagagctgtgccactcataattttaggtgtaatgagtctgtctggttgtgctgccacgtctctccctgtgccccctggagagggtgtgacgctggttagagggcggagcagagcatcagggtgctgcactgcagcgagggagacaccccatttgttgtgaccccttgaaaatgacttctggtctggctttgacaatttttttttttaatggagctgacccaataaaggtgacatggaattatttttcttctgagctagttt

SEQ ID NO: 255052 - DNA, 513 bp, Homo sapiens
ttcacaagtgtgtaaagattctatagtattgaacacttagtcaaaggagtcctacttgaattctcaaatcaatgacaaagttgcttcctctctacccaagatcaggagcttccctagtttgcacatatccacattgaccagtggctataaagtcacactgcgattatctgggtcattttaaaataggtcattagcagtacttgtagtatcgcgtctgtctaaaaatcctccaacaccgagtgacttttaaactttggggtgccttggtaaccccagggacgcttattagacatgcagactccggggcccaagctccagactaattccatgggaatagggcgggtcccgaaaccggcatttttaatcatctgcccgggtgaatccgaagtgtggtccaaaagccacagtcgaggtgcctctgcctaacaagctccacagaaagctccgacttcagccgccccgacggcgatacggacgccgagttaggctgtcgggggtctgtctggcggccgc

SEQ ID NO: 255053 - DNA, 413 bp, Homo sapiens
tccatgcaaaatgaaaaatagttaaattgaaaaacagatgtccttgtgcctcctaattcccagcaggggctcttgtctgaagcctgagatggctccttgggtttctgtgaatgttgtcaagggcgccaaggatgccggacttgcatttagatgcccaagcctctgtgctggaaatgatgggaaaaaataggaactcttgaacttgagcaagtattagaatatgtgaggtaatggagaagcctcctccctcatgcccgtgctcttgtcaggcctgtttgttaaggtccaggccccacttcccactttttttatattattattatactttaagttttagggtacatgtgcacaacgagcaggtttgttacatatgtatacatgtgccatgttggtgtgctgcacccgttaacttg

SEQ ID NO: 255054 - DNA, 465 bp, Homo sapiens
cagagtcctcatcccattttttccgtaacaattaatgccccagatttgtatgctatgatgatatcattttatggtgtaatgctattattattcaaaatatgtggcttttctaaattcacagtacatattcttatctgccagatatggtctaggtctcactctgtcttaggaaggaaaggaagaggttcttctccatgcatttgtcatcttggccccccgtgtctgcagccccatccccagccgggctcactctgccccatctcctccactcccatgcacctgcacgttgtactttacctttttccaaatagcatttagccactttgatttccaatactgatgacatccttcttttcttctcccagtctgttttgagcaggattatgttatcaaaatgtcagattatacaatgtgaaatgaatactttacctaactggaattcaaccctaaatctgtttgtggttg

SEQ ID NO: 255055 - DNA, 311 bp, Homo sapiens
ctctattttttaaaaaattagccgggcgcagtggagcacaactgtagtcccagctactcaggagcttaaggctagggggtagcttgagcccaggagttcgaggctgcagtgagctgtgatcacatcactgcactcccacctgggtaacagagcaagaccctgtctcaaaaaaaaaaaaaaaaaaaaaagacccatagcacaattgtaatcatgtgggtcattgtggggtggtgagtcacagctggtgagtggcagaatcaagaccaggtccaggtggtacagccacagagctggtgcccccaagtactcgg

SEQ ID NO: 255056 - DNA, 120 bp, Homo sapiens
tctctgaatggaaaatttacacttctcaagtgatgacagcatagagacagactgtcatgccccccactgaacaagagtggggaaatgacattcttaagaccactgaccagacaacattta

SEQ ID NO: 255057 - DNA, 361 bp, Homo sapiens
ggcaccctttgagttgagaggtgcaaggtccctcccggatctcacctggggctgtgcttcctccccagtggccaagcagagaaagaatctctcaccctgagtgaggctggcagctgtccccctaccccctgcctctgccctggtgtgccaggcactctgatttcaggcaccgttagaatttcagcccagcaaacaaaacagccagctgcggcccgagcttagggacccagaccactgccttctgctttttcctttccaaatgaaatttgagatgtcacttgtttttttaatcacaaaaaaggctgagaaaagaaaataagtatttccttcgtgtctgtctctgcttcctgcccccactcac

SEQ ID NO: 255058 - DNA, 319 bp, Homo sapiens
ggggatgagaaggttgcattagtctgctcaggctgctataacaaaataccagcctatgactatgacaatagacatttatttctgacggttttggaggctaggaagtctgagattaagatgctggctgattcagttcctggtgaggccctcttcctggcttgcaaatggctgccttctcactgtgtcctcacatggcagacagagagctctctggtgtctcttttcatgagggcccgatcctgttggatcagggatccacccttatgaactcatttaacttgcattaactccttgtaagctttatctccaaatacattga

SEQ ID NO: 255059 - DNA, 1396 bp, Homo sapiens
  misc_feature (2)..(2): n is a, c, g, or t
gnccaggagcgcccgagcggagaggcggcccgggagcaggggggcggcccccactccggccgggtgcccggcccctggcccctgcctgccctctagatcgccgccgcagccgccgctactgggagtctgcctgttgcaggacgcactagccctccctccatggagttcggcctgctcagcgaggcagaggcccggagccctgccctgtcgctgtcagacgctggcactccgcacccccagctcccagagcacggctgcaagggccaggagcacagcgactcagaaaaggcctcggcttcgctgcccggcggctccccagaggacggttcgctgaaaaagaagcagcggcggcagcgcacgcacttcaccagccagcagctacaggagctagaggcgaccttccagaggaaccgctaccccgacatgagcacgcgcgaggagatcgccgtgtggaccaacctcaccgaggcccgcgtgcgggtgtggttcaagaaccggcgcgccaaatggcggaagcgcgagcgcagccagcaggccgagctatgcaaaggcagcttcgcggcgccgctcggggggctggtgccgccctacgaggaggtgtaccccggctactcgtacggcaactggccgcccaaggctcttgccccgccgctcgccgccaagacctttccattcgccttcaactcggtcaacgtggggcctctggcttcgcagcccgtcttctcgccacccagctccatcgccgcctccatggtgccctccgccgcggctgccccgggcaccgtgccagggcctggggccctgcagggcctgggcgggggcccccccgggctggctccggccgccgtgtcctccggggccgtgtcctgcccttatgcctcggccgccgccgccgccgcggctgccgcctcttccccctacgtctatcgggacccgtgtaactcgagcctggccagcctgcggctcaaagccaaacagcacgcctccttcagctaccccgctgtgcacgggccgcccccggcagccaaccttagtccgtgccagtacgccgtggaaaggcccgtatgagcggccccgcccgtagatcatccccgagggcgggggcaacgattcacagcctccgcggactggggtcattttgactggcttgctcccgccccagggtctgaaaggggtgtttgggcagctggggggcaccggctcaggagagggccttcccctcccagccctgaggggtggactaggccctacacacagaccgcgcccctgggactaaagccaggaacagggaccagctccccgggggccaactcacccttggcccatcccgccttctccaggcttcccctccctcgttttcaaagataaatgaaataaacgtgcgcggactgtcgaa

SEQ ID NO: 255060 - DNA, 1343 bp, Homo sapiens
  misc_feature (2)..(2): n is a, c, g, or t
gnccaggagcgcccgagcggagaggcggcccgggagcaggggggcggcccccactccggccgggtgcccggcccctggcccctgcctgccctctagatcgccgccgcagccgccgctactgggagtctgcctgttgcaggacgcactagccctccctccatggagttcggcctgctcagcgaggcagaggcccggagccctgccctgtcgctgtcagacgctggcactccgcacccccagctcccagagcacggctgcaagggccaggagcacagcgactcagaaaaggcctcggcttcgctgcccggcggctccccagaggacggttcgctgaaaaagaagcagcggcggcagcgcacgcacttcaccagccagcagctacaggagctagaggcgaccttccagaggaaccgctaccccgacatgagcacgcgcgaggagatcgccgtgtggaccaacctcaccgaggcccgcgtgcgggtgtggttcaagaaccggcgcgccaaatggcggaagcgcgagcgcagccagcaggccgagctatgcaaaggcagcttcgcggcgccgctcggggggctggtgccgccctacgaggaggtgtaccccggctactcgtacggcaactggccgcccaaggctcttgccccgccgctcgccgccaagacctttccattcgccttcaactcggtcaacgtggggcctctggcttcgcagcccgtcttctcgccacccagctccatcgccgcctccatggtgccctccgccgcggctgccccgggcaccgtgccagggcctggggccctgcagggcctgggcgggggcccccccgggctggctccggccgccgtgtcctccggggccgtgtcctgcccttatgcctcggccgccgccgccgccgcggctgccgcctcttccccctacgtctatcgggacccgtgtaactcgagcctggccagcctgcggctcaaagccaaacagcacgcctccttcagctaccccgctgtgcacgggccgcccccggcagccaaccttagtccgtgccagtacgccgtggaaaggcccgtatgagcggccccgcccgtagatcatccccgagggcgggggcccagggtctgaaaggggtgtttgggcagctggggggcaccggctcaggagagggccttcccctcccagccctgaggggtggactaggccctacacacagaccgcgcccctgggactaaagccaggaacagggaccagctccccgggggccaactcacccttggcccatcccgccttctccaggcttcccctccctcgttttcaaagataaatgaaataaacgtgcgcggactgtcgaa

SEQ ID NO: 255061 - DNA, 536 bp, Homo sapiens
ggcatctaacaggtctccacagatgtggctgttgtaatggaaggtcacgatgatggtgtacttgctctcgtggtatggtttgagaagtgagctttcaacttacctaacataaagcttgaatgggtacaaagtgagacttccctagagatgaccaggaacaccaggaatgtgagttgataattgtgagtgcctctgtcctttcattcacaggccacaggtgctttccagtctttctggaaagtctttctaaactgtccacatttataaaatctttctagaaagtttttctagtcttgagttgggagatttcctggagagggacttgaatgggtacttggaggaggtagaagttcagagatctgaaaagaatatgtatcattattgtccatattgagtttctaaacttgatcaatcattcagtactgaagttgtagattttggttttgcattgttttataaaagaatgtatgataaatattaaataccatagggaaattttttttgaattttatgaaacattaaagtctgactttgta

SEQ ID NO: 255062 - DNA, 250 bp, Homo sapiens
tccttctgtgtagcagagttttttccacaggaagttgaagggttatccttgaatcattattctctgtatctagtaaaggctcccctgagactgttcaactacattgattggtatgtctttgaaggacatttaaaaggtagtacacagctatatttgttaaggcctcctcttttaacccctaacttctgtgcaaagataattttattttcagcaatcatataaggaaaatggctatcatctctctacaact

SEQ ID NO: 255063 - DNA, 483 bp, Homo sapiens
agaagtcgagaattgaattggtagaggtcttggcctgataatgccgccactagctgcctgacaaaggcaaatgcaaattttctcagagagaatgcaccctcatcttggagaattagatctgatcaaggctgtagatccaacaaccaatttacagggattacagaggacacaggaatatgtgagacatcaggatgcaattaccaggatagactgggaaactgacaacacaatttctttaaataagttgaagataaaataaaaccacacaggtggagggagaacttacccattgaaacaaaagaggcttataccagttgcaatttgtggaccttttttgggtactggttcagcagaaaaacttgacaatcacacgacagttggcattgtgaacattgacttgataattaaagaacaattgttttttaggaatgatgtggttgtatttttaaaaggatctctatttttaaaaaagagatacatgct

SEQ ID NO: 255064 - DNA, 508 bp, Homo sapiens
ccaagggaacgggggagcttagagcaaagcagtaaaattgtcagtgaagccattaattgagaaaaataactttatgaggcttatcacatgggccattatgtcgtgcttctgcctggtttccagcccctgataggcaaggagtggaagagaagtccatgggagaacggggaatttgaaggacaataaaagttgatggtgatacatgctgagaaattatcagcacagtcaaacatttctcctgcttcgaaaacacaaaacccaaagctaagccatccccatgggcttttgacattaaccatctgtcaaaccctagcaggaactgcttaagtgaaagcattcattataaattaaaaagttaaaaagttgcgctaattaagcctgaaagggaaaccagggtacattaagcagtgagagaagaatagctcttcgtgaatgggactcatgattgtatctgtctattcttgtgttttttgtaaatatactaattataatcactaattatgtttcg

SEQ ID NO: 255065 - DNA, 494 bp, Homo sapiens
gatgcttttgggggcctgtggtccctgacgtgtggcatctatgtggaagacaatgagaaagacactgataaaaacaaagaaggaatgtaattaatgcctctcaattgtacacttagaaatggctaaaatggtaaacttgatgttatgtatattttatcacaataaagacatttttaaaaacccagcaggagagagatgcgggtaacagtgaatgagcaggacagtggctgtgacgcaactgtgtatgcgagcgagaggaagggcgcagaggaaacctatttgttcttagatgacaccgtgactctcatgagggcactgactgagtggctggtgggagcccagtgggcgacccagagtaccaggagtctggcatggtaactgagaactgagaaacccagtgaccccctatagtctgtctctcactggatacctgagattcccaccctgggaccaggacaagatgaggagataagtcagtcccagggagggggtga

SEQ ID NO: 255066 - DNA, 459 bp, Homo sapiens
tcaaatatgtcagttttattttctctgtacacacatttgttactgaaaattgcaaaaacagcacattgaaggtcctcttattggagttcacatttttgaaaaccagaaaatttaataattatgctcttgccaaactacccactgttttctttatattcttgccccacaagttgctttacttgaactcttgggttgggcttcatctcactgacttcaggcttctaacacacataggacacttaggacctactggctctttgggtcacatcagggaggagagctgaagtatgttgaagttactcaaatacattcaagctacatagatctctgataaattattggtggtatggtagaaatgaaaatatacccaaaaaaatcacagaactgtttattaaaattattggtatacaggctcttctaacatagattagctttctcaacctaatacataaaattacc

SEQ ID NO: 255067 - DNA, 550 bp, Homo sapiens
gaaggaatgagtgaaagaggtgtggagtagcccactctcatcatggacctctggaatcctagctgcaggagaccccatgacccccatagacatttgagttgacagggagaaatgcacagagagttggcagagacagaactccagcctgcatggagcccagagggtttggcacagggaatggctgcagtagatcatagccgtaagtgcccaagccccaagactcactatacttctcttgttggctttagccttttttttggctaccataattggacaaaacagaggtatttttcatgtgggacaggccaatctgatctgagtaaccctctgtcttctggcttatcccagagtctgccgggccacaagaacttgcagcatggccttggctgctcagttgagtcacttgccagcagccactgccatagcctttttgctggcagaccctgcctatcagagagcttttgcaggctacctccctcatgcacctgcccacagcccttccccaacttctctgtggcatgtgctcactcacagcttccccctactgctt

SEQ ID NO: 255068 - DNA, 402 bp, Homo sapiens
ggaatcagcctcctccctttcctggactggtctgtctaccaccagttgccatctagtcctaagtgatcacttcatgcccctcctcagttgacatcctcagggactctccttcagcatcaagctgccaccctcagatgtggtcccctgcacctccctccacaggctggcccctgcctgcctcctcacctcacatctccccagtcacctcctctgctccaaggcatggcaggttcctgcccttctctgaacaggccactctgtttgaacatgtctctgtgtctttaaatagccctcttttccccactgaagccctgtccctcccaccacgaataaagatgatctttgtcttctttaaaacttgccataagtttgcaaaacacaggatgcagtctgtaatagcct

SEQ ID NO: 255069 - DNA, 797 bp, Homo sapiens
tagtttccttgtgaagcacatttgtggttagatagatggttggttagcatgcaatgagttgaaagcttttagataagtttgatctgaaggcctgacagagggtgtcatgaattatccacgttctcactgcagagcacaccttgcctgttaaccagaaagtcagctcagctcctcagaccgtgctgacacgcatgaacaaatgcccatgccccatctcctcttctgccgtagaaaatttaactataccaacctggttttttgttataatacacacaagtatattttttcatgaaattgagttgacctgtgaatctagatctaagtgacactgagcccttggaagtgatatttatggactctacactacttcatttttaacattttataatgcaaatgagttctctttcaacacaactgaaacaaatactctaaagtatgacaacactttttgaatttttctttattttttactttagaataccattgctgttgttatcgttatggttatttggtgttagtatgacacttattttatgttgtccccaaagctctgctgattatgcatttctggtaaacataaatggaaaaatgagctagttattgataaacacactttacttagaaatagaaaactaaaatgaaaaacaagggagagcatcaggaagaatagctaatggatgctgagcttaatacctaggtgatgggttgatctgtgctgcaaaccaccatggcacacgtttacctatgtaacaaacttgcacatcctgcacatgtaccctggaacttagaagttgaag

SEQ ID NO: 255070 - DNA, 247 bp, Homo sapiens
  misc_feature (222)..(222): n is a, c, g, or t
cagctatgtccatggatcagtcaagtatatagagcatgaggcgtgcaggggtcagggctctgcctcctttcttctctgtcattggtcaggctcatgaccttgatcgtgtgcaataatatctgtccttcaattctctttgtgatcatcccaccatagcaactcagattttaaaaatatcagttaaggagatctctgcctgcattttggaagcttgctgagcanatggctttgctccctttggaaaagt

SEQ ID NO: 255071 - DNA, 302 bp, Homo sapiens
ggagaatcaccattagcccgggcaccaggaggcccagggtggcttacagacagtctcatctcactccaggacagacgcccagagactgctggggggcacttcctgagatattcacagagggcctatgacagcaactgggtcccccaaccttggacaattccagagaaaatgtggccacacgtagatcaggcaggcactggaaaaggcactgggttgagagtttggggtgacagttttggaggtgcggaggctgctgttgtctgcatcccaaggtcgtggggttcagactgcaaaagggaacc

SEQ ID NO: 255072 - DNA, 432 bp, Homo sapiens
gctcctcccgggccaactccagaggcagtgcgtgtcacctccagctctcctcccacaaaaatgctggcctttcagcctccagtgcgcttagttcaccccataaactctgctaatgcttaccacatgctgagcgtcggcgcccgtccccacccccagccccacaggctcccgggtcccgccctgggagaccctcccactggccgaccctgccccaagactcgcccactccacggtgggaaacctgcaatgtgtccctccctaccccgccctcctccagcgccggccaaaagtgaccttggacgcttctacaatgccatatccactcctctgaacaggaggcgagtttgcacccagtggtgcctttggttgctagaaattaaaaacccgattgcgcgtgtttgcaattacggtaacttggcgcgtcacccccaa

SEQ ID NO: 255073 - DNA, 1400 bp, Homo sapiens
tctcttctgatatgctgtatttaatggaaaacctggacaccaaggaaacagatatcatagagctgaacaaggaaactgaggaatcacccaaatgagtgccaccaagttctaggacctggttctagcctagattcttacctccccaaaagcagcatattaggcccaggacatacctgaaggctggtcgactttttaaaaaacatgatcacactgtataagctacttagaactttgaagggcattatgatcctgactttttgagagctgcgaaaaatcaaacgcattcacgtcatccaacacaacatggctttcatcagaagttacacagaccacagtgatttagccaaataagtcttaaccaaaaaaaggaatctgaaaaacatacatgacttataaattcatagattattagttgtggaaagagtctcatagatcatagtccaatcccctagacccaaaggcccagacacgcagggttctctatttctcttcttttttctctttctttttttctttagccataaagaaaggagatggatcacctaatgcctgaaagatcccctccttcctaacgtttttgtttgaggctttctaaccatctcattcctacttttataactattattgttattatcacttcctgattcttaagcttcatcagcaccagaacacttaattctcttcaatttccttttttacttttctctcttttccttttattctgtcatcctttttttcccttcccttctccctggttgtgctgcttttctagtaatctgtcccatttttcaggttataatatttcctcttgccaaatctgttgcttatgtcttgccatgaatttcaaaatataagacattggcaaagcctcctacagaatcatcaaaggtgtcaacaaatccagcctgatacccttccagtctcacttccagtggaaggcatataggagtgatggttccccccgtgcccttgcagccattgacatttctttctgcttccactatttggtgttgggcactggagaaaaacgaagccaagagaatatgaaatttgcatagccaaatgctatggaaccaaagaataagatgactcacatctgtttaacttgaactcttatgcaaaaatcctaatcgtgtcgcaacacgggaccagttactgtgtctatcgggtcatttgggaatgggcaggatactggagctgggaggctaatggggtccagagctgcataatggggatcggatgttggtactcctcccagggagctctcaggacagctgtttgtcgtgggctcccaagtgcctaggccatgccttacgactgctgcacttaccatttgtcatatgatggcacttgactacatatggctttagaaataaaataaccctcaaaactaaaaaaaa

SEQ ID NO: 255074 - DNA, 411 bp, Homo sapiens
tgtcattgtgtgtttcaggctgtctgggtccgactttcctgacgaggagtggctgtgggattatgagaagcatggccatcggcattccatgataagatgactcacatctgtttaacttgaactcttatgcaaaaatcctaatcgtgtcgcaacacgggaccagttactgtgtctatcgggtcatttgggaatgggcaggatactggagctgggaggctaatggggtccagagctgcataatggggatcggatgttggtactcctcccagggagctctcaggacagctgtttgtcgtgggctcccaagtgcctaggccatgccttacgactgctgcacttaccatttgtcatatgatggcacttgactacatatggctttagaaataaaataaccctcaaaactaaaaaaaa

SEQ ID NO: 255075 - DNA, 332 bp, Homo sapiens
tgtcattgtgtgtttcaggctgtctgggtccgactttcctgacgaggagtggctgtgggattatgagaagcatggccatcggcattccatgataagaagagtcaagcggttcctgagtgcccacgaacacccctccagccccagaagaagaagctacaggaggcagacaagtgacagctccatgttcttaccccgagatgacctcagcccagccagggacctactggatgtgccctcaagaaacccccccagggcctcacccacctggaagaaatcctgcttcccagaaggaagccccacgctgcacttcagcatgggagagctgtccacca

SEQ ID NO: 255076 - DNA, 431 bp, Homo sapiens
ggcctttttttgtgtggggggaggggaatggcatccccttcctgtctgccaaatcaaggaataccagtgccctcctaaacctgctttgttttagtggattgttaaaaagaagtgaatgaatttatgcttcattagggaaaggttacagtggaatactgaggagtaaggggtatttctatttaacaaatgacataacttgaaggaatgaaatcataaggatggaatttcaggcattaataaaaagctgatgagagatactttgagacaaaagagccttcccagtgtaaccgagatcacagcacctacttcacatacacaggaaaccagtcctatctgtctctcccatagagcagtagctgccttgtttttcctccctcctccatcattcattctaaatctccagtcctctacctgcacgacaacacataacc

SEQ ID NO: 255077 - DNA, 603 bp, Homo sapiens
gtcaatgtgtggccgacctgaaggctccactagggctttccctctaaagctaccctggtgactgtttcttactttgctttagaaaagacccaaaaacagagttaggggaggtgctcagtgtggcccccaaggacagtggcaggggttgaggcgccgggcacactgtctctgagtgtgtcccgactcgcaggaggggcattctggggtccaccaggtggccggggcctgaggcctactgggcccgcactactgctggaaaccacctctcgctccatttcccagcacccccagtgtgagcccgaccgcaggggcggggccggagccaggaagcgctccgtgttgtgcaagggccgccacgtgagcacccgctgggccacgacgctcaccccaagacccccgacacccacctcggagctccggatctaggctcagccccagaaggctcctggagcccctccctcgtgcccgggccggcccagaggtgctgagccctccctctctgcgatctgaccttgagctttctcctccacacgtgccctccctcccgtctcccccgctccagtgctccgagggaggccggaagaaatcattctgacgcccatt

SEQ ID NO: 255078 - DNA, 699 bp, Homo sapiens
gaccaagttctgaccaatgagatagaaactaagtatgtttctacttccggataatgttcttatatggaggaaagcaatttcttctccttcttgtcctgccttactgctgattgggatgttagttgtgatgactgtaactagagcaattaatctgcactttgaaatggaagtcacatgtgagaatggtagaacagcaacaagatagatgggattggtgttcctgatgagtatagctaatatactagtcctaggtggcatgcccttacatgagagagaaatacatttttattttgtttaagcagtggttatttgggcattttcctaaatcacagacccaagatcccatagctaggaagaggcagaacatgcatctcaacccatgtgtgataccagaccttctgatttctccagtctattctgctacttcctggaactctgagtgcctgatagtaatagtgagaaatatggctgggtgggcactgggaacatagcttctccttgagactaagccattgcttggctttttctcatgctgattagagggagaggcaaacaaccaaccaatcagtaatgtaacagaatccacatttccaaatctagtgctctttccaaattgccaaccattaagtcatcagtccaaaggacttgcgagtaatggcagaaatctcagaggcttagtttcctgatttcagtctcaca

SEQ ID NO: 255079 - DNA, 541 bp, Homo sapiens
agaaatttttaaaggttaaaataaataattttaagaaagctggttcacaaggtgccacatttgatgaaagcaaaatacagtggcttttattgttactagagtgatgttcttgcttgtttttcttttttggtgaagttagccccaaattattctcatagctaagcaaatacgagagtgactgtaaggacagttggcattcccggaattgctaaacttggtaggcaacgctggtttaagaatactgagttctagccgggcgtggtggctcacgcctgtaatcccaacactttgggaggctgaggcaggcggatcacctgaggtcgggagttggagaccagcctgactaacatggagaaacgccatctccactaaaaatataaaattagccaggccccgggtgtggtggcacatgccggtaatcccagctactcgggagactgaggcaggagaatcgcttgaacccaggaggcggaggttgaggtgagccgagatcatgccattgcactccagcctgggcaacaagagtaaaactctgtctcaa

SEQ ID NO: 255080 - DNA, 535 bp, Homo sapiens
ctcaatctagaatgtaaactacttttacattcaaaattgagttctgtgatctcctgttctatttaaaatgtttagtatacgaggaagcagagaagaatggttgtttccatttttcttcatgtactagatctaaggaatcctggtcatgtttccaactagcatttctcaaactgtgctctaccagttagtagttctcaaagacataagaagttcattaaaaaatatcccgtgctcaaatatgatttgtaaatgtgagttcaattgagttaaagaagtttctttactgaataagttctcaaaatctttttaatatatgttgtctctaagagggattgtggttatttttcaaacccgtttcttttcctcatagtcactgtcaccttgtcaattaccataaaagcattgataggattctgttatacatatgggcattgtggaagcagagacaagattttcttttgcactggacaggcactccatactagtattgtgttgtttgcaaattacagaaactgaaatccagctagcttaagct

SEQ ID NO: 255081 - DNA, 533 bp, Homo sapiens
tatgagaaaatgctttctttgttctacaatatattttatcggatccagttttgatttttagagcactaaaattggaacctttgattttgacaatattattgatttggctcttttaatttgtaatagtgtgtggtaagaacatcacaacaccttttcatattattgctgctaagagaattttgacttatttctgatatttttctcatttgctgctgcttctagtagtctgtattgagatctcattgccatacagagtctttctctacccttttcttccatacctggtattgtttgtagttctggctcagcctagaactttcgctatcttagtaataacactttttagccatctagctttgcacaccaagcaaaaacaccagaaaatcaacagttcccatgatcccttcccaaaagcataagcctgatgattaaacatgcacagcaaaatttgttgcctatagcctttctgtaccactgccaggtttttatgctgatattgttgccaagatgttctgttttaagaattgagtaaa

SEQ ID NO: 255082 - DNA, 915 bp, Homo sapiens
atggttctatcagtctcaaggtttatgggccccaagcttggctgaggccagacagagctttgtgcaaactctctttctttccatgttccagcctgggaggagcttttgctgacggatgcacagggaaagatcatgtttgacacagtgggtctctgcagcacatgggagagttttactcctgttgccaaggctggagtacagtggcacgatctcggctcactgcaacctccgcctcccaggttcaagcatgtacctctgcctcccacatagctgggaatacaggtggaatatcacccttacctcaaccaaagcaaactcctggagtactgtaagtccaaggacattgtcatgactgcatattctgccttggggtctgactcagacaaagactgggtgaaaaaaggaaacccagttctccaggaggatccaatactcaatgccattgctgaaaagcccaggcgaactccagcccaggttgccttgtgctaccagctgcagcgtggggtggtggtcctggtgaagagcttcagtgagaagagaatcaaagaaaacttccaggtttttgacttctagctgacaccagaggacatgaaaaccacagatggcttgaacaagaatatacgccatttgtaaatgtctatcttttctcatcacccagattatccatttcttgatgaatataaagaaaagagtctgtggttgttccagagtttattgatttgggttgagatgaatagagaatatctcatggatgggaagttttctagtttattccagattgattagcctgctcagtcacaagttggcctaagaccccggatcagaaaataaaagtatctaaacctagttttctcttgattcccgcccccaccccacccccacaactgccaaaataaagatgtatttgaaataacc

SEQ ID NO: 255083 - DNA, 495 bp, Homo sapiens
aagaagatgagttttaacagactcctttctgtaaaactgaatgatggaaagttcatgcctattctggggtttggcacctctgttgctaggaaggttgctatgagtaatgtagaagaagccgtccaggtagcaattgatgtaggctaccgccatattgactcagcttatacacacctgaatgaagaaggcatcgggcaggccatccgaaagaagattgccaacggcactgtgaagagaaaagatatattctataccacaaaggtgtggggcaccttttcccgcccagaattggtccaaagaggccttgaaatgtcactgaagaaacttcagctgagctacatggatctttacctttttcatttcccagtacctttgcagcctgggaggagcttttgctgacggatgcacagggaaagatcatgtttgacacagtgggtctctgcagcacatgggaggccctggagaagtgtaaggatgcaggattggccaagtcca

SEQ ID NO: 255084 - DNA, 669 bp, Homo sapiens
  misc_feature (1)..(1): n is a, c, g, or t
ngcgcaagaaatccgccacgagacatcccttagagggtggaatatcacccttacctcaaccaaagcaaactcctggagtactgtaagtccaaggacattgtcatgactgcatattctgccttggggtctgactcagacaaagactgggtgaaaaaaggaaacccagttctccaggaggatccaatactcaatgccattgctgaaaagcccaggcgaactccagcccaggttgccttgtgctaccagctgcagcgtggggtggtggtcctggtgaagagcttcagtgagaagagaatcaaagaaaacttccaggtttttgacttctagctgacaccagaggacatgaaaaccacagatggcttgaacaagaatatacgccatttgtaaatgtctatcttttctcatcacccagattatccatttcttgatgaatataaagaaaagagtctgtggttgttccagagtttattgatttgggttgagatgaatagagaatatctcatggatgggaagttttctagtttattccagattgattagcctgctcagtcacaagttggcctaagaccccggatcagaaaataaaagtatctaaacctagttttctcttgattcccgcccccaccccacccccacaactgccaaaataaagatgtatttgaaataacc

SEQ ID NO: 255085 - DNA, 801 bp, Homo sapiens
atggttctatcagtctcaaggtttatgggccccaagcttggctgaggccagacagagctttgtgcaaactctctttctttccatgttccagcctgggaggagcttttgctgacggatgcacagggaaagatcatgtttgacacagtgggtctctgcagcacatgggaggtggaatatcacccttacctcaaccaaagcaaactcctggagtactgtaagtccaaggacattgtcatgactgcatattctgccttggggtctgactcagacaaagactgggtgaaaaaaggaaacccagttctccaggaggatccaatactcaatgccattgctgaaaagcccaggcgaactccagcccaggttgccttgtgctaccagctgcagcgtggggtggtggtcctggtgaagagcttcagtgagaagagaatcaaagaaaacttccaggtttttgacttctagctgacaccagaggacatgaaaaccacagatggcttgaacaagaatatacgccatttgtaaatgtctatcttttctcatcacccagattatccatttcttgatgaatataaagaaaagagtctgtggttgttccagagtttattgatttgggttgagatgaatagagaatatctcatggatgggaagttttctagtttattccagattgattagcctgctcagtcacaagttggcctaagaccccggatcagaaaataaaagtatctaaacctagttttctcttgattcccgcccccaccccacccccacaactgccaaaataaagatgtatttgaaataacc

SEQ ID NO: 255086 - DNA, 580 bp, Homo sapiens
ctctctctctctctctctctctctctctctctctctctctctctctctctctctctcggtgaaaaaaggaaacccagttctccaggaggatccaatactcaatgccattgctgaaaagcccaggcgaactccagcccaggttgccttgtgctaccagctgcagcgtggggtggtggtcctggtgaagagcttcagtgagaagagaatcaaagaaaacttccaggtttttgacttctagctgacaccagaggacatgaaaaccacagatggcttgaacaagaatatacgccatttgtaaatgtctatcttttctcatcacccagattatccatttcttgatgaatataaagaaaagagtctgtggttgttccagagtttattgatttgggttgagatgaatagagaatatctcatggatgggaagttttctagtttattccagattgattagcctgctcagtcacaagttggcctaagaccccggatcagaaaataaaagtatctaaacctagttttctcttgattcccgcccccaccccacccccacaactgccaaaataaagatgtatttgaaataacc

SEQ ID NO: 255087 - DNA, 362 bp, Homo sapiens
  misc_feature (1)..(1): n is a, c, g, or t
ngcgcaagaaatccgccacgagacatcccttagagggtggaatatcacccttacctcaaccaaagcaaactcctggagtactgtaagtccaaggacattgtcatgactgcatattctgccttggggtctgactcagacaaagactgggtgaaaaaaggaaacccagttctccaggaggatccaatactcaatgccattgctgaaaagcccaggcgaactccagcccaggttgccttgtgctaccagctgcagcgtggggtggtggtcctggtgaagagcttcagtgagaagagtcgcttccaggtttttgacttctagctgacaccagaggacatgtctcatcacccagattatcctttctt

SEQ ID NO: 255088 - DNA, 480 bp, Homo sapiens
tggcataccatcactttcaccatattctgttggtcaaaacaagtaacatgaccagtccagagtcaaagggaggggagactttgcctcttgataggaggcaaagttacatttcagagggtatgcatatagacagttccagctatttttgcaatcttctacagtagggaagtgagttctagtacattttataatgcggagaatgaactacaagagactgattccaccaaacctcaaaaacatcaccactctctatagagaaaggactgaaagggtaatgtgaagcttgaaaggagctgtgtttgtgatgaatactgaagagaggaatgaacaaggatttagactttttcagagagagtatatattaaagctattcttagcaaaaagtaaataatttagcttttaactttagataaagcattgaagaccacaattgggtagttgcaatatagaaaatataaagtgtgctgtataaatgttttt

SEQ ID NO: 255089 - DNA, 591 bp, Homo sapiens
agtacagtgggggtgatttccaagaactctttgactaactaaaggttataaagattttatgttttctcttaaaagttttatagttttacatttagatatatatgatttattttgaattaatatttctgtaagatctgttttaggtcaggtttccttttttagatatggatgtctaattattccagcacctttgttgaaaacacaatctttctccattgaattgccattgtacctttaccaagaatcaattggttatatttgtgtaagtcgatttctccatgacttcctccttccctggggttcccctttttacttttccagccacagagatgagacattagaataggacgtacttcctgtgactgcttgcatttcgggccaagaggcagaaagacagaggaaaaaagcagcagatgtttgctcctacatcttgagatcagagctcctctgatcagagaggaaggttcctttccctcagagtatatgtgactgttgtccccgctgtccaccaccaccttggaattgccttggattgggaagcaagagaattaaaagaaaaaaaaaaggaaagaaaaatggagtgtttccccc

SEQ ID NO: 255090 - DNA, 815 bp, Homo sapiens
gggcctgcctgacacttgggcgctccttcagtctcgatgttgatggcaggacaaaggggcgcctggaccatgggtgatgtggtcgagaagagtttggaagggcccctggcaccttctacagatgagccctcccagaaaacaggagacttggtcgagatcttaaatggggaaaaggtcaaatttgacgacgcgggactctccttaattcttcagaatggcctggaaaccctgcgaatggaaaacgctctgacagatgtcatcttgtgtgtggacattcaggaattctcctgccaccgcgtggtgcttgccgcagccagcaactatttcagggccatgttctgcaacgatttaaaggaaaagtatgagaaaaggatcattattaaaggggttgatgctgagaccatgcacactctgttggactacacgtacaccagcaaggcgctgatcaccaagcagaatgtccagcgggtcctggaggctgctaacctcttccagttcctgcggatggtggatgcctgtgccagcttcctcactgaagccttgaacccagaaaactgcgttggaatactgaggctggctgacacacactcgctggacagtctaaagaagcaggttcagagttacatcattcaaaactttgtgcagattctgaactctgaggagtttcttgacctgcccgtggacactctgcaccacatcttgaagagtgatgacctttacgtgaccgaggaggctcaggtgtttgagaccgtgatgagctgggtccggcacaagccatcagaacgaatctgcttactcccctatgtcctcgagaa

SEQ ID NO: 255091 - DNA, 1275 bp, Homo sapiens
ccaggggagcctggggcctcccctcgactctcaccagggccttcgacccctccaggagcccccactctacctctagcttccccaggggctcctcagccacctcctgtgactccagagcgctcgttctcagcctctggggcccagatagtgtccaggtggcctcctctgcctggcaccctcctgacggaagcttcagcactttccatgatggaccccagcccctcgaagacccccatcaccctcctcgggcctcgcgtgctttctcccaccacctctagactctccacagcccttgcagccaccaccccaccctggcccccagcagcccccagtgggggcttctcggggggaagagtccaccatgtaaggaggtcactgtgtccgggagactctggagagaggacctctgccagtggcccagggtgtgtgcagggcagctccaaggatgaacctggtggggatgcctgggctccctcctgcaggggccctggtgaggatggaagacccccaaggctggatgtaaccttgttcccaagaagtgtttggaatgtgctgtaagaatggaggaagtcgtttccactgtcagcatcctccctggaccgcgtggctggctcatcttttgagaagggttgggactgccaagttctcctggaggaagagttgcgtccggctgggattccactcactgggactgtaccgccaggtgtcatgcgtctctctgaggtttcctgattaaaggttgtctcggtttccccatgctgcactgctcattcaccgcttacctgtgggaaggtgggaaacgtgaccccaagcccacaggtgacggagtttcactcttgttgcccaggctggagggcagtggtgtgatcttggctcactgcaacctccaccttccaggttcaagcaattctcctgcctcagcctcccaagtagctgggattacagacatgggtcaccacacccggccaattttgtatttttagtagagatggggtttcaccatgttggcctggctggtctcaaactcctaacctcagctgatctgcctgccttggcctcccaaagtgctgggattgcaggcataagccaccacacacggctgggaagtgacatttaagccacgtctgcagatgctaggtgttagcaagtcaagaaagagggaaaagcaacccaggcaaagggaacagcatgtgcaaagtctggaggtgggaagaacacatgggcttttgtggccgtgggaggccagggtggacggagctcagggtaacgggatca

SEQ ID NO: 255092 - DNA, 212 bp, Homo sapiens
gtttccccatgctgcactgctcattcaccgcttacctgtgggaaggtgggaaacgtgaccccaagcccacaggtggtaagtgagcatccacctttaccccactgctggggagaaaagctggcaccaaattgtgactgggctggggaagggtctcctgtaagcacttggcggccttttatattgggagacttctttttatttttttccccaag

SEQ ID NO: 255093 - DNA, 434 bp, Homo sapiens
tggcttcactcctgaagtcagcgagactacaaacccaccggaaggaacaaccagctccggatgcgcgccacctttaagagctataacactcaactgtgaaggtctgtggcttcactgttgaagtcagcaagaccacgaacccaccggaaggaagaaactctggacacatctgaacatctgaaggaacaaactctggacacaccatgtttaggaactgtaacactcactgcgagggtccatagcttcattcttaaagtcaccgagaccaagaacccaccgaaaggaaccaaattcggacccaatggtactatgttaattcttctaccagtcaacaattaagagcaactgtcttgcttgtagcctcagcaacatatttttgtccctcggttaaatgaagaacagccaaaaagataaacactataattaactgcaaa

SEQ ID NO: 255094 - DNA, 216 bp, Homo sapiens
ctcagccctaggatcactactttcattttaaggcttcattttgctcgttaagttactggggaaaataacttcttttttccgtttttagtgacagggctgtggtttcacaaccacttggtgaaaggcagacaactggttgagaacaggggccagtctatgcagattttcatttcctagcatggcggagaagggcttttggccaagctcatggttgac

SEQ ID NO: 255095 - DNA, 400 bp, Homo sapiens
tttaggcatgcctggagctctgtgtgcttggcccagagccacgagcaggccaaggatgctgcccgttgcatgggctagggttgcctggcctccgctgcgctagggtccagggacacattttcactgttcaggggagggagttagctgtgctccagtgtatatagggcaggcctcacacaagccagcaagtttactaatttccaccgtgattctgcgatcattaaggatgaagactttgaagaattttaatgacatgaagaaatgctcatgatgggcatgatagagaattaaacaaaacaagcaagatacaaaaccatacacatcatgatcccaattatgtgtgtgtatctttgtggaaagaaaagagacggaagtaaacacaccaacactttaacagaag

SEQ ID NO: 255096 - DNA, 661 bp, Homo sapiens
gggctaaaacaccacacatctcatagataatatttggtaagttgtaatcgtcttcactcttctcttatcacccacccctatcttcccacttttccatctttgttggtttgcaacagccccttctttttgcctgactctccaggattttctctcatcataaattgttctaaagtacatactaatatgggtctggattgactattcttatttgcaaaacagcaattaaatgttatagggaagtaggaagaaaaaggggtatccttgacaataaaccaagcaatattctgggggtgggatagagcaggaaattttatttttaatcttttaaaatccaagtaataggtaggcttccagttagctttaaatgttttttttttccagctcaaaaaattggattgtagttgatactacatataatacattctaattccctcactgtattctttgtttagtttcatttatttggtttaaaataattttttatcccatatctgaaatgtaatatatttttatccaacaaccagcatgtacatatacttaattatgtggcacattttctaatagatcagtccatcaatctactcattttaaagaaaaaaaaattttaaagtcacttttagagcccttaatgtgtagttgggggttaagctttgtggatgta

SEQ ID NO: 255097 - DNA, 488 bp, Homo sapiens
ttaatctataagcgcatttggcgtgtgcttatatgtctgcttatatgccaaatttgaaattccaaatttcgccatttggaatttcaaatggggaaaagcaaagactcttatctttcccataatcaaaccccttatgaagtaaaatccttaaggtctctctacaggttaaaaataattaggtgatatgatttggctgtgttcccacccaaatttcacctttaattgtaataatccccaggtgtcaagggtggggccaggtggagataattgaatcatgtgggttgttttccccatactgttagtgtggtagtgaataagtttcatgagatctgatgattttataaatgggagtccccctgcacaagctctcttgcctgctgccatgtaagatgtgactttgctcctccttgccttccgccatgattatgaggcctcctcagccatgtggaactctgagtcaattaaacctctttcttttatatattacc

SEQ ID NO: 255098 - DNA, 459 bp, Homo sapiens
agaccctttgttgtccagaagtagtgggcatggcatataaatttcttgaaaaatgtctatgggatattctttcttttattatttttaaaaacattctcattaatattctgtgacttgtgtctttcccttgttctcttgtttaaggatgtaatctatttgaaaaataaaaacactttcatgcttgcaaaattactttaaatcatttctaactctttattataacaattagtaaatcttgaaaaatcattaatagcaatttttttacctatgtcaatttttattgatattgccaacatgatggctgaaaaacttttaatcggaatgtaactgcattattgcaatagatatgtaactagtcatttgctttccatgcctgcaaattaaataggcttatactttgtttacaagaaaaagttcaaggccttgacatggcattccaggtgtcagaaatatgccatt

SEQ ID NO: 255099 - DNA, 229 bp, Homo sapiens
cagacaaagaaagccgttggagcctaggatgacaggacaaggacctcactcccttggccacccctccactgtggtgatcctaagtggctcaaaccatgggctagctctccaaggctctttttttgagagggagtctcactcggtcacccaggctggaggttgcagtgagctgagattgcgccattgcactccagcctgggcaacaagagtaagactccgtctcaaaaaa

SEQ ID NO: 255100 - DNA, 328 bp, Homo sapiens
ccacacattcttggcattagcacaccaaacagtggtagggtaccctgagaaaggaatgcagcttctcagaggcctcacttccagccagggaaacttaagacctgaaaggaataaggctctttgtgtattcagacagccttctggatgtatcgtatataacctgaaactctccactcttgtataccaactaacaaagtcttccttatgtaacatagattgcagtgtctgtatatggtcttcccattatctggtagtagcatcttgaaactggtcaaaacttgaatgccaatagctcagtcactcagaatatacgattctgcacttggga

SEQ ID NO: 255101 - DNA, 697 bp, Homo sapiens
gagaatatatattttaggctttgagggccacctatgatcttttttgcaagtttttattcattttattttgttttataatcctttaaaaatgtaccaagccatacttacttagctcatgggctgtacgaaaacatacacccaggttgcaggccggattttacccacaggccatagtttgcagacctctgtcttaagacaacaacatttattaattattattattattatttctcatggttctaggagtcgattggccttggctagatgattttcacttagggtctcttgtgtggttacagttatatggcggctgggcagtcacatagtgtctagagtcctcaacacatggctgaagtcatatatagaaaatcaggctaggtgcagtggctcacgcctatatcccggtactttgggaggccgaggcaggtggatcacctgaagtcaggagttcgagaccaacctgcccaacatggtgaaaccccatctctactaaaaatacaaaaaaattagccgggtgtggtggcacatgcctataatcccagccactcgggagcctgaggcaggaaaagtgcttgaacctgggagacggaggttgcagtgagccgagattgtgccactgcactccagcctgggcaacagagaaagactccatcaagaaagaaagaaagaaagagagaaagagagagggagagaggga

SEQ ID NO: 255102 - DNA, 437 bp, Homo sapiens
ctaatgtttactgattaagcttgaaggtttgtggaatttgacataatattttgtatctttttggatgtgtgagatactttatgatgaaattgaaatgaccaccgtgataatggtaaccactcagagtgtcactggtatgtgtgccacgtgcttgtcgtcccgggtctatggagcctgcctgcccatcactgaggcacccttagcctccaccctggattagactgtcatctccaagtatttgtgtatgaagttacatacatacatttatatgcacagatgcaaattcattttatcttgtaatgtgttatcacaaaatgcagtataggacttttttaaagatcaaatatttccaaataaaactttttcaaaaaatatttttcctggtagtaaaagaagcacatacatgtatggaaggctaggaaattgtacttaagtag

SEQ ID NO: 255103 - DNA, 207 bp, Homo sapiens
tttttatttttctttacctttaaaaaaagtatatatagtgattctcaatatactttggaaatatgtaaagctgaagaaatagtgatttcaaatttattaaggtgaaatggaggtctgtgaaaaagctggactttgcctcacccaaaagacacatttctgcattcagctgtcaagttagcaatatcatggggctgaaataacactcct

SEQ ID NO: 255104 - DNA, 370 bp, Homo sapiens
gaaataggtcagtctaccaacataatgggcattttcaacatacccctctcagtaattaatagatcttgcagagactaaattatgaagattattaaggacatagaagatttaaatagtacagctaatcaatttgatctgacagatacataacacacacatacataaaacacattgtacccttcagtaggaaaataagtttttgcaaaccaagtctaacagtgtattcaaaatgtaacaaatgatgaccaaaatggattggtctcaggaatacaagattggctttttaatgtaattaagaaatgctgtttataataggacaagaaaaagtacctaagaataaattttaaaatgagaaaatgataaaaaaaaa

SEQ ID NO: 255105 - DNA, 108 bp, Homo sapiens
tcaatgacttgccttccccaacccccataatgcacaccaccaccaccatcactttctggaaccatcaccaactcttggactagagcttatgttgaagcttgttagggc

SEQ ID NO: 255106 - DNA, 466 bp, Homo sapiens
tattaagttgaaagcccatttgggcagagaagtggttagtctcttgattatgtttaaagaaggacattaagaagcaataatttggttggcaatctttttctataaagggccggatattaaatattttagccactgcaagccatatggtgtctgtctcaactactcagttttgctgctgtagcaggaaagcagccatagatgatttatgaatgaatgagagtggctatgttttaattaaacttcacaaaagcaggtggtaggccattgtttgctgacccctgctttagaggaacaaaacttcatgagagaaaattaacagactggcatgttttgtcagtaggaaatgtgaatgcaagcttcatacttggcacatgataattgcttcataattattaaataagccagatctgcctgcctacctttctgctggtttgagcaaatataagtagatttgaatagcgttaaa

SEQ ID NO: 255107 - DNA, 528 bp, Homo sapiens
gtcgcaggaatcgtcttgcaattcccggccccactgactgaaactgagccgtaggcgattggtaccaaaatcaagtgagaagccctcgccgagaggcgtcgggagaagcgcgcagaagccgggagctctaagggtgcgcgcggagtgcaagtcttgcacgcggggcagcgccgcatctgcggagaagggacgccgagcggagcctgctgccttccgcactgctcgagggaaagccgcgccctctgattccgccgagggggaaggcgcccccgggcgcggagacaggtggcccgctactcggccgtcgctgtttccacgtctgcaccgcgcccagaaggcctctcgccgccccgggggcgccctgtgcacgcgctgagcgcttctcctgcccggcttctgctccgctcccgccgcccgcgggagccaggggcggggctcacctgtcagcccgagccccgcctcgcggcacccaatgtcgggaggggatggcggacggacggaccggccgtccaaccagcgcgcggccgc

SEQ ID NO: 255108 - DNA, 233 bp, Homo sapiens
gtaagccaccacgcccggcctagaatgggcttttttaaaacaattaagggcatgggaactactgctaggcaatgggggaaaggtctcaaagctcactggcagagtcttctgaaaaaaacctccagtctttcagcttttcttcaatactttaaactcacctttcctatccttccacattgttacaactgtcttctctctgacacaaacaatgccagattatcctactaagaatg

SEQ ID NO: 255109 - DNA, 529 bp, Homo sapiens
attgagagaaagcaagcccacatgctgggagtcagtgctgtggctgcagccacatggccggcacctctgcaactcttccatagccacctggtcttatgccacgcacgggagcttcctgtggactcctctgtacaggaatcactgctccagctttgattacgcccatcctctaccccaccccatgagacgtggcctaaaataccaactgctcctgcctcccagagcggtccttcccacccttccatgccctgccagtcttcatgacccctggcctggcctgtgtctactgaatgacttatcattgctgcgggattgtgtctctgcagtctgctcctccctgcctccaccaacaccccttctctcaggagagtcctagaagatgaccttctgtcttagtcatctctgtgctgtcagggcatatcaaatatggcctgctacacagggtagtctataaattttgttatctaaattaataaaaagtttctaccatacctaataggcaagctgtgaaaaagtgcaattctcacat

SEQ ID NO: 255110 - DNA, 497 bp, Homo sapiens
cagtaagaaactgatgtagtcttatatttgaagaaaaaacaattgaataacatgtttgtgggttaaaactcttatacaaaaattttctaaattcatatttccagagtcctttattgcattaagcattggttaaaaggctaatttttggtgtttttgttaagcagaactttttcaaaaaacataagacaagttttattagttttattttaaaattagtatcaagattctagcttttgggtacttggagatacttgtaattttattgtaactatggggtatttttatctactaatctgagctatttttggtcacttgtaagatctttgtatgatgatttgtagacttcagcacattgagattgaatgtatttgttttagcatatgagagaaaggagaaatttgtgtagattagaagttgtggtggaaatttaacttaaaatgtaaatcattttcaggtagttaataaatcctttttgttgcttccacctccccaatttg

SEQ ID NO: 255111 - DNA, 265 bp, Homo sapiens
  misc_feature (224)..(224): n is a, c, g, or t
gagaataacaagatggtgtttgcagaatcctacactgcactgtggagttgggtcagttgcatcatgaaatattagcattttccacacaggaacattttgtaacaagaaatgttagaaatcatttgtagagtagaagacatactagacgatagttggaaggaaaaagagactgtggaatgacgcataaatgcttctaattaaagggaggggactcaaaaagtgtnggaggcttgaggaatttagcacacaactacagatgtttctt

SEQ ID NO: 255112 - DNA, 2066 bp, Homo sapiens
  misc_feature (1247)..(1247): n is a, c, g, or t
  misc_feature (1251)..(1251): n is a, c, g, or t
  misc_feature (1550)..(1550): n is a, c, g, or t
ccatgacgcccgccctcacagccctgctctgccttgggctgagtctgggccccaggacccgcgtgcaggcagggcccttccccaaacccaccctctgggctgagccaggctctgtgatcagctgggggagccccgtgaccatctggtgtcaggggagcctggaggcccaggagtaccaactggataaagagggaagcccagagccctgggacagaaataacccactggaacccaagaacaaggccagattctccatcccatccatgacacagcaccatgcagggagataccgctgccactattacagctctgcaggctggtcagagcccagcgaccccctggagctggtgatgacaggagcctatagcaaacccaccctctcagccctgcccagccctgtggtggcctcaggggggaatatgaccctccgatgtggctcacagaagagatatcaccattttgttctgatgaaggaaggagaacaccagctcccccggaccctggactcacagcagctccacagtggggggttccaggccctgttccctgtgggccccgtgaaccccagccacaggtggaggttcacatgctattactattatatgaacaccccccaggtgtggtcccaccccagtgaccccctggagattctgccctcaggcgtgtctaggaagccctccctcctgaccctgcagggccctgtcctggcccctgggcagagcctgaccctccagtgtggctctgatgtcggctacgacagatttgttctgtataaggagggggaacgtgacttcctccagcgccctggccagcagccccaggctgggctctcccaggccaacttcaccctgggccctgtgagcccctccaatgggggccagtacaggtgctacggtgcacacaacctctcctccgagtggtcggcccccagcgaccccctgaacatcctgatggcaggacagatctatgacaccgtctccctgtcagcacagccgggccccacagtggcctcaggagagaacgtgaccctgctgtgtcagtcatggtggcagtttgacactttccttctgaccaaagaaggggcagcccatcccccactgcgtctgagatcaatgtacggagctcataagtaccaggctgaattccccatgagtcctgtgacctcagcccacgcggggacctacaggtgctacggctcatacagctccaacccccacctgctgtctcaccccagtgagcccctgganctcntggtctcaggacactctggaggctccagcctcccacccacagggccgccctccacacctggtctgggaagatacctggaggttttgattggggtctcggtggccttcgtcctgctgctcttcctcctcctcttcctcctcctccgacgtcagcgtcacagcaaacacaggacatctgaccagagaaagactgatttccagcgtcctgcaggggctgcggagacagagcccaaggacaggggcctgctgaggaggtccagcccagctgctgacgtccaggaagaaaacctctatgctgcngtgaaggacacacagtctgaggacagggtggagctggacagtcagcagagcccacacgatgaagacccccaggcagtgacgtatgccccggtgaaacactccagtcctaggagagaaatggcctctcctccctcctcactgtctggggaattcctggacacaaaggacagacaggtggaagaggacaggcagatggacactgaggctgctgcatctgaagcctcccaggatgtgacctacgcccagctgcacagcttgacccttagacggaaggcaactgagcctcctccatcccaggaaggggaacctccagctgagcccagcatctacgccactctggccatccactagcccggggggtacgcagaccccacactcagcagaaggagactcaggactgctgaaggcacgggagctgcccccagtggacaccagtgaaccccagtcagcctggacccctaacacagaccatgaggagacgctgggaacttgtgggactcacctgactcaaagatg

SEQ ID NO: 255113 - DNA, 506 bp, Homo sapiens
gactaaaatgcctgcgtggttgtgccaccaggttgccaaaacatgactggcttttatgcacccaaattaaaaatggcatcctgctcttagccttgggtatgggaaaatatccgcagcttttcctggtgtctttccctcagagtgtcttcaagcctcttcccatgttagctccaggggttgggagaaagaaagcgctgtccattggcctgggttgcttggatccccagtggaaagatgaatcatagggagaggctctctgcctctctcatgtactttaatcacttttattttttctcacctttatcagctgtatgccatcacaggggctttgctgacattcttctcccaaggatctgggatgtccctcacaattctggtggattcccattttccttcttgaattaaagctcacagagtttatctatatgcactatgttgttatttccaagtgcctgaggcatgctcaaatacgctgtcttgggaaaacaaaacaaaacaaaacaaaa

SEQ ID NO: 255114 - DNA, 446 bp, Homo sapiens
aatatagaaataattacacttccttatttttttaaccagcagcataaaccagacaccagattttatctcaccagactgatggaaaatttgatctcagccatatagaggctgccccatcacagtttagggattctcagggacttgggtcactggtcctcaccaattcatgatgagcggtccattggcagaacttgctcagctcctcgaggactgctgactgctgcttctgttaatggaaatgccaactgatgttggaaacctcagttccacaggttctctacttcatgtcttccaggcatcttccctctgaggtctcattgtttccccagtgctgtctcacagaggaggtggtgtgtcctccctgtccacaggatggatgacttctaaccccttcctggaagaaggcaggaaggaattgactggaagaaatctttcttatttccttt

SEQ ID NO: 255115 - DNA, 370 bp, Homo sapiens
tcctcatactacaatctgctgatatatattaatttctatctttgtttatttcctctcttacccattagaatgtcagctctataagagcaaagattttgggccaggcacgagggctcacatctgtaatccagcactttgggaggctgaggcaggaggattgtttgagttcaggagttcaagaccagccttggcaacatggtgaaacctcatctacactaaaaatacaaaaaattaaccaggcatggcagtgtgtgcctgtagtccctgctacattggaggctgaagtgagaggatcccttgagcctgtgaggttgaggctgcagtgagccatgattgctccagcctgggtgacagagcaagaccctatctc

SEQ ID NO: 255116 - DNA, 408 bp, Homo sapiens
cactgggattataggcgtgagccactgcgccctgctgaaaattcttaacttgtgagattctcactggaaaagaggatcggaaaatttcaccatcagcagaaaaagcaacaagaggcagagcagatgaaggatcagatcaccactgtcagtacaaacctcttttctgtcttatgggctctatctcagcctgtgatgtctctcttcctacacaaggctacctggattctggtccatgtggtatgatatcttattggggtgccatcaccatttttcagaccctgcccaatgacacagctccactacaaattagggcattgtgaagccccccttgggactatggaggccctagactcttctccagcctctcccaggccttctgcagcccagaataacttagaacaatggcat

SEQ ID NO: 255117 - DNA, 348 bp, Homo sapiens
tttgagacgaagtctcactctgttgcccaggctggagtgcagtggcacgatctctgctcactgcaagctccgcctcctgggttcacaccattctcctgcctcagcctcctgaatagctgggactacaggcacccaccaccatgcctggctaattttttttttatttttagtagagatggggtttcactgtgttagccaggatggtctcgatctcctgacctcgtgatctgcccacctcagcctcccaaagtgctgggattacaggcgtgagccaccgtgcctggcttggtgatactctttcaagccttgaaggggcctgttgatctttccctattccactgccaactt

SEQ ID NO: 255118 - DNA, 232 bp, Homo sapiens
  misc_feature (123)..(123): n is a, c, g, or t
aggactgccaggggcatggagtatggggatccccactttccagctctgtttacagtgcttggatgaccatagtatggacagctgaaggaatccaggggactgtgtctgtatttcctggagatnatcactgttcaggcaaagcatggggcacatgtcgtcatcaaatatggcttagggctggaaatgtccactgaatttcataggaaagaaaccttgtgggatccttggggaa

SEQ ID NO: 255119 - DNA, 340 bp, Homo sapiens
tagtggaatattaggcaaagtgaaggagaatatggggaattgcttaggaaatacaaatgatgaaatatgcccaggtgcagtggctcatacctgtagctactttggaagctcaggtgggaggatcgcttgagcccaggagttgaagacaagcctgggcaacactgtgagaccctatatctacaaaaacatttaaaaaattaaccatggtggggtgctcctgtagtcccagctactcaggaggctgaggcaggaggaccacttgaggccaggagtttgaggctgcaccgagctatggtcatgccattgcactatagcctggctgacagagcaagactctatc

SEQ ID NO: 255120 - DNA, 1126 bp, Homo sapiens
agcgggtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttggcaggtattgctgtctctaagcaagacccgatcaccagtctagagcaagaaaaagagccctggaatatgaagatatgtgagatggtggatgaatccccgagtgagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgatacatatataaaagtctttcataaaattttcaattcaaatagacacaagacaagacatactggagagaaacctttcaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttact

SEQ ID NO: 255121 - DNA, 1148 bp, Homo sapiens
agcgggtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaaggagacgttgacatttagggatgtggccatagaattctctctggaggagtgggaatgcctgaaccctgctcagcagaatttatatatgaatgtgatgttagagaactacaaaaacctggtcttcttggcaggtattgctgtctctaagcaagacccgatcaccagtctagagcaagaaaaagagccctggaatatgaagatatgtgagatggtggatgaatccccgagtgctatgtgttcttcttttaccagagacctttggccagagcaagacataaaagattcttttcaacaagtgatactgagaagacatggcaaatgtgaacatgagaatttacagttaagaaaaggctccgcaaatgtggttgagtgtaaggtgtacaaaaaaggttataatgaactaaaccagtgtttgacaactacccagagcaaaatatttccatgtgatacatatataaaagtctttcataaaattttcaattcaaatagacacaagacaagacatactggagagaaacctttcaatgtaaaaaatgtgatgaatcattttgcatgcttttacacctacatcaacataaaagaattcatattagagagaattcttaccaatgtgaagaatgtgacaaagtgtttaagcggttctcaacccttactagacacaagagagttcatactggagagaaacccttcaaatgtgaagaatgtggcaaagcttttaagcactcctcaacccttactacacataagatgattcatactggagagaaaccctacagatgtgaagaatgtggcaaagccttctaccattcttcacaccttactacacataaggtaattcatactggagagaagcccttcaaatgtgaagaatgtggtaaagcttttaaccacccttcagcccttact

SEQ ID NO: 255122 - DNA, 802 bp, Homo sapiens
agcgggtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaagcacaaggagcacgcttgacactttagcgcgactgctggccactacgcaacttcctcctctggcaggagctgggaactgcctgcaacccctgctcagccagcacactttactatactgacactgctgcactgcttacgcaagcacatcctatcacacacacaccctggctcctctccttgcgccacggctacttgcctgctcctcctacacgcacagcacccgcactcatccacgctctagcacgcaacgcacacacaacgagccccctgcgcaactactgaacgactactgctgacgcactggcctggcactgacactcccccacgcagcacccttctctgggccccagcacgtcacaggaccactacaacagcacttcctcttctcacacccaagctgcactacttgcagcaacgcacaactggcacacatgctgcaacactgcagcacacttctaccacgcttaacgacaaacggcctccgcccaacactgctggcttgcacctgtcacggctgctacccaccacaacggcttcactacatgaaactaaaaccacgt

SEQ ID NO: 255123 - DNA, 722 bp, Homo sapiens
agcgggtctctcgctgcagctggagctgcaggtctcgccttcactgccctgtgtcctctgctcgcagaggcccagcctctgtggccctgtgacctgcaggtattgagagatccacagctaagacgccaggtaccccggaagcctagaaatgggcgacctgaggtctggagtgtatcctctcaagggagcaagtggatccctggggcagagaggaagcttctagtgtactcttactttgaaaagggtcgcgctgttttgccaggctggagtgcagtggcatgatctcagctcactgcaacctccgcctcccgggttcaagcaattctcctgcctcagccaccgaagtagctgggactacatgcacatgccaccatgcccagctaatttttgtgtttttagtaggacggggtttcaccatgttggccaggatggtctcaatctgttgacctcgtgatccacccacctcagcctcccgaagtgctgagattacaggcatgagccaccacatctggcctatgcctctccttcttaaactgctataagataacttccagatgttgccatggcatttataaactatcatagcactggtgggagtatagcagagaggatgaccataggtcactctcatcaccatgttaattttggtgggttttatccagcttctaatactgcaaactgtgttatcagccaggtctttgtgacctgtatcttatgctgac

SEQ ID NO: 255124 - DNA, 776 bp, Homo sapiens
taaggccctgcacagcccacagccccatgaatcagactcagttgttgtgacacagtgacttcacttgtggtccctgaaaatgtgcagggtatagggagcttttcccttcactcacactgtggaggaagatgaggtagcatctccaggggaagactgcctaaggcgggcaggtgggagcccctccaggtaagcctctgcctggtcaaccagacatgcagggttcctcacctttccagactggaagggatttccccagatgccaatgcataatctctcttcccttataaagcaagagctagcagatattctggcttattctaggatgtctagccccttctgaaacagtggcagcaacgcccactccctctgacagagtctgttcccagagtggttgagatgacggcttccacagggcggcagaagcctcttcttctatctgtcaggcctgttttgctgctggttttgtgctgcacagttgcattgtctgtaaactcccctggctctgcctggcatcgtttggtcattgaccctgaacctgtgagttggtgaacacaaagggccctgcatttgcgagccagttcctggttctattcctctgccctgtttcctggcccattcagcagctttttctcagtggtatttacttaggcgttccgtgttgggaaaggtgggttgcttgctgttgggtttcatgcttttcctattccatactgctttttatccatattcttccaatatttaaaagaaaggattgtgtgcaaggcttagcatttttc

SEQ ID NO: 255125 - DNA, 389 bp, Homo sapiens
cccgtacctgtacctccttcacgcaagcaatgcccagtgttacaccatttttgaggctctcctctagccccacagactcttcaaccttttcagcactaaaattaaaagtaccttcttgctcatgcaaaacaattctacccccaagctattcatcaagcaagaatgtttctcttctaagaagaagtctgtgcagatacttagcacaaaatttcaccttctatctcacttagttatatacttcttaattcagcagccctgctgagtaaatcagtgagtcttgagaatgggttgtgtcaagaatatggatataaaatagtttcaggacaaagaatcactgtggaaatttcaaacagcagaacaatatcaaaggaaaaattatgtgttagacg

SEQ ID NO: 255126 - DNA, 698 bp, Homo sapiens
gttccctcccatgacacgtggggattatcgcaattcaaggtgagatttgggcaggacacagagccaaaccatatcacccgtcttacccaattctgttgaaataaacagacatttcctgagtacctgctatccattcaagttttttctatgagctaggctctggtccaggagtatagtaaccctacgggtgatttcagaccaataataagtaacactattaagaacacatcacagaagagtaacatctctgactcgctgatatccatttcaaaccacataacaatagcatgaagtagatgtcactgactcaaattaacagaagagaaaactagggtgcagtgtttgtgattaccttggactctcaccataatagactgagctcatgttttctgactcaaaacacaaaacttttcccttgatatagttgcctctagaagaagtcccttgtctccctcaaatagcaatcaagtagaagggaaaatagtgtaagtcaatatatattaagtactttcagtgtgattccaagaaactattgagttgcgatgctaaagggagcattttatttttcagccttgggatcagaaaaacattacataaagaagtgtttgggttggaccttaaaaaaaggtataccatttcagcaggtataaatggaatgaaatgcaaatagagttgggtaaggagcagtataagccaaa

SEQ ID NO: 255127 - DNA, 394 bp, Homo sapiens
gcagaattccctctttctcggaggatctcaggctttttctcctaagtccttcaaccaagtggatgaggccacccgcattagagaagggaaagctagctgatatgttatgaggacatttgagcagccccatggagaagtccacgtggaaggaactgaggcctcttgctaccgttatgtgagtgagccatcttggaagcagatcctccagcctggttgatcctttggatgactgcagccccaggtgccatcttgactacaacatcaggaaagattccaaattagactcccccatcccaggttgcccaaactaaataaaagaattccaaaagagcatttttggatttctgcccaagaagatgcccaaagatctggtataaaagaatggaacaatatc

SEQ ID NO: 255128 - DNA, 355 bp, Homo sapiens
caaatgtgcagctataaagaatacagcaattactagtatagtttggtgccactgctttgattcctattaagacacaagcagttttactcacagtaaagaaacaaccaatatcttaggtttattatgaaaataattttgacattggggactcttttgatagctgctattctagaataaaaaggcttattgcagtcacaaataagcctgagatatagggttatggaatttagtatagatgggttgttgagagaaaaatatgtggatatcaagggccagtttttcatatctgcagcttcctgagggctgactgtgggacttgattatctgcagattttgatattagtgaggggacctg

SEQ ID NO: 255129 - DNA, 2596 bp, Homo sapiens
tccagacactcagtggagtagcgggccacttccgctccgttactgtgaggttgctgcagttttgtccctggtagtttgggtcagttccgcgagacccttctgaatttcctggacctacgcactggatccttaacgaactggtgatcgaattaggggaaaagaaacctcgtcggagagcagaggcaggattctgctttcccttggactgtatcactcaggactctgaatattccctgaaataggaggaaaaatgaccacgttgaaggaggcagtgaccttcaaggacgtggctgtggtcttcactgaggaagagctgaggctgctggaccttgcccagaggaaactgtaccgagaagtgatgctggagaacttcaggaacctgctctcagtggggcatcaatcactccacagagatactttccacttcctaaaggaagaaaagttttggatgatggagacagcaacccaaagagaagggaatttaggaggcaagatccaaatggagatggagactgtttcagaatcaggaacacatgaaggcttgttcagtcatcaaacctgggaacaaatttcaagtgacttaaccaggtttcaagactccatggtaaacagctttcagttctccaaacaagatgatatgccctgccaggttgatgcaggactatctataattcacgttaagacagaaaccttctgagggtaggacgtgtaaaaagtcctttagtgatgtctccgtccttgatcttcatcaacaactacagtcaagagagaagtctcatacatgtgatgaatgtggaaagagtttctgttatagctcagctcttcgtattcatcagagagttcacatgggggagaaactctataattgtgatgtgtgtggtaaggaattcaatcagagctcacatctgcaaattcatcagagaatccacactggagagaaaccattcaaatgtgagcagtgtgggaaaggctttagtcgtagatcaggactttatgttcatcgtaaattacacacaggagtgaaacctcatatttgtgagaaatgtgggaaggccttcattcatgattcccagcttcaggaacatcaaagaatccatactggggagaagccattcaaatgtgatatatgttgtaagagcttccgtagtagagcaaatcttaataggcattccatggttcacatgcgagagaaaccattcagatgtgatacatgtggtaagagctttggtctgaaatcagcacttaatagtcatcgcatggtccacacaggagagaaacggtacaaatgtgaggaatgtggaaaacgcttcatttataggcaagatctttataagcatcagatagaccacacaggggagaagccatataattgtaaagaatgtggaaagagcttcagatgggcctcaggtctttcaagacatgtgcgagtccacagtggagagacaacattcaaatgtgaagaatgtgggaagggattttatacaaattcacaacgttattctcaccagagagcgcacagtggagaaaagccatatagatgtgaggagtgtgggaagggctacaaaaggaggttggaccttgactttcatcagagggtccacagaggagagaaaccctataattgtaaggaatgtgggaagagctttggctgggcctcgtgtcttttgaatcatcagagaatccacagtggagaaaaaccatttaaatgtgaagaatgtgggaaaagatttactcagaattcacaactttatacccatcgtagagtccacagtggagaaaaaccattcaaatgtgaagagtgtgggaaaagatttactcagaattcacaactttattctcatcgcagagtccacactggagtaaagccatacaaatgtgaagagtgtgggaagggcttcaacagtaagtttaatcttgacatgcaccagagggtccacaccggagagagaccttataattgtaaagaatgtgggaagagctttagccgggcctcaagtattttgaatcataagagactccatggtgatgaaaagccattcaaatgtgaagagtgtgggaagagatttactgagaattcacagcttcattcccatcagagggttcacactggggaaaagccatacaaatgtgagaagtgtggaaagagcttcagatgggcctcaactcatctaacccatcagagactccacagtagagaaaaactacttcaatgtgaggactgtgggaagagcattgtgcacagttcatgccttaaagaccaacaaagagaccaaagtggagagaaaacatctaaatgtgaggactgtgggaagcgctacaagaggcgcttgaatcttgatacgcttttgtcattatttttaaatgacacataactgttgtactcatttatggggtacagtgtgatagttaatgcaagtatacaatgtgtaatgatcaaatcagtgtaattaacatacctatcacctcaaacatttatcatttatttatgttgggaacccttaaaattcactgtcctagctatttgaaaataatacgttgttaattactgtcaccctgtagtggtgtaaaacactagaacttattcctcctacctgcc

SEQ ID NO: 255130 - DNA, 382 bp, Homo sapiens
gggcccagaatcacttttgtacaacatggtttccaaattggtagtcgtaggagcaatctgggtgagtagtcatacatagccactaccagaattccctcacacctagctattctatttagtcatcatgtccttatcttttgtcccctgtaatgatcagttctctactctgtttataaaccattgactcctgagctcatgattcttctcagtctgcctctcttgctttctctcttacttttccctaacacgtatagacactatgtgccgtcaagtctttgctgcttgctactccctgaatacttagtactttttcataccctcaatctttctcttctcagaggatgccattgcttgacatctctgcttattacagttcttttct

SEQ ID NO: 255131 - DNA, 140 bp, Homo sapiens
ttttgtttggattacaaaccacattacttgataaatatctgagaaaaatgggagtgggtaagtcggaaatcaaagtagatttcacttattctatgaatacagtccttctaagaacaaagattcttgcaagtgtttagttt

SEQ ID NO: 255132 - DNA, 422 bp, Homo sapiens
taggaagtactttcatttcgttttactttatcagttctatcctgctcattcataatgctgttcttttccaatcaagcctctggctgcaatatactaccacatttcatgcagtatattatccctccctcagccccccgatcttgatgttcaaggtccctgagcaccaagtttctcgtcttaaatggtgaaaaaaaatccaaaattactgatggtcctgttcacaacagtgtctcttcttcagagaatctggttattcacttaagaaaacaaggatatgtggatgtctagaatatgacagacatacacccaaaatacggataattaaaggatttgtatgacattgacttagcgatgtagaggctttactctttactcagaaggcaggcatacaaccaaataaacacaaaactgtctgttagcat

SEQ ID NO: 255133 - DNA, 1287 bp, Homo sapiens
cctgtgtgccacgtgctggacaaatcttaactcctcaaggactcccaaaaccagagacaccaggagcctgaatggggaacgattctgtcagctacgagtatggggattacagcgacctctcggaccgccctgtggactgcctggatggcgcctgcctggccatcgacccgctgcgcgtggccccgctcccactgtatgccgccatcttcctggtgggggtgccgggcaatgccatggtggcctgggtggctgggaaggtggcccgccggagggtgggtgccacctggttgctccacctggccgtggcggatttgctgtgctgtttgtctctgcccatcctggcagtgcccattgcccgtggaggccactggccgtatggtgcagtgggctgtcgggcgctgccctccatcatcctgctgaccatgtatgccagcgtcctgctcctggcagctctcagtgccgacctctgcttcctggctctcgggcctgcctggtggtctacggttcagcgggcgtgcggggtgcaggtggcctgtggggcagcctggacactggccttgctgctcaccgtgccctccgccatctaccgccggctgcaccaggagcacttcccagcccggctgcagtgtgtggtggactacggcggctcctccagcaccgagaatgcggtgactgccatccggtttctttttggcttcctggggcccctggtggccgtggccagctgccacagtgccctcctgtgctgggcagcccgacgctgccggccgctgggcacagccattgtggtggggttttttgtctgctgggcaccctaccacctgctggggctggtgctcactgtggcggccccgaactccgcactcctggccagggccctgcgggctgaacccctcatcgtgggccttgccctcgctcacagctgcctcaatcccatgctcttcctgtattttgggagggctcaactccgccggtcactgccagctgcctgtcactgggccctgagggagtcccagggccaggacgaaagtgtggacagcaagaaatccaccagccatgacctggtctcggagatggaggtgtaggctggagagacattgtgggtgtgtatcttcttatctcatttcacaagactggcttcaggcatagctggatccaggagctcaatgatgtcttcattttattccttccttcattcaacagatatccatcatgcacttgctatgtgcaaggcctttttaggcactagagatatagcagtgaccaaaacagacacaaatcctgccc

SEQ ID NO: 255134 - DNA, 618 bp, Homo sapiens
ctatttgctaacggcaggaattgattatttcacactgcacatctaattaaagtggagaggagtaatgagcagtgaagttataaaatgaatatgataatcaattaggtttttacttctgcttaaaataatttagaatagcccatctactgtatattgaaactaatataatcagtttaacagaccttgatgcattcagagagaacaacagactgccaaatcctgcctatctcctcgtaggacattatcaaaacaatatcttgagccttggtgagaaaaatcacaaaaaaaccacattaggcagaacatcacttttccattatgtcatacataccaaatgctttctggtcctgcttatgtttacagaacaaagtgggtcaaaggaatttactgagatcataaagggcaagataaatgctggagctgagcaccccagtagctgctagacttgatggaattaaaaatggaaaattaacctatgactcaggaaatcaaccttttagatagttctggaacactaagtgtggaaggacattcatttaatatagtacagactaagaacagcactgtgagatttactagatgtactagaaaagcatggtaagatgaaagagctagtat

SEQ ID NO: 255135 - DNA, 269 bp, Homo sapiens
tgcttctcatactctgaggctacacttttaaaaatataagaacctagtgatattatttttaataacacattttatttaacataatatatcccaaatattatcatttcaacaagtaatcaataaaaattaatatatcaaaaactaaaattaaaatgaaaaataacaaaactaaaattgcctgtgttgtttgcattatatttctattagagaggcctattctaaagttactttttctccagcttaattaaaatataattgacaaatgcaaa

SEQ ID NO: 255136 - DNA, 323 bp, Homo sapiens
  misc_feature (156)..(156): n is a, c, g, or t
aatcctgtcttctaactttttgaaatatactagctgggtgtggtggcgtgctgagtcccagctacccaggaggctgagacaggaggaacacttaagcccgggagtttgcagctatagtgagctatgatcacacttgtgaatagctgttgcacttcngccttagcaacagagtaagacccatctcaaaaaggagaaaatatacagtaagctattgtgtatccacccttcagtgcagcaaaactactgaattcattcctcctatgtagctgtaattttgtatctgttaaccaacatctacctcgccttttctccctgctaccatt

SEQ ID NO: 255137 - DNA, 430 bp, Homo sapiens
gcatcctctgccaccacatggcactctctccatgcagatactcggcatactgctctctctccatttgcagatacttcagccactccatcacctgcaagaatgggcacagaagttaggaagggctgtctggtcctcacatgcttctggccccctggggtcaccttccttccacatccctccctctgcaaagcctcacctgccccaggtgtgcttccagctgtgcccgttcgtctgtgggctgctgtaactgctggttagcgtcaggggcttcacaccagctagataactgaatgatgaagaaagagaagtttcaatctgaggagcctgggctgttccacacagtgccccttaaaagggctagagctaggttcaatgtacaacttggtcaataaagatctctactgtgaaggtgctttcctttagaaataaa

SEQ ID NO: 255138 - DNA, 399 bp, Homo sapiens
gagaaagctgcatctgcgaagactctatattgtctccagttgagagtgaatgtaaagtgaggaaacagtacatgaaggcttactcttcaacaagtctataccaagggaaaaagaagtaaagcaattgtgcacagtgacgtcctgggctgaaatatttctcccaccccagccttctgagtagttgggactacaggtgcacaccaccacacctggctaatttttttaaaaaatattttttgtagagatagggtctccctatgtttcccaggctggtcttgaacccctggattcaagtgattctcctgccttgacctctcaaagtgctgggattacaggtgtgagccattgtgcctgatatttgtttgtttttaagatatgatgtccttgaatatgttcata

SEQ ID NO: 255139 - DNA, 178 bp, Homo sapiens
aatgtgcacatctggtatttcctgtgtgagagcaaaactgcaggactcagtgagtggtttctgtggtttgcacttgtgtatctgggtgtatgggagtgtgtagccctgctgactgtgtagatatgaatgtgtgtgcagttgtgagtcttgcatgtggtcatctatgtgaaacaatgcc

SEQ ID NO: 255140 - DNA, 206 bp, Homo sapiens
tacagaagtagcctgacccattggcagaactgtctgcctctgctggagagacggctggacttgagcctgtgcaatcttcaccccttggctagatcttgaggcgtgggagaggcagactgtgtagtagcctgttaccatgatggggaattaagcagtagaaatgcagttagtaaaagtaaccattgctggatcctagttctcttcta

SEQ ID NO: 255141 - DNA, 408 bp, Homo sapiens
taaaagaatgatcaatatcttttatgttagtctttttatgaaatctgaaattttattctactaaacttagggatccataatttcagttcgtcatattagtaacatgtgtagtggccaggcacaatggctgacgcctgtaatcccaacactttgggatgccgaggaaggaggatcgcttgagcccatgagattggtaccagcctggacaacacagagagacctcatgcctaccaaaaattttaaaaacgagcatggtgacacgtgcctgtattcacagctactcaggaggctgaggcagtaagattgcttgaacctgggaggtggaggttgcagtgagcagtgatcatgccactgcactctagcctgggcaacagaacaaaagcctatccaaaaaaaaaagaaaagaaa

SEQ ID NO: 255142 - DNA, 1044 bp, Homo sapiens
ggccagaatgtggccatgttaaatgatatagctattaagctcacttttacaatctaaaaggaactaataaagccaggaaacccttctcatcctccttcacagccctcatcccacacatagatgtaaaaagcttagaaagaatattctgatggctttttcagaaggaaggaccttgatgtgtgtattgtggtaaaatgaaaagcaaaatgagacagtatttaaaagtgaaagagcagagttttgctctgctgaaaaccccttccctgaagaactgattgctgttgaagttaattggcccttagatgggaagccctaagccaagctcccacttacacagtgtcaaacatcccgaagtggaaacattttatgccagtcaggggagagacaggcaacaatagcccaaatgtcattgccaagaaacatctgatactttctaatttctaaaccccaatggaagtgaggcctttttcattgattctcagttctgaaactcccaccctgttaggatttccattccaaataattcaatgagaggtttccagagaaacagtcacagagctcaagagaaagaacacttaaatgctcctgctgtaattgcatcaaaaaatccgggttttaacatcaaatttggcaaatggtgggaccaacccaaggttaactaagtgggctttcattggcattgagctatgttacttataaattataacactatagttccaaggtttttcagccttttggccaacacacacacacacacacacacacacacacacacacactataccatcatctatcaatagtctaaatacataaataaatgcaggtcatttttatcaatggcctaactaaatttatatttaaaagaacaagacttttaaaaagtacatactcctgttggtttgtaagttatacacatttatctcttgtctttgatttaattaaattagtgttttaagtatgaatttattttcctttgctactcattacctgaccactttcactcctctagatacccttaggaataaacctgaactgttccaaatc

SEQ ID NO: 255143 - DNA, 333 bp, Homo sapiens
cttggtctttccagttttataaatctctgtatcctctctctctcttattcggataaagcctctttgagttggaggtagatctggagtttctaccacttgccatgaaaagattactggataaatcttcaataagattattgtcaactgaaacagtttacagaatgggctccagaattatattatagaaaaacatcattgaatacaaattctaatgcctgaaaaatatgttttttctatgagctactattaattattaacgaattaaggcatttgctcattttattcaatgtttattacaaatatatgatttatcaggcactgtgttctgcctta

SEQ ID NO: 255144 - DNA, 350 bp, Homo sapiens
gaatcaacacagttactgggtgaatttaggatgaactacgtgtgacaaatggtgccgttgagtcctctcaactgggaactagtcaccatctatctggagaccatgtgtgtaacgggttgcacctgcttggctggatacaaaggtgggatttctttctgtctttgtcatctcttagcagattgcatcacattttggcttaatgcttactcaatcataagacaagtttcttttacttctatggatgtgaggggggtttctgggctgagcagaaatttgtttcttaattatatttttccagcaacccccacccaacctaccccaccttctctgaagctacttcccccaggctt

SEQ ID NO: 255145 - DNA, 675 bp, Homo sapiens
tccctcaaagtgctggcatttgacaggtgtgagccaccatgcctggcctccatgtcccactttgatagatccttcttttatgttatttgaaaattcagagtaactctaagacaaaaatggacaaaatgattttttgttcccaaattgcatatgcccccctgtatatactgatacttggtctccttgaaaaaatcattgtcatagggctagaaatgagagtaagtcacagaccttgctctctaaaaatagaaatgggaaccactaatcaggatcgagtattctctagagtactggaagagtgctttgctctcttggacccaggtaagttctgtgttatggaagtaatttcacaggaacttgagatcaatgcccagtattccctagtgtaacttttgatattgaagagtgacagatttgcagtatgacatttacatttagtaaatatatcttttaaaatactcatcctgcatctgaataagatctactttacaaattcattttaatgtatattctgtgataattctgataatacataagaggtaagtgttattgttactgctatcttccttccttcctttgcacatttaagtctagtgtgtcttaaactctagtgggatttctactgtgtcttgcatagattggtcaagacagaatttttgtcctgaaggatcctgt

SEQ ID NO: 255146 - DNA, 1968 bp, Homo sapiens
cgcctgcgcttgctgtggcccgggtccctcagtgccgcggcggcccggaggtggcgggaggacggctccgcgctgcatgcggggcggggaccagggacccgtgcgggccgcctccagagaatgaggctgccagccttgagagcaccaccgttacctggttgaagaggggaggggaagtccagcattggcctctgcagcgtggatctcccggccaggctctcagctgtcagatcctacaaccagaactctgcgccccaggatggaggctccagcccagaaggctgggcagggaggactccccaaggccgatgcccagggtgcctccggggcccgggagaagaggcccgaggagccgaggcccctcgaagaggaccgagctgggagccgccccactcaaaagggggacctgcgtggagcggcgggcggtaggacgactcccccaggcgggggctcccggggctgcagcctcggggtgagccccggcccggggacccggcacagcgccgggaccagacccctcgtgcgggagccgtgcggccccacctcttctcagaaccctgagctggttatccccgaggggctgcaagcccgggagggcccctgtaggagcccagcgcgtggcggggactgcagcaggaactcctgcctggcgtggcatcgcggggcgcccgctggggagacgccacccgtgtgtgacccctgtccggagcggatccagaaccacccccggactcaactgtgtgaggtccacacggactgttggccgtgccaaccagggactggcgctccgacctgcccgaggaccccaaagccgacctcccgcgggaggaaccccttggtggagcagccccgggcttgcgcgtgcggcgaggcctttgcgtggagggccctgcggatcccccaggagaggctgcaggcgacggaggagccccgtccgtgtgcccggtgcgggaagcgcttccgccccaaccagcagcagcaggcgggcaagagtcccccagtgtgtcctgagtgcggccaaacctcgcgacctcgccctattgtccccgaccccccggcccagcgactgtacgcttgcgacgagtgcggcaaggccttcacgcgcacctccagcctgctgcagcaccagcgcatccacacgggcgagcggccctacgagtgcgccgagtgcggcaaggccttcgtgcgctgctccggcctgtaccgccaccagaagacgcactcggccgagcgccaccggcgtggccccgtcctggcgcggcgcgccttccggctggggtgcccgccctgcggggactacagcgagcggagtccccgacgggggtcgggagccggggagaagccgtacgagtgcgccgactgcgccaaggccttcgggctgttctcgcacctcgtggagcaccggcgcgtgcacaccggcgagaagccctacgcgtgccccgagtgcggcaaggccttcaaccagcgctcgaacctgagccggcaccagcgcactcacagcagcgccaagccctacgcgtgcccactgtgcgaaaaggccttcaagggccgctcgggcctggtgcaacaccagcgcgcgcacaccggcgagcggccctatggctgctccgagtgcggaaagaccttccgcggctgctccgagctgcgccagcacgagcgcctgcactcgggcgagaagccctacatctgccgcgactgcggcaaggccttcgtgcgcaactgcagcctggtgcgccacctgcgcacgcacacgggcgagcggccctacgcgtgcggagattgcggccgcgccttcagccaacgctccaacctcaacgagcaccggaagcggcacgggggccgcgccgcgccttgactgcagggagccgagagtcgacgcgtcgcccaagcgaaccctgcgtcgaggaggggcctttgtcccggaaaacccaccaacgtttgtaactttgattaaacttcactttgtac

SEQ ID NO: 255147 - DNA, 2222 bp, Homo sapiens
cgcctgcgcttgctgtggcccgggtccctcagtgccgcggcggcccggaggtggcgggaggacggctccgcgctgcatgcggggcggggaccagggacccgtgcgggccgcctccagagaatgaggctgccagccttgagagcaccaccgttacctggttgaagaggggaggggaagtccagcattggcctctgcagcgtggatctcccggccaggctctcagctgtcagatcctacaaccagaactctgcgccccaggatggaggctccagcccagaaggctgggcagggaggactccccaaggccgatgcccagggtgcctccggggcccgggagaagaggcccgaggagccgaggcccctcgaagaggaccgagctgggagccgccccactcaaaagggggacctgcgtggagcggcgggcggtaggacgactcccccaggcgggggctcccggggctgcagcctcggggtgagccccggcccggggacccggcacagcgccgggaccagacccctcgtgcgggagccgtgcggccccacctcttctcagaaccctgagctggttatccccgaggggctgcaagcccgggagggcccctgtaggagcccagcgcgtggcggggactgcagcaggaactcctgcctggcgtggcatcgcggggcgcccgctggggagacgccacccgtgtgtgacccctgtccggagcggatccagaaccacccccggactcaactgtgtgaggtccacacggactgttggccgtgccaaccagggactggcgctccgacctgcccgaggaccccaaagccgacctcccgcgggaggaaccccttggtggagcagccccgggcttgcgcgtgcggcgaggcctttgcgtggagggccctgcggatcccccaggagaggctgcaggcgacggaggagccccgtccgtgtgcccggtgcgggaagcgcttccgccccaaccagcagcagcaggcgggcaagagtcccccagtgtgtcctgagtgcggccaaacctcgcgacctcgccctattgtccccgaccccccggcccagcgactgtacgcttgcgacgagtgcggcaaggccttcacgcgcacctccagcctgctgcagcaccagcgcatccacacgggcgagcggccctacgagtgcgccgagtgcggcaaggccttcgtgcgctgctccggcctgtaccgccaccagaagacgcactcggccgagcgccaccggcgtggccccgtcctggcgcggcgcgccttccggctggggtgcccgccctgcggggactacagcgagcggagtccccgacgggggtcgggagccggggagaagccgtacgagtgcgccgactgcgccaaggccttcgggctgttctcgcacctcgtggagcaccggcgcgtgcacaccggcgagaagccctacgcgtgccccgagtgcggcaaggccttcaaccagcgctcgaacctgagccggcaccagcgcactcacagcagcgccaagccctacgcgtgcccactgtgcgaaaaggccttcaagggccgctcgggcctggtgcaacaccagcgcgcgcacaccggcgagcggccctatggctgctccgagtgcggaaagaccttccgcggctgctccgagctgcgccagcacgagcgcctgcactcgggcgagaagccctacatctgccgcgactgcggcaaggccttcgtgcgcaactgcagcctggtgcgccacctgcgcacgcacacgggcgagcggccctacgcgtgcggagattgcggccgcgccttcagccaacgctccaacctcaacgagcaccggaagcggcacgggggccgcgccgcgccttgactgcagggagccgagagtcgacgcgtcgcccaagcgaaccctgcgtcgaggaggggcctttgtcccggaaaacccaccaacgtttgtaactttgattaaacttcactttgtacacatggcgtccacaggcttcccctaactcgagttttatttgaccttttctaaccgggcgcacagcatccggttgcaggcataagcagtaataatctcgagtgggcgctgatacggcccagacgctgtgtccacgatctctagggtctttttctccgcagagccgcggagcgtgttactgggctctctggtatgcgaggaaacggggcaaagtgactctcctgaggcacgaacataagacgatggaggcaggatt

SEQ ID NO: 255148 - DNA, 2324 bp, Homo sapiens
cgcctgcgcttgctgtggcccgggtccctcagtgccgcggcggcccggaggtggcgggaggacggctccgcgctgcatgcggggcggggaccagggacccgtgcgggccgcctccagagaatgaggctgccagccttgagagcaccaccgttacctggttgaagaggggaggggaagtccagcattggcctctgcagcgtggatctcccggccaggctctcagctgtcaggtgagtctcacctcacacctctcagaagacatggacaatggcagtgaatggagccaggaggacccggagtgtcggcttgccactgagaaacggagggcaggaatcctacaaccagaactctgcgccccaggatggaggctccagcccagaaggctgggcagggaggactccccaaggccgatgcccagggtgcctccggggcccgggagaagaggcccgaggagccgaggcccctcgaagaggaccgagctgggagccgccccactcaaaagggggacctgcgtggagcggcgggcggtaggacgactcccccaggcgggggctcccggggctgcagcctcggggtgagccccggcccggggacccggcacagcgccgggaccagacccctcgtgcgggagccgtgcggccccacctcttctcagaaccctgagctggttatccccgaggggctgcaagcccgggagggcccctgtaggagcccagcgcgtggcggggactgcagcaggaactcctgcctggcgtggcatcgcggggcgcccgctggggagacgccacccgtgtgtgacccctgtccggagcggatccagaaccacccccggactcaactgtgtgaggtccacacggactgttggccgtgccaaccagggactggcgctccgacctgcccgaggaccccaaagccgacctcccgcgggaggaaccccttggtggagcagccccgggcttgcgcgtgcggcgaggcctttgcgtggagggccctgcggatcccccaggagaggctgcaggcgacggaggagccccgtccgtgtgcccggtgcgggaagcgcttccgccccaaccagcagcagcaggcgggcaagagtcccccagtgtgtcctgagtgcggccaaacctcgcgacctcgccctattgtccccgaccccccggcccagcgactgtacgcttgcgacgagtgcggcaaggccttcacgcgcacctccagcctgctgcagcaccagcgcatccacacgggcgagcggccctacgagtgcgccgagtgcggcaaggccttcgtgcgctgctccggcctgtaccgccaccagaagacgcactcggccgagcgccaccggcgtggccccgtcctggcgcggcgcgccttccggctggggtgcccgccctgcggggactacagcgagcggagtccccgacgggggtcgggagccggggagaagccgtacgagtgcgccgactgcgccaaggccttcgggctgttctcgcacctcgtggagcaccggcgcgtgcacaccggcgagaagccctacgcgtgccccgagtgcggcaaggccttcaaccagcgctcgaacctgagccggcaccagcgcactcacagcagcgccaagccctacgcgtgcccactgtgcgaaaaggccttcaagggccgctcgggcctggtgcaacaccagcgcgcgcacaccggcgagcggccctatggctgctccgagtgcggaaagaccttccgcggctgctccgagctgcgccagcacgagcgcctgcactcgggcgagaagccctacatctgccgcgactgcggcaaggccttcgtgcgcaactgcagcctggtgcgccacctgcgcacgcacacgggcgagcggccctacgcgtgcggagattgcggccgcgccttcagccaacgctccaacctcaacgagcaccggaagcggcacgggggccgcgccgcgccttgactgcagggagccgagagtcgacgcgtcgcccaagcgaaccctgcgtcgaggaggggcctttgtcccggaaaacccaccaacgtttgtaactttgattaaacttcactttgtacacatggcgtccacaggcttcccctaactcgagttttatttgaccttttctaaccgggcgcacagcatccggttgcaggcataagcagtaataatctcgagtgggcgctgatacggcccagacgctgtgtccacgatctctagggtctttttctccgcagagccgcggagcgtgttactgggctctctggtatgcgaggaaacggggcaaagtgactctcctgaggcacgaacataagacgatggaggcaggatt

SEQ ID NO: 255149 - DNA, 352 bp, Homo sapiens
ttttttttttgagacagagtctcgctttgtcgcccaggctggagtgcagtggcgtgatctcggctcactgcaagctctgcctcctgggttcacgccattctcctgcctcagtctcccaagtagctgggactataggcgcccgccaccatgcccggctaattctgtttttgtatttttagtagagacggggtttcaccatgttagccaggatggtttcgatctcctgacctcatggtctgcctgtctcggccttccaaagtgctgggattacaggctgagctaccacgaccagccagcatgtaacattttttaaaacacaagtttatgaccatacgtagacatctgtacctaa

SEQ ID NO: 255150 - DNA, 427 bp, Homo sapiens
ctgcttaatcttcatatcaaatctatttcctcatctagaataatagtatctaaggtttcttgtgaagattaaaagaaattatgtgaagggtttcccagtgtttcttagatactctattttttcccttaaaggacttggccaggtgtggtggctcatgcctgtagtcccagcactttgggaggctgaggcaggaggatcacttgaggtcaggagttcgagaccagcctggccaacatggtgaaaccctgtctctaccaaaaaatacgaaaattaccggggcgtggtggcgggtgccagtaatctcagctactcaggaggctgagacaggatgattccttgaacctgttgtggggaggttgcagtgagccaagattgcgccactgtactccagcctaggtgacaaagtgagactctgtctcaaaaaaaa

SEQ ID NO: 255151 - DNA, 377 bp, Homo sapiens
ttgttccttcctccccaccttcattccaccttaattacccaggcctcggtttgcattcatgagccaggaagacatgcatgtagataaagtgactcacctgcctcctctgttcctttctttacctgccttctctagctacaagatgcctccattgctctcatggtcctgggttcaagtctcagttatctgtgtgatttaagccttatgaccctgtacagggagcactttgcacctgaaggcctggctttctcatttgtggccaggcttggtggctcatgcctgtaatcctaacactttgggaggccgaggtgggaggatcacttgagtccagtagttcaggaccaacctgggcaacatagtgagaccctgtctctaca

SEQ ID NO: 255152 - DNA, 773 bp, Homo sapiens
cccacagcctccactgtgcatcagggagccaccacttctctggccaacatttcctagtggaaaggcccctctcctccccaaggagcaatgtcactcggcgagctcccagggaggaagtaagcatgcacagctctgcccttccctcctcttctttccaaagcccaccttcggggctcacaccttctctgcttcaccacttgttaagcctctggaagcagctctgccctactttgtggagagggtgaggcctaatgttgttcagtgccacctgaggttgcacgagccacagaattaagagcccactgtggccattcagacgagccatctcctctgtgtcaggtaacgatggccacagtcacgctgcataacaacatccatgaaacctcagcaccgtataacaataagcatgtagttagctcatgaacctgaaggtctgaaggttggctgccccgggtcgggcttgcctgggctgtctccaactgtggctcagctggggtcatctagtctaggtggcttggcctcccccagtgtgacacatcttcctcccaggaccaagacactagcaatgacagaagcacaggagggcaagccagcagctgcaggtccccaaagcaagtcacgtggccagcacccatgcagtagggaagggtactcctgcggaagtgagcaggagagagcaaatatttcccgacagtaatccagtctaccacagcctgccttcctagagacagttattcatgttccacatgcagaatatacccaatcaacacccc

SEQ ID NO: 255153 - DNA, 452 bp, Homo sapiens
tttgtctacagtcttgaagaacgggttgaaaacaacagtgtgccaagtcgcttctcacctgaatgccccaacagctctcacttattccttcacctacacaccctgcagccagaagactcggccctgtatctctgcgccagcagccaagacacagccttgcagagtcaccgctttcctgtgcagaaaccttaggggccctccaggaagctgtgggggccaccaaagccttcggtgaacatttcctgcaagagccccgacagaagattcagaacatcatagcacctgctcattcatccatgtggcaacgttacatcctatgctcatatttagagtgtgggttttctttagcgtgtgactctgccctgttaactgatttgaaaaatgataaacacattcagatctagtctttttaaaatccctttttaaattgtaaaataaagcaagcatgctat

SEQ ID NO: 255154 - DNA, 303 bp, Homo sapiens
gcctgcatcaggttcctgaatcagctctgctgagtattggctgggaaacttgggctccatggtttgcaaagagcttatacctgtctcatcccacttggtttgcccaattccctgggaggttgatggtcggtagtgccacccttacctgtgtggaggaggaaatggcagttttgggagttgagtaactgtgtaaggtcatcctgctccaggagatccagggacagcccctgcccaagtcttctgactccagatccagtattcttcccacccctctcctgaataaaggaaaccttgatttaaatc

SEQ ID NO: 255155 - DNA, 475 bp, Homo sapiens
catggttggggtgaggagaggaaaaggcttcatggagcaaaaggcactttagctgaaccttcctgaaaggtcaggcatctgataggcaaagaaaagggaaagatgtcctcactaccctttatggcaggctgtgtccccacagactctcagtgcaaattcctccttcctgaagaaagcagtcaccaagcccaacgtgcaactctcttggtacattataacttaatcaaggtgatgtttaattgctttcctcctgcttggcttcaggcttacatcaccaaagcctttagagaaacagtcaccttcacagctgtacattctgcaccaatgactacatactttagggaaggaccaaggttacagagggagactggtgccttcgctgcatgatgcacagactcagaacatccctgcactgaagtgtaggcaatattcttaatggcaatgtggcagtagcaaataaaattatatgcataaa

SEQ ID NO: 255156 - DNA, 522 bp, Homo sapiens
cagttgtttctcattcacttttaatcacgttttgagcacctgctaagtaccaggcattttgctaatgaggagcacagaggtaaaagacacatcactactgtatgaaatgcgtagctcagtggtgtgatacacaagcacagagaggtaacagagagcaaggagggcatggaagagaggcctctaactttggactgggaagggagaagatgtaagacaagaaagtcttccctaaggagctgatgcttgagctgtgccctgaggaatgaagagtagaccagttgggctaagcagacagaaaaggggaggaagctccagagagcaaatgagcatgagagtgcctgatgtagttagggcctgctctcactttaaatgaacacagacatagcattattgtggcacaaccatatagtgtggagataaaaaatggtggctatggaaattacaaagtagcagttaagaaataacgttaagcagtgttttataagtggactgtaagtataattatgtaaaatatacatatag

SEQ ID NO: 255157 - DNA, 693 bp, Homo sapiens
ggctacactcgtattatacctggtgatccattagaaaacatttgttttctatccccatgaccttagtctcttttgaattagagggctgacttccaaagggaggaatgcttccaccaagaaacacaatgattttattgaactggaagtcatgactgcaatccagctactctggcctcctcattcatctaaattaggcaaagagaaaatttattgtacttgatgggtgtttgatcctgattatcaagaggaaattgggctgctactccataatggaattggagatagtacatctggaatacaacagatcccttagggtatctgctagtactaccatgctactgtgtgtggcagtgggactagtgaattttatttccatgtgtccactgatgcactgcatttactgtgaagtgagctccttgatcagcaagaatattgtttggaagagtatgacattggataagaaattcaacaggtcccttagggtatctcttagtactgccatgctaccgtgtgtggcagtgggaccaatgaattttatttccatgggtccattgatgtaccacatttactgtgaagtgagctccttgatcagcaagaatgttgtttagaggattatgaaaatggataagaaattacataagtccacaaatagtaaatgataagtcatggatggcagaaatattccatacatgg

SEQ ID NO: 255158 - DNA, 690 bp, Homo sapiens
aaaaaattagctgggcatggtggcatgcacctgtagcccctgctactcaggaggctgaggtgagaggatgacttgagcccagtaggcagagattgcagtgcattccagcctgggctacacagcaagaccctgacaaaaaaaaaaaaaaaagaaaaagaaggtcacaaaaaaacagaaaactgcaaaatattgatgacaaaaattaaagaagacataaataaatggagaaatataccatgctcatggattggaagacttacattgctaaactgtcacttctccccagatggatctacagagtccacataatctcacttaaaactccagaagaaatttttgtaaagttgacagctgattctaaaattttacatagtaatcagaataggttgatattaggatagacagatagttcaatggaatagaatgcagagtttagaaatagacctacacagaaatagtccattgattttttaagagttgctttttgataagggtgctaaggtaatgtgatagagaaaggaaagtattttcaattcaaatggctgaaatgactggatatccattgagggaagaaagggactttagcctttcacacaatacacaaaaattatggaattctgaagaaaataagagaaaatgttcatgaacttggggtaggcaaaaatttaatagatgaggcaaaaaaaaaaa

SEQ ID NO: 255159 - DNA, 382 bp, Homo sapiens
cattcctgtagatgagtcttctggcttccagttttccggagaactctgaggctgtcctgctttttttttccccccactgttggtcatttgtttcttctgcctggatgcttttaagattctttgtagcttaccaagttcagcatgatatgcccttaacttgttgattcactcttatttgttgtttatttttcctggtacatagtaaggtcgtttaatctacaaattaagctcattattttagaagagacctcaagtatctctttctggaccatttgtactaatttatttcatagtgttccagatgtttgaggtatgttgatgaacaaagcagataaaaattcctgcccttgtgtagagcttaaattgtagctggggagataaa

SEQ ID NO: 255160 - DNA, 440 bp, Homo sapiens
tccaactctgagaattagttttcagtgttctcatgagactcagagaagtttaaatacctacccaaattactcagtgatagatccaaaagccaagagccaagacacacaccaatacacagaatcccaatttaatgcctttctactaatattgtctgcatttttaagaaaaatattatgaatagcaacatgagtactttacaatggcattagttatcagtttcatttcacatttcactgccatttttgtagcagacatggtcccacatcttctaattacattcccagatctcaaccactgtaaatatcttcagatcacctattttgcttaaatggtggcttctgtgtgggtaaatctggtgccctctgccttgagccccagctgtttgcatcctgctgtgtgtgattgtgagtgactcaatgttggacagcggcaacttcag

SEQ ID NO: 255161 - DNA, 336 bp, Homo sapiens
ctcctggtgattttaaggtggtgcaatttccatgacaaaccagcctaccaggtgttgtttgtccacctgagaaaacttctatttgagtattggcaccaaaattagagttcttattcttcaaaaagttgaaaaacagctgaggtcaatctcccaaaaggcaacaacgtttccattccaattcataaagtcgcgaagcagtaagatctgaaggacactgttttatttttatcggagatgaagcttgtttttatttacaatttccctggacgggtttaagccctgagaaggatgaattaactctgcctttgtatattaaacattatcaaacatccccat

SEQ ID NO: 255162 - DNA, 357 bp, Homo sapiens
cccaggctggagtgcagtggtgcgagcctggctcagcccatggggatggtggtgagctcctccatttatttatttatctggagtctcactctgccaccaaggctggagtgcagcagtgcaatcacagctcactgcagcgtcaaattcctgggttcaagtgatgctcacacctcagcctcccaagtaggtgggactacaggcacaccccaccatgcccagctaatttgtaaaaacttttctgtagagatgggggatggtctcataatgttgcccaggctggtcttgaactcctggcctcaaatgattctcctgcctcagcctcccaaagtgctggaattacaggcatgaaccactgtg

SEQ ID NO: 255163 - DNA, 483 bp, Homo sapiens
gctgttcatggaatagacacgtatggagccaggctctgtgctaggtgccagcaatgcaaagatgaaagacacctgtctcaaagagctcccaccagctgggcctggggcatcatccccaagctcacaccttgtcattcattttgcttgtctattcatggtggttaattcctgaggacaaggacttttttcatactcttcatgatacttatgtgctgagagtgggtgttgaaatgtatttgtactttgttttatttgggagaaaggccttattgtgtagcagctaagagagaaggccatagggttatatggattgggttcaaattcccctccaaacctatagctctgtggcttattaggaggatgactaggacaagttatttagcctttatatacctcagttttctcgtctgtaaaataggtgataggtaataatagcatcttttatttgaaatttaaacaaaatattgaacttggcacatagtg

SEQ ID NO: 255164 - DNA, 336 bp, Homo sapiens
tcagccccgagacactgcttcaataggaggaagaagtcaccacaggccctcactggaggtgcagcgcagtgtcagagaagtagatagagtgcctcccggccacacgccagcagggtgactctggctgactttcttagcctcttcgaacatctgttttcttttcttatttttcttcctttctgtaacctcaagaatatctgttttctcagtaataaaatgactagttgccatggggatgagaaaatggacctgttacaaagcgcgggggttgagagaagggccatggggccaccctgtctgggcttaagtcttttttttttttttttttgagaagga

SEQ ID NO: 255165 - DNA, 522 bp, Homo sapiens
gtaataaggagaactgatattctatagtgtctggaaaactcgcatgtatatgctacaaataataaaatcatgctttagaacaatattcagtgtcaagggatagtgtgcttaacatgtagctaaatgggataaaaaaccagtatgcacagtgtcatacatataaaatacaacagactttgcatatgattgtggttttcttctttgtgctttcctatatattttatatcaaacctgtattattttgttaatcatctccccacattcctattaaaccgaatataaaatagggaaaatgtacatgtatgatagcttgatagattgaaatatttatttaaggtctgtaacatttagcaggcggcagggctgactagaagataaaagaattaatctggagcggccgggtgttgtggctcacgcctgtaatcccagcattttgggaggccgaggcgggcagatcaccaggtcaggagatctagaccatcctggctaacatagtgaaactccgtctctactaaaaataca

SEQ ID NO: 255166 - DNA, 790 bp, Homo sapiens
agagcagtctttgtagaccattgctagatctttttggaatgggctgccttgaaagcagagagaatgtaaccatgtgtctttaagtggcattgtttagtggttcttcacggcagcccaaagagaaagtatctggcatcagatttgctggatgtgcagagatgccagtatctctcgtttgagctagcctctgcggtgtttttgctctcaaacctggtggtagagtgacggctttgatttgcttcctgcctgaagcctgctttggatgaatttaaaaacctgtttgtttccccatcggccggctgagccttacccataattcctgaactttgattatgggggttattacaggacaagagcttctttgtaaaagagcatgtttaatactctggggtctagcgtgactagcggatataaattgtatggaagcaattaaatgcgaaggaaatgtcatgtgggctgaatttaaacataacttgcggcattgattttttttttttaacttacactaagaaggatggagagagaaaaaagaaagagaatggaaacaggccaagcgagtcagagaagcacacgcagagacaagagaaaaggagtcatttttaacatttggttaaaagtccaaagcccagagctagcattatgtgaattatactagtattatgccattgccctttaaatgaactctttaaaaacacaaatgtcagggaagtatactgtacttggggcttgtatctctttccagttgctcctctttatcttaaggcatatatgtacatacagcagtgatttt

SEQ ID NO: 255167 - DNA, 405 bp, Homo sapiens
ccttaatcctcacaacaaacccacaggtagatactattattattcctagttttatagatgaggaagtggaagcctggaaaggttgagtcatttacccaaccagattcatacagctaaagtcatggagctgggaatccaacccatatggtttggctgtggagtcaccattctgacctaccttactgtatggaaaattaatggcaagagacgagagagaatgagttttggatatgttaggcttcagaaatatgagggacatctacctgggggtgtccaggagggtggttacatttgtatgtttttctgtagctcagaaaggacgagcagtgaaaccaagacaatgagagaagccacctgagaataaatacaataaaaaatagaggagagtgaatataaacactaata

SEQ ID NO: 255168 - DNA, 1072 bp, Homo sapiens
cctaagaaatcttaacatttcgccaggcaaggtggctcatcctgtaatcccagcactgggagagaatggcacacgtaatcctagcctttaggaggccaaggcgggaggattgcttgagcccaggagtttaagaccagcctgggcaacagtgagatcccatctttacaaaaaattgaaaaatcatccaggcatggtggcctgtgcctgtaatcccagctgcttgggaggctgaggtgggagaatcacttgagcccaggaggctgaggctgcagtgagccaagatcgcactactgaactccagcctgggtgacagagcaagagactctgtctcaaaaaaaaaaaaaaaaaaggaaatcttaccgtctttagttcctatcaccattactgcagatttagaagcaatctacctgaatcagaaaatagagctcaaataagttgtgtggcttggtataatctgggaaaatcagtttcaaaagttacctgcccttgggatagaactttttgtcaacaccagttttcaaaaagtaccctagttatgaggccgttgctgggtaaactttatcccattccagcttcaaccagaggaacctgtacatcctaaagtttcacataagattacacttgaagaataggtttctccattaaaagacttgaaaactactggtcttcaggctccctacctgtttaatctgtcaagacattgccagcttaaatttcggacagttacataagtgtccctgttaacttcaaatggccctgacaggaatgctaaaacgtcagacattcaaatgggccaagctttatcaggattataaaactttcaaagctcaaaaacatgccatctctatgggaaacagtatcttggatttgatgttacaaaaggaacaagaaaatggtttctgaatggcagctttcagtttacaagtagtggcaaagtaaatgcttggatgttatgaggtagttgatctaaattgtgaggctttcttaaaggcactcctttgatctcatggagtgagagactagaaatctattcaacgtattaaaactcctctcccagcaaaataaaataaac

SEQ ID NO: 255169 - DNA, 424 bp, Homo sapiens
gacttctctacgtagtcatctatggtttccccagtatgcatggctctgtatatctttagtgagaaggtcactttctctgcaaggtgtagcctacagcctttttacggaagcaaaaatacctacaacaagtgaaggacatttaaaggattgaactccaatgtgtgcaaaatcagcatgaactctacatgtgatgactaaggcattgatcatagagagtaggagataatcatgctggttgtccatggtgacacacacatacagatgtccctagctgggtaacgtactatacagacagttattacagcttataactcatctgacactatacttggcactctatagctcagatgtctacgacatattaactacgacgatacgctcacaatcatcatccatgaatctatacatccagggagtgcctgct

SEQ ID NO: 255170 - DNA, 1370 bp, Homo sapiens
cgcagagctgtcagcaagctccaaaccgcggctgccgcccggagggaagcagacggggagtcggtggcggccgccgagtccgcatgcgcaggctgcaaaggcccttttgggccggtcccgccgcgctaggttggcgagtgggactatttgatcctttccaggttcgccagcgtggtgttacgagaggaaagcgcagccgcagcgtacgaatgggaaggccaaacacggtcccggggagtctgagggaagctgcagggcgcctggaattggggtctcgagtgagccggtaaaaaccgcctcccgctgagcgtcccggaacaaatactgtctgaactgagccgtaagcaagaaacggtcaggagaagctggggcgatctgatgattagaacatttcagggactaccagagagaagtgcgtaattgctctaaggcaggtaggtaattggcctggaaacttgggaacgccccgccccccaccccgactttcagcaaaccaccgtgcccaggaaaaagagcgattgtggaagaccctgtgaagaagagaccaggaaggcactgtggcttaagagagcaaggcgttcctgaatgcagccaacatcaactggtaaacaaaaaactgtgagaacggatcctgaatcttgcgcttaccaggggaaattcaggagagatatgaacctgagcaagatgaggttgaagttactcaatgcggcattaagcctgttcacggccacttcctccggcgtcaccaacacacacactgtacaccagcagtatttttacacggggtatgtgtgttaagtactatcaggtggataattattacttcacctgtatttgctgccttgataccattagagaaactcatgaattataaatagcatagtgaatttgtgattccctgaagatatactaggtggacttttaaaaaggcttctattccaaagggaactaatatggaggaaatggtttcgagaaagaaaaaagaaaaaacggagtccttgattagttgtggggaaggcaacataatgtaatgtgaagaataaaggagtcagatccaggaaaccccataactattatgaaacatttctaggctgggcgcagtggctcacacctgtaatgctagcgctttgggaagccaagatgggaggattatttgaggccgggagtttgcgaccagcctgagcaacatagcaggatcctgtctctgcaaaaaaatttaaaactagccaggtgcggtggctcgtgcctgttgccctagctactcagggagactgaggcagaggattgcttcaacccaggagtttgaggttgcagtgagctaagatcatgtcactgcactccagactgagcaacagagtgacactttataa

SEQ ID NO: 255171 - DNA, 442 bp, Homo sapiens
actatgaggagaaataaatgttcagaaacaagtagagcacttataaacacctttttgtgccaaattaagaacaaaaaagtcagcattaagttaatgccaccatatacatccttccacatttatgtttacaaacttgtgcttttatttctaggaaacatttctaggctgggcgcagtggctcacacctgtaatgctagcgctttgggaagccaagatgggaggattatttgaggccgggagtttgcgaccagcctgagcaacatagcaggatcctgtctctgcaaaaaaatttaaaactagccaggtgcggtggctcgtgcctgttgccctagctactcagggagactgaggcagaggattgcttcaacccaggagtttgaggttgcagtgagctaagatcatgtcactgcactccagactgagcaacagagtgacactttat

SEQ ID NO: 255172 - DNA, 536 bp, Homo sapiens
cgcagagctgtcagcaagctccaaaccgcggctgccgcccggagggaagcagacggggagtcggtggcggccgccgagtccgcatgcgcaggctgcaaaggcccttttgggccggtcccgccgcgctaggttggcgagtgggactatttgatcctttccaggttcgccagcgtggtgttacgagaggaaagcgcagccgcagcgtacgaatgggaaggccaaacacggtcccggggagtctgagggaagctgcagggcgcctggaattggggtctcgagtgagccggtaaaaaccgcctcccgctgagcgtcccggaacaaatactgtctgaactgagccgtaagcaagaaacggtcaggagaagctggggcgatctgatgattagaacatttcagggactaccagagagaagtgcgtaattgctctaaggcagctttctgccatgtgaggacgctaccagaaggccctcatcagaaactcaaacctgcaagagccttgatcttggacttcccagcccccagaagtatgagaaaat

SEQ ID NO: 255173 - DNA, 722 bp, Homo sapiens
ggcgatagagtgagactccgtctggaaaaaaaagaaaaagaaaagtatccagaaacagggtggaaaagcattggtaattgtggagtaccaagtaatgagttcttactctactcttgctatttttatgtgtgttcggaattttccttactaagaaagtatgtgataccatgcgttgccacgatatggcatggcatgatgagaaggcacttcacctctgtggcgtttccccccaacccataagccctttctaatcattagaaaacattaaacaaacccaaattgagggacaattcacacagttcacacagttcatactgagacacggaccaggagaaggaaggatctgggggaacgggagactgacccagtctaaccaggacttcaaaactgccatggtcatggaagacaaggataaactgaagaagtgtcacagatcagggaaccctaaggagacatgatgactcaatgcaatgtgggatcttggattggatcctggaacagaaacagacattgatgggaaaacaggtaaaatccaaataaaacctaaagtttagttaatagtagtgtactaatgtaagttgttttgtttgggcatgtgccagttatgtgtattcactttgggggcggctggtgaagagcacataggaactctgtactacctttacaacatttgtgtaaatctaatcccaaaataaaaagttcatttacagaaaaagaagaca

SEQ ID NO: 255174 - DNA, 548 bp, Homo sapiens
catcctgggatgcagaggacaccccaaatgtccacagggccacgggtgagaaaccctgcttgagggagtaatgacttttggccaaaggatggcccagatggggccctaggtctgaggacttcggggccggccatgtgggtatgagggggcaggaagggagggggcccaggactgtggctttgtatcccctggctatggaaggtccttcacctgctcttctccccatgttttccttgaggaatcttgaccgacaatcccacgttcctactaatttcactcatccttcaagatctgcctcctccaactccaagaagccctcctgggctgccccagggttactggtgcttactctactttccatcttccaacttgagatgacattctgcctccatcaccctcccacataacatcccactgggctgcaccacggcccattccctgaactctgagtgcactctcccctctccaggcctttgcacacgcagttccccccctcctgggaccccctccctaccttcccgttatcaacttcttgtgctctcccacat

SEQ ID NO: 255175 - DNA, 527 bp, Homo sapiens
gcatgacactcaaaaggaaatgctcattagaggattttggatttcagatttttaggtttgggatgctcaacttgtaattagaaatgattgcttttgaaaatggaaattaagttaataagcctgattttttaactctaagtaatggaacgtgtataggttaggaattgaaagctgggtcctaaatctccttgtcctctcactaggtgtgagcttacagccaaatcatgtgactccctgaggctcagtgtccccaactgtcaatggatggctttacaggccagcactactctcttctcacctcttaaattgtaggagtgtaaagggatccttaaatctgcatgactgtgtcccaggcatccagtttttctgtgtgaattctagaatggttacaggcctcatctgagagccacttgtagactactttctttccaaatattaatatcaaaatgtcagattatgcagagattttctctttaattctgtacacaagcagaaatagctaaagtcaatattgtcttaaaaaaaaa

SEQ ID NO: 255176 - DNA, 392 bp, Homo sapiens
ggagctctgatggaaaatcttagtatcatgaaatgtcatcaaaattctccatttactctctgcttccccagttcagtttcttgttactagttatgtagttgctttagaaacaggatatgggctcagctcacttaagcaatgatgagctttatgattaaagctcgcagaaacggtgccaggtaaaattctgctccacagataaaacagccaacgtttagctggattagaagcagaacgtcctgctgtcaagagtaggattggcccttagcatgctgtgtagcttggcacccagaaggattcccaggacaaaaggaaaatctctaggtagatatatacagatattatctcaaacaccaaaaataacatttgtgaataaaaataatagaaaaact

SEQ ID NO: 255177 - DNA, 409 bp, Homo sapiens
tttcaagcaaggagaaggtcttccatcttccagcaagggagtgggccacctctgtaggcccagatattccggagaagctgggaggccaaggtccttaagtgtgtctaataagtttccccattccaattctcatgttcccacttttttccaatcaggaccctgattctcttgaaggagacttacacaggctgagaattaaccttctctggcgttctgccactcataagtacaggctgcacctgggcttcagttcagttggccttctggctgccagtgatgagggactttttaaaggcttccatggaggccctttgactctcacacttgggtttaaattggtggttaatagatttgatcctggcatctatacttagtgcatcaatggtgcttaccaataccctcccaattc

SEQ ID NO: 255178 - DNA, 122 bp, Homo sapiens
agtgttgggcaccctggtgctctccagcatgtggtgtttggcctaagtggcccatgtggactttgtttcaaggattttacgacaagaaacaccaaaatgaggacatctctgtggccatgttt

SEQ ID NO: 255179 - DNA, 375 bp, Homo sapiens
gagccaccacgtccaaccaagttaatattttttaaatgaagcactagtaagaggactgcgattccatccaaggtcagggattgtagcagcagacttcgctttagggagacagtgtgggaaaccagcagttttgattatctctttttagggctttccatttcactaaagaagagggctccactttttggcatggggtgaaacatggaaaaccctgactctctggattctgggcttcaagacaggacagaatgagaggaatcaggagttaccgtccaggcctttcattagtccttctcttcactgcatgactgaatcctgccctctggctttcctaagccccaggccactccagcattgtaggaagcagcagttcct

SEQ ID NO: 255180 - DNA, 2707 bp, Homo sapiens
  misc_feature (1327)..(1327): n is a, c, g, or t
ccccctctctcttacttttaacctgattatttcatatcagttatatgggacttcagaaaactttccttgttcctcaagtctaaattagccctctctggtcacttttatgccatagattttcaatatttataattacatatgtgcatatgtatatgtgtgtatttgatatcgtttaagtgttgactccaagcaattctaaataacgcaagcaccagaactgtgcctgtctgctcaaaagtgcagtcatcccttagtatctggggggattggttctagaaaccctgcaggtagcaaacactgcaaatgcctaacttctttatataagatagtgtagtatttgcatataacctatgcatatcctccctatgctttaaatcatctctacattacttataatacctgatatagctgtaaatgttatgtagatagttgctgtacagtattgttttttatttgtattatgttttagtgtcacattgttgtattttattgtgttttttttcccaaatatttttgatctgcagttggttgaatccgcagatgtggagcctgcatatatgaagggctgaccgtatactctctgctccttccagagtatctggcatgtgatgagctcgccacaaacatttagtgattcgataaggctctggttgatttacagtttctactttcctgacactctgttgctggtttgaataaaaatttcttcttgaaatgtcatcataaattgatttttattggaagatttacagaagaaaactaattttatatgttctgctcctatgaaaaatttaatattttagtgtgatatctttgccattaattactattttgagggtttgcagtattcttgatcatgtgttgtctgtgcaattcatttttagagcaaagaagagtgtgaagtttaaaaattaataaaccaggttttattttagtctttgtcttgatggcattaggagtaaggagatgtggagtaccttgtatgacgactaataccatggaaagatctggccaactaacaaatcatttatatcacgtttctggataactgtttataaacatacaatatattggactgataaaagctgataagtatatgattcaatgactaatacatgtccaagtgaaaaatttttacaaatggacaataccctattaccagtgagctatctgcccttagaaactcagatttattagaatcccaattacctgtcagaataccaaacttgtccaatatgaattcttcaatgccaaattactttgctcaactatattttcatataaagccctcttaaaatctttcttttccatgaagttgtgttttttngttttaattccatagctcttagcctacctaccaattctctcccaagtacacaagcaggagcaccatctcaaaggagtttttttctttatatatttacttgtttacttaaaaattcatttgttttgttttatttgtttatgaaatatgtatatatatataggtcttgctacatattagacactgctccaagctttttaaaagctttactcattgcttttgtcagttcatttcatccaaaagtaaaatattgtttaccatacaaagttgtcatttcaacaaattataatgttttctacaaaatgatatgtcatgacatttagcaatttagccctgcagtagattttatttactttgactcaccattagtctagaattaggattccatttttctctttctaaaaatgacaattattaatgttttcttattgaaaaaaataacatccattcatttttattaacaaataacagtataagtaagcctatagaagaaaaattagccatatcactaccctgtttagtttttctctgtctgtcttctgatcatatgtatatatctgaaaatggataatatttaagtgaagcaaaaataatattcaaaatgtacttcaattgaatccagattttatttgtatttcatttctcaatattttctcctctacaaaaacagagtgaagttgtaagaatactagacccaagtttcaaaatctcatgttaagtgagattttgcatgtcctccgtaaaatttctggagcactttataaaagtttattttcgtggaaatcaaaaaaccaggtcatgatattcttttctaagtccctaaacctgtctaacaatgcaaaggttgtctgtccttcttacatgtagactcatttgtctaagtgggccttaacatgtatgatttccatcaaggctgcttggcaaaggctttctgttagtgtgtaaggggaatatgatgaccaatataacaacctcagtatttcctctacctctcttcaactcctcaacgtgaacccaatgtttttgtggaacacaaagcctctgaatgcctgggaagtcaccagtgtgatcccagccaccacccattaatcttcttaactagcatgtccctcatcattacctcccttcccaaagccctttgcatgtgcctgttccctggcaagaaagcctcaactaaatggccaagagctaatgagaattccccccaaaatggaaaattgaatataaatgagaaagttttaaaaggtgccaagatcaggcccggtgcagtgtgtcacgcctgtaatcccagccctttgagaggccgaggtgggcggataacaaggtcaggagatcgagaccatcctggctaacacggtgaaacctgtctctactaaaaatacc

SEQ ID NO: 255181 - DNA, 296 bp, Homo sapiens
ggtcattaaaataatgtcttgaggccagagaatttatctttgaattatccttaaattttcaccgtgaagtttcttcagcacattctacacactgaaagagtcagaaaatcattttgggtctcctgaatttggtcttcaatttgtcagcaaagataaagtgatcatgttatattttttttcaaaaagagtgtcattaaatcaattcatttgaatacttgcttattatcacttcatcataggtaatgtacatacctgaagatatttttaaaattaaaaattgtgaagtaattatatgc

SEQ ID NO: 255182 - DNA, 395 bp, Homo sapiens
ccctataaacatgcttctccttagcttttagagcatcatcatcctgttagtcactcaagtcaggtccctctcctcatccaccacatccaacttatcactatgtctgtcagtttctttgtttttctttccctgctgtctttgccctagttaggtgtttgccaagtttgcctggttattaaaacctaccagaaaaaatgtattaatgataaagattcctaggctgttcccctggggttactgactcagtgattttggctagggtaggatccagaaatatgtatttttaacaagcaccttagatgatgtttatattcaggcaagtttgggatacagtgctgtatcaattaggatactttggttgtaagcaacagtaaccaactctggctaacttaagc

SEQ ID NO: 255183 - DNA, 911 bp, Homo sapiens
gcccggaagtgatgtcatcggaactgtgcaaggtcccgtccagagctggctgctgttccgctagcgagcggcatgcttagtgaagaaaagcttaaaggccgtctttgcccaaaacgctctctgtgcgcacctgcatttcccccagatttgcaggtgatgagagttctgtaaaattacacagctagtgactgatccagcggaggccgaatacagatggagtctcactctgttgccaggctggagtgcagtggtgccatctcagctcactacaacctccacctccggggctcaagcgattctcctgcctcagccttccgagtagctggaactacaggtgcctgccaccattcccagttaatttttgtatttttagtagagatgacatttcactatgttggccaggctggttttgaactcctgacctcgtgatccacctgcctcagcttcccaaagtgctgggattacaggcatgagccaccacgcctggcccaaatcctatttttcaatatttatttcctaattatgtcctactaggttaggttttattttcatttgttacatatttattgggttatttcctttatgctaggaactttattagtataaggatacagataaggtccattctctgttctcaagaatctgagtctacaggcagaagacaaaatgcagtacagaattatggaaatgtgaatggaaactgcattcagagaggggtattgcttgggaaaagccacattggcgtgccacagatgtatgccagcccggcaggcccatagtgtgattacttgagtttcaatatctgattcttttataggcttgaaattggtttatcaggtctggaagtgactggactctggagtactgagttacccaccacaaactgctaataaaatgctgtgtaaaagcca

SEQ ID NO: 255184 - DNA, 956 bp, Homo sapiens
tgggggaaaggcatgtatgctctctgaggcctgtctgtacttttatgcagatagttagaatgccactcatgggcattctcaaaaaatatggcctatgtaagttcaacataaatcgagagttccagctgaatctagatatgcttatttggtctcagatattgtgtgtctagctttccatttgtagccttcagaggaaaattttattattaatacatattatatattaaaacatataagaatctttctttttttttttagatggagtctcactctgttgccaggctggagtgcagtggtgccatctcagctcactacaacctccacctccggggctcaagcgattctcctgcctcagccttccgagtagctggaactacaggtgcctgccaccattcccagttaatttttgtatttttagtagagatgacatttcactatgttggccaggctggttttgaactcctgacctcgtgatccacctgcctcagcttcccaaagtgctgggattacaggcatgagccaccacgcctggcccaaatcctatttttcaatatttatttcctaattatgtcctactaggttaggttttattttcatttgttacatatttattgggttatttcctttatgctaggaactttattagtataaggatacagataaggtccattctctgttctcaagaatctgagtctacaggcagaagacaaaatgcagtacagaattatggaaatgtgaatggaaactgcattcagagaggggtattgcttgggaaaagccacattggcgtgccacagatgtatgccagcccggcaggcccatagtgtgattacttgagtttcaatatctgattcttttataggcttgaaattggtttatcaggtctggaagtgactggactctggagtactgagttacccaccacaaactgctaataaaatgctgtgtaaaagcca

SEQ ID NO: 255185 - DNA, 342 bp, Homo sapiens
caacagagtgaaaccctgtctctgaaaaatcaaaacaaaactaacaatttagtttttgaagagacatgaccaaatttccccgaaatctattaagactgtggggaagtatccacttgcctacatgcttagcgatgctagaaagtatccatcttttaatttttgtccatctaatgggtgaaaaatggtatcttgtgctttaaaatttattacttactagaggaactatacatctttcattacatttattattctctgtcacttgttctactgtaaatagtttatctgtctctacttgtatctatgtgtttttttccaataaaaaactggtttgtgtattactat

SEQ ID NO: 255186 - DNA, 323 bp, Homo sapiens
aaataaagccatgtgcaaacacaatatattaaaaggaggaaccttatctcaagcactggtaccggcactcatcaagacgacaatgctctaatgaagggctgaagataaagcctgctgaaaatatgcaccaaagtgcagatggtaactctggatagcagaatttcaagtaactttttttctttgcttattcatttttgacatgagttgcttatacgacaataggtaagacaaagagggatggcagaggatatgaagagtttggcctcctgtgttccctcctgtcagtcttcaatctaatacataaataaagaattgtaacctgg

SEQ ID NO: 255187 - DNA, 610 bp, Homo sapiens
ggttatgatgatggctacgggggtgaatatgatgaccagacctatgagacttatgataacagctatgcgacccaaacacaaagatactagatcatcactttgaatgccttctaccaactgagaaggtaaatgtgcacaagcccaggatgaggagattattcttaaacgggaaaggatcttaatttacactcccatctctgcacacatcccatgtgtcctaacttagtcacgagggcacatctagctgaaagggtggcacatctagctgaaagggtgtattcactattagtgcagccatttgtccaagtaaacatttatctatggaagaaatgagaagttatattttaataatctaaggtatagactgtggcagagtccattttgattattatacatcattttccattatcttccattattttacaaatatctagcatgctctgttctcccttgtttagagttctgaaagttaaaattccctcttgctgtgtatgtatcacttatgatagacaataactgtgcttctttatcatattctctcccactactgttctttttctgtctcttatcttaagcaattaaaataaaaagtgagaaacataaaaaaaaa

SEQ ID NO: 255188 - DNA, 462 bp, Homo sapiens
agcccagtggctagctgaacttagaagctgtggctgtgaaatatcaccccttgcattttcctgtggtttacacaggagaaaactcttgaatatgtaggtggatagaggtggcaagcaagtgttacctgtgttgtccatggtttatttgattctggattggagcagttcttatgtgaccattagaaatgaagtgtagaactttatagcaattgaaaaaaaggattgctttctttattaacaaataaaggtttgagtcacatggaagatatagacatagaactataaaactgtaattctctccatccatcaagtattaaaacattttagactattgtatcaaaacattttagaacccaactagaaactatttagataatgagatggctgggtcaaatggtatttctcatatgtaactaacctgcacaatgtgcacatgtaccctaaaacttaaagtataataaa

SEQ ID NO: 255189 - DNA, 711 bp, Homo sapiens
aataaggttacttgctcaaaatgacatagcagaaattgatattcaagcctacatttttttctgatcatagataggcagttaaagtgtataaatacagtggttccagagtcaaactacctgggtttaaactatatgtgtttatgcctcagttttcccagtaaatgaggttaataatgtgttttctcatagtttttataagaattaagtgaggtggtgtttgtaaggagtttagattagtacgtggtacatggtaaactccccaaggagcagatgttttgtctcaaaaaaagtattaaccttttactatataaccagtaacctataagatacagctttgagaaaagaggatataagggactcaattttatgtcctttgagtttgaatcagatgattaccaaaggaaaatgtccaataagccactaaaactagggatttggagctcatatgaacagcctgaaatagagatatagtcaattataccagataatggttgatgacatgggaagatatgggcggatccttggagagaaagcatgtggttagaagagactactgccaggacaccaaagatatgaggaagaaaatatgaatcagatgctttcaggcatctagtctgagatgactgctaagcttatttttaacaagggagataaagtacaaactcaatatgcattatgcatgttacacaacacctaggggaagaagacgtg

SEQ ID NO: 255190 - DNA, 310 bp, Homo sapiens
  misc_feature (118)..(118): n is a, c, g, or t
gctgcaagttaagaaaagccttcaaagccctgggttcttgatttcccttttactttcagcattttgccttgaatgaacgacctcaaataacttagatattcaaaaattgatgaatggnacttagcaaggtacaactcaaataaagatgatgagaactaagtcagccaccagtggcctgaaaatcatggcagcagcatgcttcctgtggaggcatctcttcgtgacattttcaaagggttcttcccatccatccactttcccaaaatcctctgcaatttaaggaatatctcccacactggcctgtggtgtt

SEQ ID NO: 255191 - DNA, 449 bp, Homo sapiens
ttatggacttgagcattggcttttgacaaggatgccagtgtctctaggccccagcatcctggggacagggccagagcataggccatggtcagtgctgccaggttttggatctctgccttgtgccggaggtgagagtgagaggcaggatgacagcagagctgggcagaccctgccacgaggggcccagcaggggctgggcggacagagctggccatgctgggagcagtgggtggaggcccttgagggccaagttcaggcaggacttaggaactctaaccccactccagtagaaaagccctcagccgccttacagaaaattcagaaagggagctgggtttggtagctcatgcctgtaattcagcactttgggaggtcaaagtgggaggatcgcttgagcctaggagttcaagaccaacctggccaatgtggtgaaaccccatctctacaaa

SEQ ID NO: 255192 - DNA, 1091 bp, Homo sapiens
cttctgtttgtgatgacatgatatatatgtagaataccctaatgcccaataaaaaagaactgttgcaataaattcaatatagttttaggatacaaaattaatgtacaaaaaccagtggcatttctgtacacaaacaactgtctgaaaaggaaattaagaaaacaatgccatttgcaacagcaacagaaaggataaaatgcttaggaataaccttaaacaaaaaggttgaaaacttgtacactgaaaactataaaacatcaataaaggaaattttagaagacacagataaatggaagacatccatatttatgaattggaataattaatattgttataatttttgtactacccaaagtagtctataaattcactgcaatccctatagaaatcccaaagacattctttacagaaatagaacaaacaatcgtaaaattcatgtgggaccacaaaagaccacaaataaaacaatcttgagcaagaaaaacaaggctggagaaatcacactttctaaatttcaaaatatatttcaaagctacaataatcaaaacagtatggaactggcaaaaaaaaacacataccagaccaatggaaaagaatggagaacccagaaataaatccatgtgtttatagtcaacttatcttcaaaagggtaccaaacacacacagtggggaaaggatagtgtcatcaatgaatgactctgggaaacctggatagtcccatgcagaaggatgaaaatggactcttaaaccatagacaaaaatcaactcatacaaaaatcagctcaaaatggatttaaaaacttaaatataaggtcctaatccataaaactactagaagagaacatagaaaaaaagcttcttggctttagtctgggcaataatattttggatatgactctgaaagccaggcaacaaaagcaaaaatagacaagtggaattcaccaaactcaaaagcttttgtacagcaaaggaaacaatcgacagagtgcataggcaacttacagaatgggaggaaatatttgcaaaccatgtatctgataagaggttaatatcccaactgtgtaagtaataagtacaactcaatagcaaaa

SEQ ID NO: 255193 - DNA, 405 bp, Homo sapiens
gcaaggtagagtggagatgcctcttcctgccacccctgcaccagacaggtgttgacggaggaatcaggagatgctgtccttgagtgaagccacgagtctctctgatgtggagttttaggcttggtgacacacacagcaggctcagcagaggaaacagagcgctttgcacacacacgtgggcctccgctctccagccaagcccaccctggctttggcagcagagccatgggcaacccagacggtgtcggggtcaagaaggtgaggccggcactaaagacatcccatcccccaagacctgccctgctgaggatcctgcagggccctaagtcacagtgtagctaattcttccttccagaaatttctgggagaacccagttatacctgcagatggaaagctttccacac

SEQ ID NO: 255194 - DNA, 255 bp, Homo sapiens
ccgggttcaagcaattctgcctcagcctcctgagtagctgggattacaggcaccagccaccacgcctggctaattttcgtatttttagtagagacggggtttcaccatgttggtcaggctggaactcctgacctcaagtgatcctctcacctcggcctcccaacgtgctcggattacaggcatgagccaccgtgcccggccagatgtccatcattttttaacactccaaagcacaatggatgttataaattaaaa

SEQ ID NO: 255195 - DNA, 721 bp, Homo sapiens
taaaaatagggttttatggtactctgtaggttcctggtgagccagggttccagggaaaagctgagaaaggatttggatggtggtgacggtgcaggctttggctgctacaggaagcggaggagaccagaatcccaaccctgaccttccttctccttaaagatgcatagacttcctggaaggctcacatggcctttctcaagtagccgatcctctttaggggagacctgccatcttccagccgcgtcatgttgcctttcagggcaagccttggccagtttgcagcgttgctgtttcttttgcagggcggggaggcaggggccggtgtcaccggtggggtcttggtgaagttcctccttcctccaggcagatggctcggtgagctgcaagaggacagactgtgtggactcctgccctcacccgatccggatccctggacagtgctgcccagactgttcagcaggtaatcccctgcctctgccccaagcccccagggcagggcatctcaggcatcgggctccttaagccctatacagccttcatctcatgtcgtcctaacaaccccaagggacaaccccattgcacagataaggaaactgaggtagaacagtttacccaagtcaggccccctctgagtgctcgaggcagatctgaagacacgcagggcttacggtgcaggtgggtggtacaggagctgcacctgtgagacaattggagaacagca

SEQ ID NO: 255196 - DNA, 978 bp, Homo sapiens
taaaaatagggttttatggtactctgtaggttcctggtgagccagggttccagggaaaagctgagaaaggatttggatggtggtgacggtgcaggctttggctgctacaggaagcggaggagaccagaatcccaaccctgaccttccttctccttaaagatgcatagacttcctggaaggctcacatggcctttctcaagtagccgatcctctttaggggagacctgccatcttccagccgcgtcatgttgcctttcagggcaagccttggccagtttgcagcgttgctgtttcttttgcagggcggggaggcaggggccggtgtcaccggtggggtcttggtgaagttcctccttcctccaggcagatggctcggtgagctgcaagaggacagactgtgtggactcctgccctcacccgatccggatccctggacagtgctgcccagactgttcagcaggctgcacctacacaggcagaatcttctataacaacgagaccttcccgtctgtgctggacccatgtctgagctgcatctgcctgctgggctcagtggcctgttcccccgtggactgccccatcacctgtacctaccctttccaccctgacggggagtgctgccccgtgtgccgagactgcaactacgagggaaggaaggtggcgaatggccaggtgttcaccttggatgatgaaccctgcacccggtgcacgtgccagctgggagaggtgagctgtgagaaggttccctgccagcgggcctgtgccgaccctgccctgcttcctggggactgctgctcttcctgtccagattccctgtctcctctggaagaaaagcaggggctctcccctcacggaaatgtggcattcagcaaagctggtcggagcctgcatggagacactgaggcccctgtcaactgtagctcctgtcctgggcccccgacagcatcaccctcgaggccggtgcttcatctcctccag

SEQ ID NO: 255197 - DNA, 712 bp, Homo sapiens
tgagtagagctgtctcttttacttggaaggatgtctgacaacagagtaacagaataaacccaaacgaaaccagcaaaccaggctttgtggagacaagtggtttgagaatatacacttgattatcccacaaacaagtggctctagggagagaacttactcactttttctttatgtatcattgcatttttgaagtaagggccttataactagatttttcagcagggcctaagacctaagacataactctaaaacgtaagacctaagagataactctgaaacatccaggggaataaattcctcttaccataggaacttttatgtgaaaagtgttgggagaaactccaccttgtccaagtcctgcaggttcaggcatccagcacatagcctttggcttggcataagaaagggagaatggaggctgggcgcggtggctcacgcctgtaatcccagcactttgggaggccgaggcgggcggatcacaaggttaggagttcgagatcatcctggctagcacagtaaaaccccgtctctactgaaaatacaaaaaaaaaaaaaattagccaggtgtggttgcggccgcctgtagtcccagctactcaggaggctgaggcaggagaatggcgtgaacccaggaggcagagcctgcagtgagccaagatgacgccactgcactccagtctgggctacagagcgagactccgtctcaaaaaaa

SEQ ID NO: 255198 - DNA, 435 bp, Homo sapiens
taaaaaccgaatccctgaagcactgtggaaatggttgctcttgttatccagggacaggaattttcctaggaataataattgagtagcagttggttagactggggcagagtaacagctcagcacctgaaactgacctgtgaacagatgagctggtgtatgtatctcaacacacatgcctgtatgtcttgttttgttttctaagtctaaaaatcaaaagaataagctaaaaaaatgatatgtttgtctattaattatcttaattttcctatagaactatgagtttttcaaaagcctcctacatagaatactcttattaatatttctgagtttttaatattgcaggttaacttttaaaagggattttgaatttctacaatagatttcattaggtgattacttagattatcttctctcatttaattatgcaaagcatct

SEQ ID NO: 255199 - DNA, 424 bp, Homo sapiens
aagaaaagtagagtttcagtttatcatggaactttttggtgattccttatgtttcatgtatagaatttaataattgtttgaataattgttacacagggcaatatcccatcaccaggaaccaatgaaactgctcacattttttggatgggggtaagaggatgcagtcttgatttgtttccttctagcttataacacagtgtgagggtagtgtgagaaagttttagaaaatgtgattaaatctcagtcatggaaatcagttctggcacagcattctgtagaaggtggtgagggtgacaagaggtgggtgcaaatctcagcatatacaaaggctttgctgagaaatacacaggggaaaggcaggtgccaagccacagcatgtattatatatacctgagtcagtagatcaaataaattcacaaaactg

SEQ ID NO: 255200 - DNA, 478 bp, Homo sapiens
gcttcaaagtcatcctggcaacacccagctggctgacaaaggaaaagagagggaatgagaagatacagtctttgtttactcttccggccagggaatgacacatccccttcacgtatgttccactggtccctcctagatatgaagaggctgggaaatacagtttagatacgtgcctagaaagagtaaatggggcccaggcacagtggctcacgcctgtaatcccagcactttgggaggccgaggcaggcggatcatgaggtcaggagtttgaaaccagcctggccaatatgttgaaatgctgtctctactaaagatacaaaaaaaattagccaggcatggtggcatgtgcctgtaatcccagctacttgggaggctgaggcaggagaatcgcttaaacccaggaggcggaggttgcagtgagccgagatcgtgccattgcactccagcctgggcgacagggtgagactccttctcaaaa

SEQ ID NO: 255201 - DNA, 305 bp, Homo sapiens
agtcttattggctatgtctacaaaaagaaaatcctgaatctgaccccgtataagcagctttaccactaccaccctggtccaagtcactgtcatttcccgcctggattattgcagttttctaattgttctacctgctccagtcctggtccattcagtgtattcctaacaagttgaagatattattaagatataggtcagatcttgtcagtcctctgctccatttctgtgctccaaactcttcaagagttgagtcttcctttctgtctgactcaaagtaacagcaagagacgttaaaacagcccatg

SEQ ID NO: 255202 - DNA, 283 bp, Homo sapiens
ttttagtagagaaggggtttcaccatgttagccagtctggtctcgaactcctgacctaaagtgatccacctgcctcggcctcccaaagtgctgggattataggcatgagtcactgtgcccggcccaaaatatgtgattcttaagtgtacattgtagtggatttgatacaggtacttgtactatactaacaaaatagatttatttaaattgactctttttgtcccatttacaactgcattaatagccataagctcatggttttgtagtctgttatatattttcc

SEQ ID NO: 255203 - DNA, 225 bp, Homo sapiens
gactggtggaaccagaccgttgctgtcccagggccatgctgacggtctgaaattggactcttcagaggagaggcctgtgggaggcctgcccgatgctgaccaaggcagggcagaagggaagcctcatgggagaccatcctatggcgggcattctttcctgggcaccccagtgaataatctcccgctctggccccctcctcgtccagcagtgcccactccccattc

SEQ ID NO: 255204 - DNA, 319 bp, Homo sapiens
ccagtaagtttttcaaaagaactatttggcagccctgaaacagattacaacgctggtacaaaccttgactgactgcagggttacagatgtcagaatcgtgtgtcttcagaaatatgcacaacaacaactggattccctgtcataatgcctggccctaccaacattgcaaaatgctggccggcagagaggacagaaaccattcggtcacagcctttttcctgagtaatagtggggtcctgcaagctacaactcagttgtcaataggactggaaattccttgactaaactcatataaactggacctttccatgcatgtctc

SEQ ID NO: 255205 - DNA, 622 bp, Homo sapiens
ctgtaatcccactactcaggaggcagaggcaagagaatctcttgaactccagaggtggaggttgcagtgagctgaaattgcgccactgcactccaacctgggcaacagagggagactgtcaaaaaagaaattgggaagtcaaggtgggaggatcacttgagcccaggagctccagaccagtatgggtaaccccatctctacaaaaaataaaaataaataaataaataaaaaaacgtagccgggtgtgattgtacatgcctgtggtcccagctactcaggaggctgaggtgggagatcactttagcccaggaggtcatggctacagtaagccatgatcatgctattgcactcaagtctgggcaacagagtgagaccctgtctcaaaataaacaaataaataaataaatcccaaaatgtttcattgtggctgtgaccttatgacctacacagaaaaactctaaactagatttaatttctcaagttttatgtttaatcagtgcttgaatcaacttcaagaaatgtgaattttcaaagttgttttatgaccttatttttcataaagacattaagtcatcagctcagtgtttcacttttttaaaaaacacattaagtcaaatatgtt

SEQ ID NO: 255206 - DNA, 538 bp, Homo sapiens
ggttctatggagcaggtttctgacagctattcattcattagggaagtgtttaacagtggcagttccagtaccaaagttggaagccaccaacatagaccttcagagatcagttttccctgcttgaatgtccttgagttcagagatagagatgcaactggatctgaccttgtgaaatgtctctttccccttttcctttcctaaagctttttctctgcctcatctcaccacactgatggtctccttcattaattcactgagtgccaagagtgtgcagtgccttgtgctgccaccaccaacttcacacttctcatctgattgaagagcatgggctgctctgacatgaatcattgcccggagactagaaaaggccttcccctgacattggctggccatttggagaaattgaaacactctgttgtttggcttcttactgttctccttcctacagaagacctaatggggtttgctggccttggctgcattctgaatttgttctctttttttccttttggaaacatcttatgtcatgttcttagaa

SEQ ID NO: 255207 - DNA, 455 bp, Homo sapiens
ccgtctacactataaagcagatctgaccgtatgcacgcttgccaccgtccggcgtttaacatgagatgcaactggatctgaccttgtgaaatgtctctttccccttttcctttcctaaagctttttctctgcctcatctcaccacactgatggtctccttcattaattcactgagtgccaagagtgtgcagtgccttgtgctgccaccaccaacttcacacttctcatctgattgaagagcatgggctgctctgacatgaatcattgcccggagactagaaaaggccttcccctgacattggctggccatttggagaaattgaaacactctgttgtttggcttcttactgttctccttcctacagaagacctaatggggtttgctggccttggctgcattctgaatttgttctctttttttccttttggaaacatcttatgtcatgttcttagaa

SEQ ID NO: 255208 - DNA, 328 bp, Homo sapiens
tagaacatcaataccaaaacctcataaaaagagcataaaacaaaagttaccgatcaaccacttgtgaattatagatgcaaaaactcctaaataaaattcaagtgatagactctaataccacattaagaaaataatactatgactaagtgggatttataccagcaatgcaaataaatatagttcaatattgaactatggcggccgggcgcagtggctcacacctgtagtcccagcacttcaggggactgaggcaggaggatcacttggggccaggagtttgagatcagcctgggcaacatggtaagatcccatctctactaaaaacacc

SEQ ID NO: 255209 - DNA, 883 bp, Homo sapiens
caaagagctattcaattaattgtacaacaggggtgttttcaccacacgtttaaagtttagggctggtctttttttataaccccccccaaataaactagaaatttggtccccgcatgaaaaaatctctttaaagtcctttagctccgaatgtatccttccaatggtttttgtttcgttgacttcaaaaaaaaacctggaccctcgtatatgtgctcacccttctctgctcagctctgtgcctgggaggctgacctctacaaactgcatcaccaggcttccgccctctggcttccagatggatttggccaatgggcagcaccagtgggaaaggagaggacaggaggagagacaggctgaggcctccctcctcctgtgtccctgacatacagtgacagtgctgccctgcagctcaggatggatgcagtcaaggacgacagcgcatgtccaaaaaagctgtctgctgaacatttgcccagcagattttagaaagaaaggaaacatcttagtgattttcttgcctccagaagattccctgatccaatctttccttggcacaaacttttagttattgtgtttacatatacattttatatatgtgtggtcattattgtatctgttttatttggggactttatcttgatgtgtgttatacctaatacactgcaatataaattatgtaattatgtgctttttttttttgagatggagtctcgttctgtcaccattgcacaccagcctgggcaacaagagtgaaactccatctcaaaaaacaaaacaaaaactgtttcgtgaacatgggacactcttgtaactccatcctactcattcaaatacaggccatcacccatgaaaataaaaagaaaataaaaggtgaatagcactg

SEQ ID NO: 255210 - DNA, 594 bp, Homo sapiens
atatggaaaagaggtcaggaagagatttcactctcacacacacacacacgctatcacacgaagggctagccaccaggagcaaacagaggcaaggaacacattccttcctacaaaattccagccctgtcagtaccttgattgcagcccaatgaaactgatttcagaccctccagaaccaggagagaattcattccgtcatcttaagccacccagtgtgtgataatttgatatagccttgggaaacaaatacacctgacctccaaaaccctcctcaccctgacccccaaaaccctcctgccttctccgtgtctaagcacgtcagatttatgggggatggaataatctagaataatctgaaataattttaaatgaaaaaagaaatataagagaaggtccttatgcaggccttttgcagaggaacttttgctgcatacaagggttactggacttagaggtgtgagacagcattgtagccccagctagtaaggtaggttgccttgagtaggtggaactgaccttgatcagagaagagagtggaggtgtattctggaggaaaactacatgaacaaagggatggaagtgaggagagggatc

SEQ ID NO: 255211 - DNA, 740 bp, Homo sapiens
aaagagggaagtctttggacactggaggggactgaattggagaaggaaaggaaggatgaaatgaatctcaggtacacagatgcctgcaggaagttgttcagcacaatgaatcaccaaatattttagagataaaatttcaacaaaaatttgagaaatatattttgtgcttagtactgtgccaatggttgtgaaacatataaaagaaatataagagcctggaggcagtggctcacgcctgtaatcccaacactttgggaggctgaggtgggcagatcacttgaggtcgggagttggagaccagcctggctaacatgatgaaaccctgtctttactaaaaatacaaaattatctgggcatggtggtgcatgcctgtaatcccagctactcaggaagctgaggcaagagaatcgcttgaacccaggaggcggaggttgcagtgagctgggatcacaccattgcactccagcctgggtgaccaagtgagactctgtctccaaaaaaaaaaaaaaaaaaaatgaaaaaagaaatataagagaaggtccttatgcaggccttttgcagaggaacttttgctgcatacaagggttactggacttagaggtgtgagacagcattgtagccccagctagtaaggtaggttgccttgagtaggtggaactgaccttgatcagagaagagagtggaggtgtattctggaggaaaactacatgaacaaagggatggaagtgaggagagggatc

SEQ ID NO: 255212 - DNA, 937 bp, Homo sapiens
atttctgtcaagggtaccgtataagtattaacagctgactatatcccagtgccaatgctcacctaggtgtccttggcatagtgcagctcaattaaacgtttatttaatattttattttatggagacagggtcgctctgtcgcccaggctggagagcagtggcactatcatacctcacttcagcctcagtgatcctcccgcctcagcctcactagtagctggtattacaggcatgagccacgcacccagactcaattcaacatttgtaagagtattccttgttcggtctccaagtgcttaacttttgagagccgtgaaaagccctcttctcccaagtttaatcacatctcctataaaatctcatccatctgctgacacttccaatagttttttacttttttcttttactgacctaatcctgaataaccttaaattgctgctttccttacttctccttaacttccccagacctctctgcaaacttctaattcccattcggctgaaacactgtaatacttctagtcccattattacaaattctaacaagtctccaaaagctgaaactgacttctccaaggtgaccaggctttcttagcgtttccaactctttccccctagatcctagaaaataactttaccctgatactcttctagttccttccctcaccatccttcttttttcacgtttttacctacgtttccaattcacctcatccagctctacctccgtattacttcttctcattccgaactatctcaagtttcctaaaagcacctactgttctagcacatactccaaaattcccgcactgcctttttctcctttctctactcttgggacaagcaatcacaattccttcgacacgcaactagctccatcttcccttctaggaaaccttctctagcctacccaagcactgttaatcactcccctctag

SEQ ID NO: 255213 - DNA, 458 bp, Homo sapiens
tcaaaacattaacaatacactgaactcttgaaattcttcaggaggctctactcagagtttgcagtacgaattttaatactgaagtcaaacatttctgaccccagctattttaagtgacaaaataatgtacaaaagacaatcaactactaacattattttacacacacagcagggttaacaagaatacagctatctgttgttattggtaggggactggttccaggacctccttcagataccgaattacataatacttaagtcacttacataaaatgtaatagtatttgcatataactaagcacattctcccaaatactttaaactatccctaaattacttgtaatacctaatataatgtaaatgctatgtaaattgtcatactgtattgttttaggaataatgacaagaaaaacgtccgtacatctttggttcagacgcaaccatgcctcttttttctc

SEQ ID NO: 255214 - DNA, 564 bp, Homo sapiens
gattgaaattgattttcagaggactttatcactgatttgtgaagcaaatggtacagatgaaataggcttttcattatgaaattccatgatagaatcattgtgctgtcagatttttgagtaagaatttgtacctttaacctatactcctagaagagcctcaggactgcctggaggaagagccttgtttgcaataaagcagcttgcttaagaactgtcagcttttcccagatgagtctgaagctctgtcactaagctatcatctggctcttgtttctcccctgctgggaaatgaagcattgtaccaccagggatccatttaagagagagtagtacatgttgttcttataccaataatgttctcactgaggcacaatttctaaaaagcttaatgtctctttgtcattctgtaaatattagaaaatatttggtgagtttctgtagggctgtgagagagagagatgaacattttggtataaattgagtttaatttttttgtttttcatttgctagaaagacagatggtctttaaaaagatgttatactaaataaatgttgtgttgtacg

SEQ ID NO: 255215 - DNA, 510 bp, Homo sapiens
aactcccggtctcaagggatcctcctgttttggcctctcaaagtgctgagattacacggatgagccactatacccagaacatacctatttatccatttaaaaaaatccacattatgtttggccaggttttacagagcacttttgatcacattacacaataggaagggcaagtaatataccaatttttcacttgtaaaaatggagactctgtgttttttttcagcaacacttacataaacacagtagaaatgtaatacttggttgtggaatgcctgaacaaatgaaaaataaatacatatgtctgtaatttttttaatttatttttaattgacaaataaaaattatacatatttatagtgtatgacatgatgttttgatacatcttttttttttttttttttttttttgagacaggatctggctctgtcacccagtctggagtgcagtggtgcaacctcggctcactacaacctttgcctactgagcttaagccatcctcctacctcagtc

SEQ ID NO: 255216 - DNA, 480 bp, Homo sapiens
ctgaaagactgaatgagaaatgcatctgatctaatgctgagacagtcgaatttgggaatttgaaatgcgatttaccagagagcaacttgggcttagcacatggctgaggaagagaggaagaggaaggttggactttccatttcagagatggaagaggtcaaggaaaatctgcatgctcaaacaatctcctgcctcaacttcccaagtggctgcgactacagttcattaaggagcacgcagtcacagctagcttcctgtttgaagaaaaagaaaacagtcccttgttcaaatatcataattcaccaaaatctcaccatgtttttcatttttttctattataaatttacgttaattgcatgctgcttaaatgtggttttacatatttactctcagcagctcacttttagagctacatatattttcccacaaatgagtctttcaaatcttcaataaatgctctttcaatatttgaaaaggtgg

SEQ ID NO: 255217 - DNA, 433 bp, Homo sapiens
ctgaaagactgaatgagaaatgcatctgatctaatgctgagacagtcgaatttgggaatttgaaatgcgatttaccagagagcaacttgggcttagcacatggctgaggaagagaggaagaggaaggttggactttccatttcagagatggaagaggtcaaggaaaatctgcatttcattaaggagcacgcagtcacagctagcttcctgtttgaagaaaaagaaaacagtcccttgttcaaatatcataattcaccaaaatctcaccatgtttttcatttttttctattataaatttacgttaattgcatgctgcttaaatgtggttttacatatttactctcagcagctcacttttagagctacatatattttcccacaaatgagtctttcaaatcttcaataaatgctctttcaatatttgaaaaggtgg

SEQ ID NO: 255218 - DNA, 361 bp, Homo sapiens
ttggaagtcttatacttgtaggaatgaaaaatggtatggctcctttgaaaatctaacagtttcttaaaggttaaacataacacaaatcagatagacagtcattcccttcctaggaatttacacactgtgtctgcacaatgatctgtatgtgtgtttccagaccaacctgaggggcgggctgctatttctcgtggctcagtaacaagacacagatgaactggggaggaagagagttttgacttctgcaactggttacagggaaacggcctggaaattatcaccagaccaactcaaaattggaaagttttcctgggctaatgtaccttctaagctatatgtgtatgtggaagtgtgcattcat

SEQ ID NO: 255219 - DNA, 430 bp, Homo sapiens
ttttttttttttcctttttctggagaacggggtctcgctatattgcccaggcaggtctcgaactcctgggctcaagcacgtcttgaaagtgttggccagttgtcaaattttcatgaatttcagagaagtgggtaataggtggtttctctcacggtatttaaagcgaagtagtaaagaggaaaaagactgaaaaggtaacctgggtcaactcattttttagggcgcacagaagtgtggtagcggagcctggacatcaggtggcctgaagcccaaaccaccagctcccccagcacaggagagtgcaaactgtagctcagtcttggccatctggggtcttctgcaaatgaactgcccatagtctggccaataattcacactgttgtattgctgtctttcattctctcttaagtagagcgttctgaacatatct

SEQ ID NO: 255220 - DNA, 693 bp, Homo sapiens
gccggcagtctcacataaactccaggctgaaatcacaacatccattagagtgctccacagctcagagcaagcaagcaagtggttgtcagtgcagctagtaaatcacctgatcctattacaaaatcaattactgcagtgcatttccattgctacacaatctgatgatgacaaaatgatattggatatctactgcaaggtcaagaaaactgctaagaacatctttaattggtcttttatttttaatcatttggtcttagtcataatgcatccattttcattgcatatttttatttgaaataaatctatgtagttacctttggttgcctgggacattcgatggataatctctgcaactggtctgatgtatggctacaagagaacaaatcggagcagcaggtcgaacggctcaacctcttcattaaagaagaaataatgctgcagccacagccacacattgacttgctcattagatgagaatttgacttaaaaaatcagaactggtgatgtcacatatatactcaaaattgtcaaactgcctcattctgcagctctctggctgaaagaaacactactaaaaaagaataaaacaacagctttgctacagaagatgccagccacaaactcatcgccaagaaaaactggatattaaaacagaagtctcccagctactctttagaaagaaggtaaggtgct

SEQ ID NO: 255221 - DNA, 716 bp, Homo sapiens
acccctagtgaggaggaaacattttacttacgtgtgacatttactcagaaacctgactataagtatggtgaatgtatggtttatggcataaacagcaacatgtttgtgaagtaaagatggcgttcttcataacaatggcggttcaaccagcatgaactagaactgtcctgggaaaactagaaaacacaactgaggaccgagaaacaaaaggtctcatgtataccccaaaatggtattaaaaagagacaaaatactaaagtataaatagcttattataagacacaattttgagcatgctttctttactttagatacaatttgcaaaatcttccctgtagctttatgtcagtccagggccgctgattatgaaattgcaaatttgaagaatgaggtggcttccttaataagtagcagttgataaccgctaaggaagcatgaacaacaaaagtggccaaatcaaaaggcacaagaagtgttcaaagtaaaccaaaatttaggagctacagttttatttcataagtgaaaatttagtaagcctcaaaaacatcacatagagtgtctgtctgggctgcaagaccctgaagtggcaactccatttccaaactttgcatcaaaatattccaatctgaatgggcttttattttctgagaggatgagttaaatcaatttacatgtgttgattgagttcttatcacttgtttaagaagtgtgtcact

SEQ ID NO: 255222 - DNA, 1180 bp, Homo sapiens
caaataatgttgctgtgaacattcatgtacaattttttctgtgaacatacaattcaaattattcaaatggttttctcttctcttgggtgtattcctgggagtagaattcctggatcatttggtagttctatgattaacattttcaggacataccaaactgttcttaatgtggctataccattttacagtcctaccagcaatgtgttagcgttccagtttctccttatgctagccaacacttgttattgtttttcttttttattttagccatcctagtggttataagatggtatctcattgtgatttttatttccctaaaggctaatggggttttcaggtgtttattaggcatttgtatctcttctttggagaaatgtctatttagatcctctgcctatttttaatagacttgtgtttttattgttgagttgtcagagtcctttatataaaggagactagacttttatcagaaatatgatttgcaaatacattatattctgtagggatttcactttctttatagtgtcctttgaagcacaaaggcttttaattttggtgaagttcaggttgtctattttttatttggttcttgtgctttaggtgttatatctaagaaacttgcctaatccagggtgacaaagatttacacctatgttttctcccaatagttttggtagtttcagctcttacattttagtatattgttcattttgagttggtttttatacagatgctcttgatttacaatggtattacagtttctaatgaatatatattgcatttgcactatcataatgttgaaaaatcttaaattgaaccattgtaagttaggaccatctttatatggtataagaaaaggcccaactttattcttttgcatgtggttttccagttgtcccagaaccatttactataagactgttctttccacattggattgtcttggcccccatgttgaaaaccaggtgatcgtgaacataaagttttatttctgaattctcagttctattacactgatgcacatgtctttttttaagtcaataccacactgtcttttgtagtaagctttgaaattagaaagtatgggtccttcacctatattcttctttaagattgttttgactatttgagtcctttacatttccacataaattttaagatcagcttgtgagtttctgcc

SEQ ID NO: 255223 - DNA, 507 bp, Homo sapiens
agcaaggaagattatagagagtaatgggttgatatgagggaatagagtattcaaggaatgcctcataaattagcaagaacataatttaagtatgggaacccactgtgccagcctttggggcaaaatcaaatgcaagtcaacaaggtgagttttttgagtttttcttagagcaatatgacattggttaacatttaaattacttccaattttaacaaatttggaagcaccatttttgttaaaatacttaataaatttttgcatgcgttcttacatttgttctcctcagttttcaaacctaccttgtccttgtatgtctttatgacaataatagtagaaagatatgagagtctatattaaaggatgttaatctagtgccatcttactccagagacataattcatatttatttagaggaaaaataaaacttaggaaaaaagaaaagaagtcttcaaagaatgttagaatatagaatatttaatttagaaatgaatttttatagctaagaca

SEQ ID NO: 255224 - DNA, 286 bp, Homo sapiens
ttgccaatgttgtaaatagtaatctccatctctccatcagatagagaagaaaatgggattaaaatgtagtaagagaaatttagatggtttataacagtttgaaaggaatcatgagttaaatttcatagtgtagaggcaggaggctaagagaggataaagatataccgctaatgtttataaattctgtacattatccactccttacctctcaaaagcctctttgctaaaagtaggtgtcattatgtatgcaaataagggaagctatgccatgaaatgtaatccttag

SEQ ID NO: 255225 - DNA, 709 bp, Homo sapiens
gcacattttcactggcatatggcataaactgattttttttaactaatggaagcctattcagggatcaattattacctcatggaaatatttgtcaaccattccttactttcctacttagaagcagggggaaagtgtgtttttaactactaggtaatttaatcattttttcccctctcacctcctatatatctactggggccaagtcagctgaaaaaataaaatcatataagcaaactgccacttcatcatcttgtctcagaaactcctgctggcagcatacattttatataccccaaatggggtgttctgaaacagacaggcgaattccagcttcccctaatttactgccctcctttccatagcatcagattcataaaacattgcctgggtggctggctggctgtctcactgtcttgaggctgaagcaaggcacaggggaccaggaaggagacattagttgccaagtctctgctgacaagaatacttgcctccgcccttttagagcatttaacataagcaaaagaaacaggggaaaaagacttggcttgccagcaaaccattacacaaatctaaagatgtggtattaagttttgttcctgtaagtgttctttccatgactagccctattaattggtgcttcagcttcaaaactatttcagtttttatgtcacagaagagacttgagaatccaattagctacgtttattag

SEQ ID NO: 255226 - DNA, 285 bp, Homo sapiens
acaaacccatcttgaaggctggccgggcgtaccacaaatataaggcaaaaaggaactgctggccacaattacggggtgtggccataaatcctgtggagcatccttttggaggtggcaaccaccagcacatcggcaagccctccaccatccgcagagatgcccctgctggccgcaaagtgggtctcattgctgcccgccggactggacgtctccggggaaccaagactgtgcaggagaaagagaactagtgctgagggcctcaataaagtttgtgtttatgccacc

SEQ ID NO: 255227 - DNA, 353 bp, Homo sapiens
agtacagatgataatttaactattttcactattataatttattagcataaaagggctttgaggccaggcacagtggctcacgcctataatcccaacactttggatggctgaggcgggtggatcactagaggccaggggttcaaggccagcctggccaacattgcaggaccctatctctactaaaaatacaaaaattagccaggcatggtggtgcatgcctgtaatcccagctgctcagaaggctgaggcaggagaatcccttgaacctgggaggcggaggttgcagtgagccgagttcgcaccactacactccgcctgggcaacagaacaggactctgtctcagaaaaaaaaa

SEQ ID NO: 255228 - DNA, 383 bp, Homo sapiens
tcaatgcaacaagaaaagctaactatcctaaatgtatatgcacccaatacaggagccctcagattcataaagcaatttctcagataaatcttaattgagatacatgctacaaaatgcatgaccagtacattgatttagggacttcagttagtcatagttatcaatattgtcctattaattgtgacaaaatacaccctgccaatgtaaaatattcttttaataggggaaaatcagaggtaggtatatgaaaataccctgtaccatcttcacaattttctgtaaacctaaaactgttttaaaattaagcttataacatatttcaaaaggaagagaactttaaaaacctagtattcttaaagagattaaggaagatattttataat

SEQ ID NO: 255229 - DNA, 556 bp, Homo sapiens
gatgataacataaatgaaaagctcagttgaaggattgaaagataaaagtaagaaaatatcccagaaataagagcaaaaagacagcaatgtaaaataggggagaagataagagaattagagaaccagcttaggagttctagaaagagaaaatgtagacaacaaaaggtaagaaatcatcaaagactggagtaggggaggtcatgctatctgtttctttttctattttttattttgagttacattttttttactgtgaaacaagcatatgtacatgagaatgaacaaaacaaatatgcagtcatgtattgcttaacaacagagataggttctgagaaatgcatcattaggcgatgtcatcattgtgcagacatcatagagtgaacttacacaaatctgaatggtatgtcctacagtacacctggaccatatggtatagctgttgcttccaggccacaaacttacagcatgttactgtactgaacactgcaggcacctctaatacatcggtaagtatttatgtatctaaacatagaaaaggtacaataaaaatacaata

SEQ ID NO: 255230 - DNA, 494 bp, Homo sapiens
gattgagccataattctgttgagttgtacatggagaatctagagatttagtattttaaaatggagaaaattgaggtaagtgattgcacaaggtcaaatgtgtagctgatgaagaagtcaggaatagaagccagctatctcttaaagattattttaatatgtaataacatgtttttaaaaagtacaaaaaggtatactgtgaaaggtaagttttttccctaccccatctctcagttcttccattaccttccccagaggcaagaagttaccaatttcttggactttcaagagctatttcatgtatgtgcaatcaaggagatgtatacattgtccttcacacagatggtagcatattatgcatacctttctgcaccttgcttttttttacttaacaatgtctgaaaattgtagagcccgggatttttttgttccttggtccatgaactttccattttgctatactgcctattattattaaacaactgttttttgtta

SEQ ID NO: 255231 - DNA, 937 bp, Homo sapiens
agacaactgagaggaaggaggtaccacgggcactctctcgcgagagggccgcagagccgcctttgacgggggcgtgtacctggagagcaacggtaaggacggagccgacggctccggcgtcgggtcggttccggcatcgacgtatcgtttggtcgccccagagaggagacaggtttcttcagcttgccgctgaggatgtggcatcggctgcgctcaccgccgccgcctctgtgaactgcgggagttgggacagcggccagggctagatgggtgggacgcgagtcctcgccgaaagcttgccctgtgcggggcgcacttggaggcgagctctgggccgtggcgagttttgcagcctaaggtcttggcaggcgcattgctgtgggctgccggagagcaggctggagttcgagaccgcccaccggagagcaggcgagagttcgaggcctaggtacagcgcatttcgctaggcatccccaagaatatccgcgtgatccttgtggccagagtttgttgagctaatatccccagcccaaacagtagagcacatcacatgtcggccacctgggagcgttgaacctggtagttactaggcgcccctggtggaaataaaactcattatgccctagttatgtcttagtgcctgggtgacgatgatgtagcggttaaagattaactgagcgcacttagaggttgtctttgtctacctaaggaaaatatcaatagattaaacccccaaccttaaagaatctccgtgaatttttctgaggaaacgtgcaatattgtcatacaaaaggccccaaatatgcaaacattgctttttgttaaaagtttgttttgttttgcagtgacatctgtttgagcagatgaatatgccattgggaaagtcaaggactgtcgcagaggaggacatggcagaccttaactaaagtgaggggga

SEQ ID NO: 255232 - DNA, 359 bp, Homo sapiens
ctttgagacagagttttgctcttgttgcccaggctggagtgaaactctgccaaaaaaaaaagtagaagatcgttcttactttgggaagctagtgcctataacagattgacccacaatgatggtactataacctaaaaaggtaaacaacaggactgtggtggcaggggaagaggagcatcagagatcctacatgagttcaactagatggaggactgcggagagaggagagagaatggaaaaagagggtgccaaaagccacagcctgtagcctgtgcagggaccagggacaggggtggctcagaaggaactgctgcttcctacaatgctggagtggcctggggcttaggaaagccagaggg

SEQ ID NO: 255233 - DNA, 515 bp, Homo sapiens
agttaaaaaaaaaaaaaaagaaacttttgcctattagtgaaattgtgctcagataaaagaaagtaatagtctcactgtgctctctgctgatcagatagtactggggcaccaaacactttatttcttctttcaaggtatgtgtaaactgtgataaaacaagataaaactatgagggcagttagggaactcaaaacctgatctcattggtcttaattgatggaccagggcatttagcttgggaaaaagaaaattaggagggaagtaataactgttttcaactatctgaagggctgggatgagaaagaaggactgctcttattctgtatttactcctacagtcagaattgggatgaatgggcaaaaaactaaaagaagcctgattcattaggcggcagaattttctaaatattagagctaatgatgttcaatagaatgggctcccattatcggacggctcaagtggaggtgctggccacctgtcagggatacttagggcagtaggatggccccttcca

SEQ ID NO: 255234 - DNA, 240 bp, Homo sapiens
ttcctgtcccagcatggtgtctgttatcatgggacagcaaatgtcacatatatcaatgttcaaaggggtcttttgatgatttatttatttattttccagtctctcagattcgccaaccccaggcatatgagaaactaagtcttatgtcatattgggaaatagtaaatgacactaacctattattagtgggtttccctctgttgtgatattgaagtaaaacttctttcttgaagggcagat

SEQ ID NO: 255235 - DNA, 1103 bp, Homo sapiens
gaggatcccacacgtgatttgaacttccatctagtgccaaaggagggaacacggacattatcagcttggccagatgggcagaataagaagagggagtgcagaggtataaatggtggtataagacaaaaatcacaaaatggaaactgactgtagtacaacactgaatatttactcttgcaacttctgatttctggccaggcatggccagaaattacaggctcatgcctgtaatcccagcactttgggagcccgaggcaggtggatcaccttaggtcaggagctcaagacgagcctggccaacatggtgaaaccccatctctactaaaaatacaaaaattagccaggtgtggtggcgcactcctgtagtcctagctaccagggaggctgaggcaggagaatcacttgaacccgggagacggaggttgcagtgagctgagatctcaccactgcactccagcctgggcaatagagtgagactctcaaaaaaacaaaagaaatttctaacttctttgttagggaagacctccgctttcttcataatagtagataatactcttcctttctgctgaacccatagggcccattacacaacgtcattcttgaaaatatttgtgaaatgctgtttaaattgcctaaaatatttttacagtagttcaatgcaaatgaatttgtggaaaagtttattacataatatgatcaagcaattttagccaaagggcatttttccaaaggctgtgttatattcatgtcttgttcagtttatggtattgtgtaacatattctccatagcttcttttctttttttttttctttttctttttagacgtggggtctcgctatgttggccaggttggtcttgaactcttggcctcaagcattcctcctgcctcagcttcccaaagtgctgggattacagccatgagccaatagtagtaaaatgactttttgtttttgtatatgatttttactttaaggattttttccttccatacattttaatccaaattatatgtttactgcatttcttctctgtgttactccagtgaacacttagaaaatacataaatgagggtgttgtttagaaataaaattttgtgacatga

SEQ ID NO: 255236 - DNA, 418 bp, Homo sapiens
ggcgggcggatcacaaggtcaggagattgagaccatcctggctaacacggtgaaaccccatctctactaaaaaatataaaaaattagccgggcatggtggcaggcacctgtagtcccagctactcgggaggctgaggcaggagaatggcgtgaacccgggacacagagcttgcagtgagctgagatcgcgcccctgcactccagcctgggcgacagagcgagactctgtctcaaaaaaaaaaaaaaagaaaaggaaaaatatgtacatttttaatagtggtagtaagaattttctgtaactacttacgggacatcttcactgaggggtctccagagctcctaaaactcagcactcccccagtgattcttacattttcctgccagacttgctcttcttcccacaatccccaccttaatg

SEQ ID NO: 255237 - DNA, 151 bp, Homo sapiens
aaaaagaagattgagagaaaaggagagagagagaaaatggggtaaggatgtcaaagtttcacatttgttggtttctagcaaaggggcagtataaagcaatttgtagttgtcacatttgaacacataaaattaaaattttttcaaaaagcaa

SEQ ID NO: 255238 - DNA, 188 bp, Homo sapiens
gtttttgtatcttacaatattgctaagtgcacttattctgttagttctggcagtttctttaggatttttaaatgtacacagtgattttatatgtgacaaaaacagccttagggccaggcatggtggttgacacctgtaatcccagcactttagaaagctgaggcaggaagatcacttgagctcagggt

SEQ ID NO: 255239 - DNA, 418 bp, Homo sapiens
ctgcttctcgggattgttgtgagttttacaggaaatcagatttgtaatagcgtagagctttgcatctagtggatgctcagtacatgcgtattatgaggggaacaatagtggtttttctttttggtaaagaattgctcattaaattaatttacatggtaaattaggggacccacccctgatacctcgtgggttagcctctgaagctcagtcaatgtgtaccacagaaatcaccccagtagcaccaagaacctccatgaaatgtcagatactggggaccccagagacttttccagacattacccccaaatcagaagactactttgattccaggtgtgtgtgtgttgctattgttgttgggctgagaaagtggattgggagtgttgctagctcaaataaatgtgcttcttataagagcttt

SEQ ID NO: 255240 - DNA, 377 bp, Homo sapiens
tctatataaggaatttagtctcaaataagcattcctcactttactggcctagactgaacaaggcaatggctagtggcaatctagtccacaattaatgaagatcatatttttgccgactccttggaccctgggttcatgaagatacgaagaattgaggcaacaacaaaaaaatacattaacaaaaagaaagcaaacattaaagcacaaaagcaccttcatcaatgttctcaccacctgtggttcccaacataaagaattttccatctctgttagctataacactctagagctaggaaagtaactagtactttacaaatatttttcctttcaaatgctttattacagttagaggaaaaaagaacgtaatgaacaaaaaa

SEQ ID NO: 255241 - DNA, 954 bp, Homo sapiens
gaaaataaaaatccaagtgcctatctcttgcatttccagttggtagtttcctatcatcgggtttgcctgttcacacaagtctttgcggcacaacggagtctgacttcccccaaattaatgcagttagtttattcctcgttctgatgattgccatatatagagaaagatctaattatttttatgtggcactattcctcatttatttcttggggactatgagtgatttagttaactccaccaagggaagtgtaagatgagcctcctcagggtggctgaattctattcgagagcatcacagggaggtggggaatagttgacgtgtgctgagataaactcttttacaagtatgacactgttgctttatttttttgccccagtctgcagggtgaaaaggacttttcatttcactgaggtgaaaagtgggtctgtgagtagagcgactttctttaaaaaaaaaaaaaaaaatcagaaaccaattacttgatatgcagagctgcaagcctcgttcctttaacaaaatcagtgcagtgtgcactgccgttaacctgaggaaagcagctgacatctcttgattacggctagaggtggaaggacccaaacttgcagcctccccctccccctcgagagagtgttagtccagtcctttagagaggttcggtttggctctctgtcatcaccgggacgctggcagggagtgtgtgtcatggttacaatagagtgtgctaacatataacaaccatgaaagcccagcgggaaaggctacagattccggggctgaccttggatctcactcccaggagcctgagtccaaccccatccagcccaggcagtccttgtagtcctctcttggcctttcacttttggagccctgtgtgtccaaatgctgggagaacatcaccccttggatgaattgccaccacattaaataaaacatatccaaagctcaaaaaaaaa

SEQ ID NO: 255242 - DNA, 293 bp, Homo sapiens
ctgcatgaatttggctcgaggaagagggctccagaaggagctgagtctccccagaagaggaagtttgatagattcccagaagtggaattgcttggtcaaacgtctcactcccaggagcctgagtccaaccccatccagcccaggcagtccttgtagtcctctcttggcctttcacttttggagggaatgatctgcactgaattctccctgtgtgtccaaatgctgggagaacatcaccccttggatgaattgccaccacattaaataaaacatatccaaagctcaaaaaaaaa

SEQ ID NO: 255243 - DNA, 1121 bp, Homo sapiens
gtgcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagttttctcactcccaggagcctgagtccaaccccatccagcccaggcagtccttgtagtcctctcttggcctttcacttttggagccctgtgtgtccaaatgctgggagaacatcaccccttggatgaattgccaccacattaaataaaacatatccaaagctcaaaaaaaaa

SEQ ID NO: 255244 - DNA, 293 bp, Homo sapiens
tcactgtcaggaagggcagcctccgaagagccatttcaactcagcccgacatcgccagagactagtggacccagctgcttcaaaaaaggagctgagtctccccagaagaggaagtttgtgcagaagcagtgattgtgactgggtaatagacaagagaagtgagagaaactgctttctaggcaagatgctgttatgagattgtcagccctgtgtgtccaaatgctgggagaacatcaccccttggatgaattgccaccacattaaataaaacatatccaaagctcaaaaaaaaa

SEQ ID NO: 255245 - DNA, 1722 bp, Homo sapiens
gtgcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagttttctcactcccaggagcctgagtccaaccccatccagcccaggcagtccttgtagtcctctcttggcctttcacttttggaggtaagcatgctccagggcctgcccagggctgctttgtctttctgttgccccatttcccaccaccagcatttgattacttcagactctgcaatccacaatccacagggtgaggaaactggttgaattgtttacttggtgacttacttgatcacttactctatttagcatatttactcatatttcacttggtgtctcttgactcattgttcaatgtgtgtgtatatgtgacagtttttcattttgctttcttagggaatgatctgcactgaattctgtaagttttgatcaatataaagatataatttattggtttctagaaaacatttcctaattcctatgagagtattataatacctgttgcctcaaactattttatacactattatttacaggataatgtatttaaattgtctaaagtgttaatattttttaaatcattttttagaactccaaggtatatactcctaccccctcactcataggctgattatattcactcttctctgtttgttagagaaatatccccaaggaactcttacattttagcatagtttgttataagaatacacgatagaaaatactgctactatagtatctatggtatgtatattctaatagacttttcatgaattcactatttatggatatagtgaatcttcctgtatctaatcggaagacacacatagtgt

SEQ ID NO: 255246 - DNA, 1555 bp, Homo sapiens
gaaaataaaaatccaagtgcctatctcttgcatttccagttggtagtttcctatcatcgggtttgcctgttcacacaagtctttgcggcacaacggagtctgacttcccccaaattaatgcagttagtttattcctcgttctgatgattgccatatatagagaaagatctaattatttttatgtggcactattcctcatttatttcttggggactatgagtgatttagttaactccaccaagggaagtgtaagatgagcctcctcagggtggctgaattctattcgagagcatcacagggaggtggggaatagttgacgtgtgctgagataaactcttttacaagtatgacactgttgctttatttttttgccccagtctgcagggtgaaaaggacttttcatttcactgaggtgaaaagtgggtctgtgagtagagcgactttctttaaaaaaaaaaaaaaaaatcagaaaccaattacttgatatgcagagctgcaagcctcgttcctttaacaaaatcagtgcagtgtgcactgccgttaacctgaggaaagcagctgacatctcttgattacggctagaggtggaaggacccaaacttgcagcctccccctccccctcgagagagtgttagtccagtcctttagagaggttcggtttggctctctgtcatcaccgggacgctggcagggagtgtgtgtcatggttacaatagagtgtgctaacatataacaaccatgaaagcccagcgggaaaggctacagattccggggctgaccttggatctcactcccaggagcctgagtccaaccccatccagcccaggcagtccttgtagtcctctcttggcctttcacttttggaggtaagcatgctccagggcctgcccagggctgctttgtctttctgttgccccatttcccaccaccagcatttgattacttcagactctgcaatccacaatccacagggtgaggaaactggttgaattgtttacttggtgacttacttgatcacttactctatttagcatatttactcatatttcacttggtgtctcttgactcattgttcaatgtgtgtgtatatgtgacagtttttcattttgctttcttagggaatgatctgcactgaattctgtaagttttgatcaatataaagatataatttattggtttctagaaaacatttcctaattcctatgagagtattataatacctgttgcctcaaactattttatacactattatttacaggataatgtatttaaattgtctaaagtgttaatattttttaaatcattttttagaactccaaggtatatactcctaccccctcactcataggctgattatattcactcttctctgtttgttagagaaatatccccaaggaactcttacattttagcatagtttgttataagaatacacgatagaaaatactgctactatagtatctatggtatgtatattctaatagacttttcatgaattcactatttatggatatagtgaatcttcctgtatctaatcggaagacacacatagtgt

SEQ ID NO: 255247 - DNA, 1276 bp, Homo sapiens
gtgcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgctttctcttttccttgtcttcaaacaaattgacatttgcggaggtgcgttgtgcagtagaacattcctcatgctgatgatcctctcctcctggcctctctgtctaccccttgcccctgtcgtagagctgtaagccatccttcccccgactccgcctgacatgtatcatggcacaccttcgtttttgttctttgtgtttatgtcgaatacctccctgctagactgcaagccccttgagggcagaattcttgtctgatttttactttctacttttcactgctctcaggacaatgccttgcacatagaaagcattcagtaaataatgttgaaggaataaataattatttatggaaaagt

SEQ ID NO: 255248 - DNA, 1128 bp, Homo sapiens
gtgcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttgtgcagaagcagtgattgtgactgggtaatagacaagagaagtgagagaaactgctttctaggcaagatgctgttatgagattgtcagccctgtgtgtccaaatgctgggagaacatcaccccttggatgaattgccaccacattaaataaaacatatccaaagctcaaaaaaaaa

SEQ ID NO: 255249 - DNA, 1008 bp, Homo sapiens
gtgcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgccctgtgtgtccaaatgctgggagaacatcaccccttggatgaattgccaccacattaaataaaacatatccaaagctcaaaaaaaaa

SEQ ID NO: 255250 - DNA, 1157 bp, Homo sapiens
gtgcagcgcgggagcacagtggagcgcagatcgcggacccgagcgggcatgtccccgcgcgcgggagcctccgtttgcggccgggcccgggcggctgtgaacttagcagcgggctcctgcggccccgtcactgccatgtagtcgctggcggggctccctgcagcccgggagcggcagtgccagtgagcctgagcccaggagcccgcgtcttccccgggaggcgctgagtgcgcgccgcgcccccgccgctcgggaggcactttgggccagacagggaaatgggggagaaagtttcggaggcgccagagccggtgccccgcggctgcagtggccacggcagccggactccagcctctgcgctggtcgccgcgtcctctccgggtgcttcctcggccgagtcctcctcgggctcagaaactctgtcggaggaaggggagcccggcggcttctccagagagcatcagccgccgccgccgccgccgttgggaggcaccctgggcgcccgggcgcccgccgcgtgggctccggcaagcgtgctgctggagcgcggagtccttgcgctgccgccgccgcttcccggaggagctgtgccgcccgcgccccggggcagcagcgcgtcccaggaggagcaggacgaggagcttgaccacatattatcccctccacccatgccgtttcggaaatgcagcaacccagatgtggcttctggccctggaaaatcactgaagtataaaagacagctgagtgaggatggaagacagctaaggcgagggagcctgggaggagccctgactgggaggtaccttcttccaaacccggtggcgggacaggcctggccggcctctgcagagacgtccaacctcgtgcgcatgcgcagccaggccctgggccagtcggcgccctcgctcaccgccagcctgaaggagctgagtctccccagaagaggaagtttgatagattcccagaagtggaattgcttggtcaaacgtctcactcccaggagcctgagtccaaccccatccagcccaggcagtccttgtagtcctctcttggcctttcacttttggagccctgtgtgtccaaatgctgggagaacatcaccccttggatgaattgccaccacattaaataaaacatatccaaagctcaaaaaaaaa

SEQ ID NO: 255251 - DNA, 311 bp, Homo sapiens
gtttcggaaatgcagcaacccagatgtggcttctggccctggaaaatcactgaagtataaaagacagctgagtgaggatggaagacagctaaggcgagggagcctgggaggagccctgactggtgagtcgcagcggcttggatgagagaaggaattgcatttctttacaaggtcctgcatggccccagagttccacatgtaatcagctttcttaagaatgggcctgcctctgcagaccatttcataaaaatcttatctaatccagaaagcagttaaattgaaaattttattaataaactttgctgaaatat

SEQ ID NO: 255252 - DNA, 473 bp, Homo sapiens
caggttcaagtgattctcctgcctcagcctcccaagtagctgagatcacaggtgcacgccaccaggcccagctaatttttgtatttttagtagagacggggtttcgccatgttggtcaggctggtcttgaactcctgaccttgtgattcgcccacgttggcctcccaaagtgctaggattgcaggcatgagccaccacacctggccaataatttctttttttatacaaactctcagagaacttaaaagaacacatgctcctaccgatcattttagtagtttaccataaccaaagccagataggacagtatataaatgaaaatttccaggcaaatctcactcatgaccatggatggaaaaatcctaaaataaatatcagcaatggggaaaaacaaaacaaaacaaataaattgcattccagtaattcaagattgggtcgacgcggccgcgaatttagtagtagtaggcggccgc

SEQ ID NO: 255253 - DNA, 446 bp, Homo sapiens
gttttttccttggggagtccccgccccgtgtggggtttcccgtcagtcggagcggcaggtcgcgagagcagggctggtggccagcggggagcctcgcagaggaaagcatcagtcttgctgaaataagcctagaattggaacgtaagggagttgtctgtagctgaatcgaccgatcgatagaaggatataactggggtggtgtctgtgcagatcggcatagaggatgagcagggtctgtctgggctttcgcgtccggcgtgtggagtggcaactaagattttttttttttttttttaagtgcctgttttctgaaattggcaggggccagggagaggaaacagttgcttgctatcagggtcatcccggagataacttgaagtttctagagcttattcttagaggcttcaggaaaaaaataaaaaaaaccaaaatcaaactttaaaagc

SEQ ID NO: 255254 - DNA, 328 bp, Homo sapiens
ggctctcagagggtgtcccatgcacgatttctcctcaccctcggaacaaacctagcaggtaagtattttcaccattcccaatttaagtctggggaaactaaggctcagggccgtaaatgaactcacttggggtcagaaggtgggcaggaggcagacctgggaccactgccgatccctcagcaggcaggcctttgtgtgttcagatgctcccccgagccctgtcgtgcgttcagatgctccgccgagccctgtcgtgcgttcagatgctctcccgagccctgtcgtgcgttcagatgcttcctgtcgtgcgttcagctcctgagccctg

SEQ ID NO: 255255 - DNA, 389 bp, Homo sapiens
ttctcagcataatatcatgttttccataaaagtggatcttgatcatcgccctctctcctagacagagaaaagccttgtcagtttttttatgagagagaaaatccagggaaccccaattggctttcatagtgcttagcaattctcatgaagggggtgaaatgtggagtagagaaatgtacagtgatttctggaacttttgttccagaagatgttaataaggtgaagttgttgttaactaaattttgcaggtataataaaacttgaagatgaagctatattcagggagaaaatctgcaaagagaggaatttcgtaaagggcagggtgaacagtaatgccgcttcagtagttcatgcctgtgcatagtcaaccttagaaaggcttttttaaa

SEQ ID NO: 255256 - DNA, 410 bp, Homo sapiens
gcatctcgtacccgtcagacgctgaactatgtgcagaggtaaagctgggcagcaacatcttattctcataacttctttaccactatgaaaaccaaaacaaagttactggtgaaacataactttagatttccagaaagtcaatccagatccaagtaacaacccgtatgtaatggggtagacaatggtcatgctaaaaccaagttccagtgttgagttccgtcagaaatttgttccctatctgaatgttatcattttgagatagaagaatcatttgaatcttcatcatgactatcattatctttggttttaattcatatttttcttattacttaatgagattgaacatcttttcatgtttattagccatttgaattctctctttggtgaagtggctgttctacttttcactt

SEQ ID NO: 255257 - DNA, 479 bp, Homo sapiens
tgagaaggacacaatgtcactgctgtggtctcctggcaaaaaaaaaagcacaatctgaatctaatcatgaagaaacatcaggcaatcctgaattgggactgtctgcaaaataactaacctgtactcttcaaaagtgtcaaggtcatgaaagacaaaggaagactgaggacctgtcagagatgagaagagtctcaattggtatcagaatcaaagaaactgtggggtcttggattggatcctggaccagaaaacgaacatttgctgacacatttggtaacatttaaggtctgtagcttagtttaacagtattggtcaatgttaattcaccagttttgattcttgaactatgattatgtcacatgttaccgtttgggatgctgagtaagggcacatgggaactctttcttcaacttgtttgtaagtctgaaattatttcaaagtaaagagtttatttaaaaactttctctattatctgaaca

SEQ ID NO: 255258 - DNA, 532 bp, Homo sapiens
acacacatatacctgattttttaagagttaaaattcatgtgtagcagcacaataaggtggacatagccataccccagaaagacatgccaagtcaaaagttgggctgatgctgcagggtttctgaccttctaatctaaatttggagataggttgcctagattttggaacctgcagggttacaggaacaaagagtgcaaagtaaaggcaggcacactgcctaaagcaagcctttgatagagttctccatttattcaataattcattcaacaaatattcaaagcctctaaaatgtccctggccttattccacagaaatccctgcttgtgtggaacatgcatcacagtgtagaggagctcatgggctaggagaaccagagtgagatggaaagtgggaagagaacctcctaaagaaaaactgaagcattttgttaggtgatctgtcatatcacagcagacgggggccctgaaatatcattataagacttgaatttcaaataaggataccagggatacaaaaaagctcaaaacattat

SEQ ID NO: 255259 - DNA, 346 bp, Homo sapiens
tgcccaggctggtctccaactcttaaagtgctgggactgtagctatgagccaccatacctggcttaattttcttattttaattttatataagtgattattattgttcctaagataattggggcagtgactcctttacaattgtagagatctaatttgtctattcacttcactgaaagagtatgccaatttgtttcatgagaaaatatcctatatttataaagcaggaaaattccttccaccaaactagggtgcattctaaagaaacgaattgtgctaagtaacatcacttaaagtgaaaacagaggcaatggtatctattaacaatgtttatcagtgaaggaaata

SEQ ID NO: 255260 - DNA, 567 bp, Homo sapiens
actaagtactatttacttctgttactctctaatttgttgatccttctactgtttgtaattttttaaaagtccttgtttttataatctatagtagactatgactttataagtatcaaaacctataaatctttagtagtttgtagagaaaacccactaaaatccttcatttaagttagttgcctctgcagactagaaaagtaccattctgtttcctgatatcctgtcttagagtcggtatgtggagagcaccattaactatttgtataattaaaatgaatgtgctaagttattttccacatttttgtttttggtgctgtaatatcaagtgctttgttttgtgttctgatgtatctgcatttacccttcagatgcaaataatggacctaaataggcttttattttaatatcagagggaactttatgctctaaggatacattctttttcttgctatatatagttttggtaaatactgaataagtgtgattagtacttaatagatctattcataatagctgtctgtaaatgacatagtatttgtaatgaataaaactatccttattttaaac

SEQ ID NO: 255261 - DNA, 323 bp, Homo sapiens
gcttgcaaacatttggttaacaaggcacgtcctgcacagccctacatgccttaaactttgatttcatacaacacatgtttttatgagctccagattgggtcaaagtggttggggcaaagtggctggggcaaagctacagattaacaacatctcagcaaagcaatggttgaaagtacaggtctttttcaaaatggagtctcttatgtcttccctttctatgtagacacagtaacagtctgatctctctttcttttccctacatatcccccttttcgttttgacaaaaccaccaccatcatcatggccccttctgtcgtcttctc

SEQ ID NO: 255262 - DNA, 168 bp, Homo sapiens
gcttgcaaacatttggttaacaaggcacgtcctgcacagccctacatgccttaaactttgatttcatacaacacatgtttttatgagctccagattgggtcaaagtggttgctgtctctctggagctgctggatacacctgtagactgtagcggtgattattaagaga

SEQ ID NO: 255263 - DNA, 275 bp, Homo sapiens
ggacaagaaacgtacctctcttccctcatatccagaggaagcaatggagggatgtggcgcttagactcactctactatccagtccatcgaagtcctaataatcttcaggatgcgacagagtgagactccgtctcaacaaaacaaaacaaaacaaccctaaggaaaagagagaatgtactggaggataggaagtatctaggagaaccttcttttttttttttcttatatttaaatttaagccttcatttatataaaataaaacgcatgaaacctat

SEQ ID NO: 255264 - DNA, 459 bp, Homo sapiens
cggttctcgagagaaagggaaggaagaggttccaagtatctgctgcccaacccactcttcaccatcctgggtgtcatcttctccccagtgccgtcctttcatcttcatttgaccaataaggacactgaggctcaaagccacagagggggctgagccagaacttgactgcagggccatgtgcttccaaagtccatgtcctttgcactttaccttcagttcaaaagaccaaagtggagtataaaatatgaaagcagattccattttgcttttcttagcccttagaaaaggggggagatcaccattctaactaagttaaagaaccagacacatttaaataaagtgactgaaatgctgtggaacagatgtgaataggaactaattttgctttttaatgagcattttgatcagatcaatactacaaaatgctaaactgtacaatgccattactgtttaaatgca

SEQ ID NO: 255265 - DNA, 492 bp, Homo sapiens
gccttagattttcaaggtcttagaggaagaaagggattacgtatgctgcaggcagttcatcatattgcttcttttaaatgagcatcgatcagtactggataacaatgagcaatgaatttagcaatggcaaaagcctacaaatagaattctggcttgccaagtaagttttgattgcttgtgttaaaggcgacaaaagccaggaataggccagccatggtggctcatgcatgtaatcccagcactttgggaggccgaggcgggtggatcccctgaggtcaggagttcaagaccagcctgaccaacatggcaaaaccctgtctctactaataatacaaaaattagctaggcatggtggttcatgcctgtaatcccagctacttgggaggctgaagcaggagaaccacttgaacctggggggtggaggttgtggtgagctgagatcataccattgcactccagcctgggcgaaagagtgaaactctgtctcaaaag

SEQ ID NO: 255266 - DNA, 2201 bp, Homo sapiens
gtcccttccctgggcaccaagagatgggctccccttgcctggcagagaaacagctggaaactggctccctgagacaagaagactggtaaacccagcgcttcctacctggtggtcttcagcaatgcccatgccttccagagacgggggcctgcatcccagacaccaccactatggttcccacagcccttggagtcagctcctgtccagccccatggagacgccgtccatcaagggcctttactaccggagggtgcggaaggtgggtgccctggacgcctccccagtggacctgaagaaggagatcctgatcaacgtggggggcaggaggtatctcctcccctggagcacactggaccggttcccgctgagccgcctgagcaaactcaggctctgtcggagctacgaggagatcgtgcagctctgcgatgattacgacgaggacagccaggagttcttcttcgacaggagccccagcgccttcggggtgatcgtgagcttcctggcggccgggaagctggtgcttctgcaggagatgtgcgcgctgtccttccaggaggagctggcctactggggcatcgaggaggcccacctggagaggtgctgcctgcggaagctgctgaggaagctggaggagctggaggagctggccaagctgcacagggaggacgtactgaggcagcagagggagacccgccgccccgcctcgcactcctcgcgctggggcctgtgcatgaaccggctgcgcgagatggtggaaaacccgcagtccgggctgcccgggaaggtcttcgcttgcctctccatcctcttcgtggccaccacagccgtcagcctgtgtgtcagcaccatgcccgacctcagggcagaggaggaccaggtgagcggcctctgatggcattcacggctccatcccgcagggtgcctgggcggagatgtcttttaggggcccaagaaaatgtcttcagatcttaaaataagaagaaaaaaatgaatattatccaacatgggttatattcattattaggccatcagtcataaaagataattttccatcttttttttttttattggagtcctgcaaaggcaaaagtgcctaaggctcaccgtgaaaatcattacgtggccctcagccatgcgtggactcagtgggccacacagacacagtgtcacctctcccagctctcccgagtctgtgactacaggcaaatcacgccacctcctctctgagcctgtctcccactccgtgaaatgggtaacatcacctcgaaggtttactcacccagtgaactcaacatgtgtttactgaacaccactctgtgctaagccctagagcaggtcaaaaacataaaatccctgccttcttgagctaacattctcctgggcatccccactccattttcagatgaggaaactgaggcatgggccatttattttcctcggagctccacagtaaggatgccaatgatgcaaaggtccccggcctcagtttccctgcagtgctcagtgtctgggccagtctcactggatgggaaactcacagatgagctgatctgtaagtcactctgccccaggaggccagagtaaaaagtgctgcttgcccacaccttcgtcccctttgcagggagttacaggagaccccgagacaccctccctccactcgggagccagatggtctgagaagtgaaataagaacctagcatttggttgagagggttattggaaagcttcaaacagagaattagattgtttcctgatttaaaaaatcactcctctccagcaccgagctcccccagggctgcccatcatcttaatgtttggagcttgccttgtaatcaacagagagagaaactaaacacatacgtaagatggtgcttgctctatttggctcctaacagttgccagcccacctaagttctcttcgcttaaagatatgtcccagggcaagacaacaggatcagagaacttgccagatagaaaagacttaaatggagaaccagcccatgcctcacagacagtaggatcccagtaaatatgggttgaataaaatgtgtcttgtccaacctacaaaagtttggccctaaaaaaacccacaaaatatttggacctttaaacagcttgttttcccatggagaagatgacaatgccaatcataggcattttttcattctacagcataaaaacatgagatttaagagcctgct

SEQ ID NO: 255267 - DNA, 2144 bp, Homo sapiens
tcggagctgaacttcctaaaagacaaagtgtttatctttcaagattcattctccctgaatcttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaataaaaataagtagttttaaatgttataattcatgttactggctgaagtgcattttctctctacgttagtctcaggtcctcttcccagaatttacaaagcaattcactaccttttgctacatttgcctcattttttagtgttcgtatgaaagtacagggacacggagccaagacagagtctagcaaagaaggggattttggaaggtgccttccaaaaatctcctgaatccgggctctgtagcaggtcctcttctttctagcttctgacaagtctgtcttctcttcttggtttcataccgttcttatctcctgcccaagcatatatcgtctctttactcccctgtataatgagtaagaagcttcttcaagtcatgaaacttattcctgctcagaataccggtgtggcctttctggctacaggcctccactgcaccttcttagggaagggcatgccagccatcagctccaaacaggctgtaaccaagtccacccatccctggggcttcctttgctctgccttattttcaattgactgaatggatctcaccagattttgtatctattgctcagctaggacccgagtccaatagtcaatttattctaagcgaacattcatctccacactttcctgtctcaagcccatccattatttcttaacttttattttagctttcgggggtacatgttaaaggctttttatataggtaaactcatgtcgtggaggtttgttgtacagattatttcatcacccaggtattaagcccagtgcctaatattgtttttttcggctcctctccctcctcctaccttccgccctcaagtagactccagtgtctgttattcccttctttgtgtttatgaattctcatcatttagctcccacttataagtgaggacatgcagtatttggttttctgttcccatgtttgctaaggataatggtttccagttctaccgatgttcccacaaaagacataattttcttttttaaggctgcttagtattccatggtatctatgtatcacattttctctatccaatctattgttgactcacatttagattgattccatgtttttgctattgtgaatagtgctgcaatgaacattcgtgtgcatgtgtctttatggtagaaagatttatatttctctgagtatgtatccagtaatagcccattcatttattgcataaaattctaccaatac

SEQ ID NO: 255268 - DNA, 974 bp, Homo sapiens
tcggagctgaacttcctaaaagacaaagtgtttatctttcaagattcattctccctgaatcttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaataaaaataagtagttttaaatgttataattcatg

SEQ ID NO: 255269 - DNA, 939 bp, Homo sapiens
cttaggtacgaggccgggtgttaatcggccgaggcaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcaggaattcctttcctacaagaaacctaaaatgagagagttttttattggactgtcagaccaggttgtcgagggtcagtggcaatgggtggacggcacacctttgacaaagtctctgagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaataaaaataagtagttttaaatgttataattcatg

SEQ ID NO: 255270 - DNA, 2028 bp, Homo sapiens
tcggagctgaacttcctaaaagacaaagtgtttatctttcaagattcattctccctgaatcttaccaacaaaacactcctgaggagaaagaaagagagggagggagagaaaaagagagagagagaaacaaaaaaccaaagagagagaaaaaatgaattcatctaaatcatctgaaacacaatgcacagagagaggatgcttctcttcccaaatgttcttatggactgttgctgggatccccatcctatttctcagtgcctgtttcatcaccagatgtgttgtgacatttcgcatctttcaaacctgtgatgagaaaaagtttcagctacctgagaatttcacagagctctcctgctacaattatggatcaggttcagtcaagaattgttgtccattgaactgggaatattttcaatccagctgctacttcttttctactgacaccatttcctgggcgttaagtttaaagaactgctcagccatgggggctcacctggtggttatcaactcacaggaggagcagcttctgggatgtaggggagcccaacaacatagctaccctggaggactgtgccaccatgagagactcttcaaacccaaggcaaaattggaatgatgtaacctgtttcctcaattattttcggatttgtgaaatggtaggaataaatcctttgaacaaaggaaaatctctttaagaacagaaggcacaactcaaatgtgtaaagaaggaagagcaagaacatggccacacccaccgccccacacgagaaatttgtgcgctgaacttcaaaggacttcataagtatttgttactctgatataaataaaaataagtagttttaaatgttataattcatgttactggctgaagtgcattttctctctacgttagtctcaggtcctcttcccagaatttacaaagcaattcactaccttttgctacatttgcctcattttttagtgttcgtatgaaagtacagggacacggagccaagacagagtctagcaaagaaggggattttggaaggtgccttccaaaaatctcctgaatccgggctctgtagcaggtcctcttctttctagcttctgacaagtctgtcttctcttcttggtttcataccgttcttatctcctgcccaagcatatatcgtctctttactcccctgtataatgagtaagaagcttcttcaagtcatgaaacttattcctgctcagaataccggtgtggcctttctggctacaggcctccactgcaccttcttagggaagggcatgccagccatcagctccaaacaggctgtaaccaagtccacccatccctggggcttcctttgctctgccttattttcaattgactgaatggatctcaccagattttgtatctattgctcagctaggacccgagtccaatagtcaatttattctaagcgaacattcatctccacactttcctgtctcaagcccatccattatttcttaacttttattttagctttcgggggtacatgttaaaggctttttatataggtaaactcatgtcgtggaggtttgttgtacagattatttcatcacccaggtattaagcccagtgcctaatattgtttttttcggctcctctccctcctcctaccttccgccctcaagtagactccagtgtctgttattcccttctttgtgtttatgaattctcatcatttagctcccacttataagtgaggacatgcagtatttggttttctgttcccatgtttgctaaggataatggtttccagttctaccgatgttcccacaaaagacataattttcttttttaaggctgcttagtattccatggtatctatgtatcacattttctctatccaatctattgttgactcacatttagattgattccatgtttttgctattgtgaatagtgctgcaatgaacattcgtgtgcatgtgtctttatggtagaaagatttatatttctctgagtatgtatccagtaatagcccattcatttattgcataaaattctaccaatac

SEQ ID NO: 255271 - DNA, 3473 bp, Homo sapiens
aaaaaggaattgggattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccctgtttt

SEQ ID NO: 255272 - DNA, 2013 bp, Homo sapiens
aaaaaggaattgggattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctgggtaagctgaaggtagtcctagagatcacagtgatgtgagtggcacctgtcaccttctttacatgacctgcattatcaggaacagtatgtaaaagatgaatgatgtctgccttttatttttagataggtatgttgttgaaaaagcaagtggcaaaacattgctcccaatcctttaggcttacttattccatgcttcttttagaatatttattttatactttcgtgaattaaaaattttcagtacctgaaagtcaacagtcactttgtaactgaagaatatacagctgttaggctaaaattccctttgctcactggctttgattgaatacctacagggatcataactgtctagacaattacttgacatgtgttctcatattccttctgtcttcccatagagagcagtttgggattaatacacatgattctgtctctcaaaatgtacctctgcactggaagtttttaccccaattttgagggatttttccagatttcagaaattatagttaatgtcatatcactcgtttaagttacatttttacctccagtcattttggctctcttttagctcgtttttatagggatttgtaaaattaaaaatgctttgcatgttttactttataccttaacagggtttattaagggaactccagcaatgttaaatagacatgttagatccactaccccaagtgcacttaaagtgtgatataaatgg

SEQ ID NO: 255273 - DNA, 646 bp, Homo sapiens
cttaaaaatggagactggtgtaatctaagcagttagaggtgacactctcctcaccagcaggagatctctggagaccttaaaccagagaatctctggccatggggtcaccagatgtaactgaaagcaggagtgaccacttaagtgaaaacagggagggagtggaagtgtgcatgcccagcagtgagatgcctcagagagaagaaacatatcctgggtcatatgacgactaaatagcagagcctggattcacactctggcttgttttgccctagtgctcaggccacttcactgaggttcttctactgcaaatacttcctgttacttatttataccatgctctttcattcccctgtactttttctctaactgttcctttttctttaggagtacccttcttgtttgatcatgtcgtgagtttttgaaattcacctcagacttacagataaccatgatggagtaaacataggcatttaactctgcttcctacagaaacctcattaaaataacaatgaaagaataaaaaggtataaacccacagggactaactaggagaatagaagcaggtataatagcaagtgtgagttgtcaacagaattttggataagtgtggcttgtagacgaaagaggtaaaaagaaaaaaacaaag

SEQ ID NO: 255274 - DNA, 224 bp, Homo sapiens
attcttttgcagaaatatttatgattacagtaatcattgctatgtttcagaatactttagagctttaattatgtcatttgggcttcagccaccagggaggtaagtgtggtgaaacagaaactcagagagagaagaaacatatcctgggtcatatgacgactaaatagcagagcctggattcacactctggcttgttttgccctagtgctcaggccacttcactg

SEQ ID NO: 255275 - DNA, 820 bp, Homo sapiens
tgtgtgccaatttgttcaggtaagtactgggaaatcttttaagtcatggagatgttttgatataaaattgtagtgaacataagaaagtgctgtgtgtgtaatagatgctccataattagccataaatattctttctggagtcagtttgtagctgcaagtaagagacagaaaatgtctatagtgaagaaatggcattaattgtgcatgtggagaggacatctgttcccaggctgcaaaactgactcattctgaatttaaagagggttttttttttaatttaaaagtaaactttaatgtcaaaaatgcaaacttagggaggacataaagatcacatacaaggctgccacttcacacttggagggttgcacagcatctgggcaaaggctctcctcacttcccagatggtgcagcagctggacagagatgctcctcacttcccagatggtggggcagccaggaagaggcgctccttactcccagatggtagggccgccgagcagaggcactcctcatttcttagtgcggccgccaggcagaggcacacctcgtgtccaagaaggtgtggcagccaggcagaggcgctcctcacgtcccaggcggtgcagtggccgggcaaaggcgcttctcattcccagacagggctgggggccagggagaggcgctgctcacttcccagacagtggggcagctgggcagaggtgcttctcacttcccagaaagttgggcagctgggcagaggcgctccttaaagaggatttgttttatgtttatcctcagctatgtatgcctcacagctcttctccttgtgttatggctacgg

SEQ ID NO: 255276 - DNA, 315 bp, Homo sapiens
attttctaattctctgaacaaccgtgtgaggtagttattatctcaattgtattgactgagaaaatgagacatgaacagatcaaggaagctgacaaatatggcgtagtttgtaaactgtaatgtgaggatttgaatccagagcctctcactccaagcactccatttaaactctactgtatgctgatttgagtttcataaacaacttgaaaatgtgcatatcccttgccgcccccactatcagaaagaaaacgttcccagaaccccaatacccagaggcaatctcctcactgagaattcagtggactagtagtagta

SEQ ID NO: 255277 - DNA, 693 bp, Homo sapiens
attccatttctaagaatacagcctaagaaaatagtcatgggcatatacaaagatatttgtatacaattgatcatttcagtttgtacaaagctattaattaaaacagagacaacttccaattctaaaagaggagaatattcaataaacaataatatattttccacatcagtgtttcccaacttgtgtggcatcagaatcacttgagggcactgactagatggacagaataccaggagccttccctgtagattctgattcacaatgtctgggcagctgccaaggagaaggtataacaacgagtgtctcgggtgcttcttaaggcaagtctgggaaatggtgctttatgtaacaaaatattttaaaatgcattaaaaatgatgaagtagaaatataggtaaatgtgagaaaaagttcctaatgtcgtctcaagtgaaaagcagttttttaaacagattctatagtatggtctcaattttgtatttaaaatgtatacatgccaatataaaacaggaggacattcactaaaattgtttaggatggttagctctggatcataagaccgtaggtgattttgcttctttctttgtacctatcttcagttttctaaattctctgccatgaagatgccttacctttaagaccaaattaagttataaccaaactctcctaagtgtcttttctttcacaaagaga

SEQ ID NO: 255278 - DNA, 301 bp, Homo sapiens
gtcacccagtttgaaagctgttgtattggaagatggttaaggcccttctaggtttcaaatgccttgacgtccccatgacctatgtccccccccccccaccatgtcaacccttcagaggggtgccgatggtagagaagccaagcttgctatttttggtgattgaggtttacaataaacaaaaccagctgttttctcattacctataattttttttcaggcaatgggtccattcactgaactaatctgtcttgcatagctgcttggatgtgggtgtggggaaaatggttgggtgagcagatat

SEQ ID NO: 255279 - DNA, 527 bp, Homo sapiens
caaatcggggaatgaatacaaatttatcttacagttctagaggtcagaagtctgatagaggtcttactgggctaaaattaaggtgttgacaaggctgcattcctttttggaagatctaagggaggctgtgtttccttgcctttcccagcttctcaaggccacccgcattccttggctcatggtcctctttttccatcttcaaaggctgcaaaggtgatcaactcctttccatagccctctttgatcacagctgggaaaggttctttgcttctgtaaacacattagatgagcccatctgggcgattcaggatagtctccccacctggtgggatctccccagcagtttccttaccttaattataaacacagtctcttttgccatttataagatcatattcacaagtactggggattacggtgtaggcttctttgttggccattgttttacctagcagaactatatagataaaataattatgtggaaatcagtaataaaaatatattaaaagccaagtttttgatataat

SEQ ID NO: 255280 - DNA, 256 bp, Homo sapiens
ttttttttaattatctgttttcctgaaataccaaggcttgcacatattaagaacaataaatactattaaaacatccatcatttaaaacaatttatactagtatatattagctttgggaaacaaaaatatgaataatttactgtaattgtatgactttctggacctttttaaacagttagagctaaattttctctgctttagatttttttcatcattgctttcccagattgggtaatgttgcaatcctgtggcaatg

SEQ ID NO: 255281 - DNA, 413 bp, Homo sapiens
aacaattaaaatggtaacatcaaagatcactgatcacagatcaccatagcagatatataataataatgaaaaagttggaaatattgtgagaattactgaactgtgacacagagacatgaagtgagcacatgatgttagaaaacttgcgccaatagtcttgcttgatgtacgattgccacaaatcttcaatttgttaaaaaatctgcaaataaatgaggcatgtctgtgtttgtttaatgattaacaatccgtcacaaactggataattcatcagcaataactcatccagtttgtgattcatcaatccatcttcgttttgctgcatttcaaaacaagcctcagtcatccatgtatttcatgcctaaacacttcagtaggtgtatcattaacttaagttcagtattgaacgtagt

SEQ ID NO: 255282 - DNA, 247 bp, Homo sapiens
ttgaaactcttatgatttcagttaatgtaatgtctgccctccaggaattcagcccagctgaagaggcaggcaggtggggagatagaataggatgtgttgcatgctctcagacatagttttacattggatgagatggtagggaaagctgcagaggggagatgttatttgaatttcgccttgatgagtgaggaagagttaaatcaacaaaagttggaaaagcattcagaacagagggagaaaaaccgac

SEQ ID NO: 255283 - DNA, 303 bp, Homo sapiens
cctggctggaaagatctgatgctctggaagccatgatgtgaaagctctgcagtggggacagggggtatcccgggtgataaaggttagaaagagaaactgctgatctcacgttcgtagggagctggccatggtcctgccctgcaaacaagagccgggagactgcaagaaaggctgagtaaagcccaaagagaaactcttccccctggatgatgatcaagaacctcattctgccggcttctggaggaatcttggccagaaaagaactcagaatccctttcaacctctttcaatttttctggtctg

SEQ ID NO: 255284 - DNA, 564 bp, Homo sapiens
gggttcaagcaattctagtgcctcagcctccttagtggctgtgactacaggcgtgtaccaccatgcctggctaatttttctatttttagtagaaatggggtttcacggtgttggccaggctggtcttgaactcctggcctcaagtaatccacccactttggcctcccaaagtgctgggattatgggcgtgagccgctgcatccggcctctgtattaaatactttagctgcatattctttcttcgaaatgaccacaaaaagaaggtattactgattaatatgcatatggtcttgcgtatggccagacttatgacttgcgtatggtcataaaggtagtaagttgcagagcagcactcagacctgcctggctttgatgaccgtgccttgatggcactggaagtggaaaggtgggggtgactggggaggtgaggttttgtccgttccctggatgctaaaaggaaatggaggagtgtaagaggttgattctttgaacctggatggctggggcaaagataacactgtaacaggaagaagagaggccggagggaacactgatgtgatggga

SEQ ID NO: 255285 - DNA, 504 bp, Homo sapiens
agttgatgttaatctagaatttttagttttttaaattatcgatatactttctgtcttttcctttttttttcactctctctgtatttgtgctttccccctttactctctttcccttcattccttctttctcactttcttcttctatttttcactcttgggtagattatcttttagaaaacagcaagatattatataatttactttatattctctttccaaatgattaaagtaataattaaaaatttttgatatgtgtgtatgcaaggataggaatcctcttgtaagtggaagaactctaccacatgcatgagtcattagtgtgttaaacactgggaagtggctttaggtccagctgggtgctctgaagaaggtaggtttcttcagttctttatgttaactgtctccttaccttaaaaaaggagtgaagaatactgactgcagaggttttgtgaggattccggtaacacagaagcatagaactggaaaagaatattaatatttgcc

SEQ ID NO: 255286 - DNA, 329 bp, Homo sapiens
aagtgcccccaggttattttaatgtgcagcctgagtttaaaaccactggattcggccgggcgcgttggctcacgcctgtaatcccagcactttgggaggcctaggcaggtggatcacgaggtcaggagatccagaccatcctggctaacacggtgaaacctcgtctctactataaatacaaaaaattagccgggcatggtggcgggcgcctgtagtcccagccgctcggcaggctgaggcagaatggcgtgaacccgggaggcggagcttgcagtgagctgagatcgtgccactgcactccagcctgggcaacagagagagactccatc

SEQ ID NO: 255287 - DNA, 1503 bp, Homo sapiens
gagggagggagcgagcgagcgaacgagcagccggcgccgtcctcccgcagcaccagccaggccacgccgccgcctcttcccctgcgccccgcgcccaggccgggccgagccgagccgagccgggtcgggcccgggccatgctgctcaccgtgtactgtgtgcggagggacctctccgaggtgaccttttccctccaggtcgacgccgacttcgagctgcacaacttccgcgcgctgtgcgagctcgagtctggcatccccgcagccgagagccagatcgtctatgcggaaagacctctcacagacaaccacagatcattggcttcttatggcttgaaagatggggacgttgtgattttacgacagaaggagaatgcagaccctcgacctccagtgcagttcccaaacttaccccgaatagatttcagtagtatagctgtgcctggcacatcaagtccccggcagcgccagccaccaggaacacagcagtcccactcatctcctggagaaataacttcatctcctcagggcttggacaatccagccttgctccgagatatgttgctggccaacccgcatgagctgtccttgctgaaggaacgcaatccacccctggcagaagctctgctcagtggagaccttgagaaattttctagagtcctggtggagcagcagcaggaccgagcccggagagagcaagaaaggattcgtctgttttctgctgatccctttgaccttgaagctcaggcaaagatagaagaagatataaggtaaagacctgttcatctaaagaacaaaacttagagactccagatttcccagactgcaggttatctgacattggttgggcatctgcttggaggtagcttctctgttttgcagttgagatagtaacctcagtcttttaggttagtctctcctctttcattttctatgcatttcgatttgacatgacaaagatataggtgcttagtttaatgactttctttctaaaattttaaggaggactccctgactagcagacagagcatcataacacagctttagataaatgacccccggactgagcagaagccaccatctggtgagaccacaaggctggttgcatattacatgggctgatttgactctctttctttagacatattgtataagtcctgattaaatccagggcttaaacatgattggattagagagggctctgcgccgatggaacgttggtagtcctaagtctgttttcctgctgcatttcttgtactggcctcagtggataaactgaatgctggacatgtttccagctctcagtttctgtaatgcggtggttctcacctggggctatagtaaaatcacatgagaaacttttaaaaatgcagatgcttggactcttctcccaaatctgatgaatcagaattgtcgggcatggagctcaagcaaggacagtgacgctgttccggcctcagtcacactgatagtcacaagcaagattctgttcagtcattctctg

SEQ ID NO: 255288 - DNA, 334 bp, Homo sapiens
tactgtaatagtctcagaagcccaagatggaattctgtgaacattcatggaggtcctaccatgactcgggcactgctccagatgttaaaaatatggggatatgtaaaacagatgaaggacctgtcctcagggagttatcttctattgagagaaactgcaaacaagtacattaatctgatcaggttatgccattttatataggattgccagggagagactatgcccagaggggattattttgaaaaataccaaaacccccatcacagaagtattctactgggtaacaatgtggtcaaatataatcaaacaacagctaagcagtagagctgaggac

SEQ ID NO: 255289 - DNA, 530 bp, Homo sapiens
atacccatgggttctgcatctgtgggtcaaccagctgcagattgaaaatatttggggaaaaataatggatggttgtgtctgtactgaacatgtacagactgttttttcttgtaattattcctgagcaatacagtgactatttatatagcatttacattgtattagatattataagtaatctagagatgatttaaagtatatgaaaggatgtgtgtaggttatatgcaaatattataaaccattttatgtgagagaattgagcatccgtggattttattttttaatccatgaggggagaggtcctagaaccatttcttcacagatagcaagtgacaacaatttatgttggtgtgagctcaaaattgctaatgttggatgttacaaagactggaataacaaatgaataagcaggttatatcattgaaataataactttatatcagtatgatcaatgaaagattgtacttcagttacatgagtgggtacgtgcttgtataaattctagtatgtcactatatatgcactgattc

SEQ ID NO: 255290 - DNA, 1070 bp, Homo sapiens
cgaggggagcgagaggcgcggagagtttggcaggcagacccagaaatccctggagcgcggcggacccggcggccggaggggcgaccccgcccgatgtaacgcgccccgcccgagccccggcccctgcacggggggggtgatgtgagcagagcccaggaatgccttatgtggatcggcagaaccgaatctgtgggtttctggacatcgaggagcatgagaacagcggcaagtttctgcggaggtacttcattctggacacccaggctaactgcctcctctggtatatggacaacccccagaatctggcaatgggggcaggagctgttggagctttgcagctgacctacatctcgaaggtgagcatagctaccccaaaacagaaaccaaaaactccattttgctttgttatcaatgccctgtctcagagatatttccttcaagccaatgatcagaaagatatgaaggactgggttgaagccctgaaccaagccagcaagatcaccgttcccaaaggtgggggcctacccatgaccactgaagttctcaagagcttagcagctcctccagccctggagaagaagccacaggtggcctacaagacggagatcattggaggggtggtggtccacacacccatcagccagaacggtggggatgggcaggaagggagtgagcccgggtcccacaccatccttcgaaggtctcagagttacatccccacgtcaggctgccgtgcttccactgggcctcccctcattaagagtggttactgcgtgaagcaagggaatgtgcggaagagctggaaacgtcgcttctttgcacttgatgactttaccatctgctacttcaagtgtgagcaggaccgagaaccactgcgcaccatattttttaaggatgttctgaagacccatgaatgtctggtcaagtctggtgatctcttaatgagggacaacctgtttgaaataataacaagctccaggaccttctacgtacaggcagacagtccagaagacatgcacagctggattaaggagattggcgcagctgtccaggccctcaagtgccacccc

SEQ ID NO: 255291 - DNA, 1004 bp, Homo sapiens
cgctggggcaccgaccccgcaacgactgcccgggctgcgggaggggaggagagcagagaacgtccccagggtgatgtgagcagagcccaggaatgccttatgtggatcggcagaaccgaatctgtgggtttctggacatcgaggagcatgagaacagcggcaagtttctgcggaggtacttcattctggacacccaggctaactgcctcctctggtatatggacaacccccagaatctggcaatgggggcaggagctgttggagctttgcagctgacctacatctcgaaggtgagcatagctaccccaaaacagaaaccaaaaactccattttgctttgttatcaatgccctgtctcagagatatttccttcaagccaatgatcagaaagatatgaaggactgggttgaagccctgaaccaagccagcaagatcaccgttcccaaaggtgggggcctacccatgaccactgaagttctcaagagcttagcagctcctccagccctggagaagaagccacaggtggcctacaagacggagatcattggaggggtggtggtccacacacccatcagccagaacggtggggatgggcaggaagggagtgagcccgggtcccacaccatccttcgaaggtctcagagttacatccccacgtcaggctgccgtgcttccactgggcctcccctcattaagagtggttactgcgtgaagcaagggaatgtgcggaagagctggaaacgtcgcttctttgcacttgatgactttaccatctgctacttcaagtgtgagcaggaccgagaaccactgcgcaccatattttttaaggatgttctgaagacccatgaatgtctggtcaagtctggtgatctcttaatgagggacaacctgtttgaaataataacaagctccaggaccttctacgtacaggcagacagtccagaagacatgcacagctggattaaggagattggcgcagctgtccaggccctcaagtgccacccc

SEQ ID NO: 255292 - DNA, 588 bp, Homo sapiens
cgaggggagcgagaggcgcggagagtttggcaggcagacccagaaatccctggagcgcggcggacccggcggccggaggggcgaccccgcccgatgtaacgcgccccgcccgagccccggcccctgcacggggggggtgatgtgagcagagcccaggaatgccttatgtggatcggcagaaccgaatctgtgggtttctggacatcgaggagcatgagaacagcggcaagtttctgcggaggtacttcattctggacacccaggctaactgcctcctctggtatatggacaacccccaggtgagagggtcagtgggaaggggtggggcgactgggtgcccatcactgcgccagaggaatgcacacagggttagcctccaggcctaggctcgtgagcaacacaacctgctgatcagcagggaggggacaaccctacaacacacacagacacacacacaaatgcacattcacgtgcacacacaccacacacaccccatacacaccacacacacgcacacacatgcaccttatacacacacaccacacacacaccgtacagacaaacacaaacacaacaaaagcaggcacc

SEQ ID NO: 255293 - DNA, 184 bp, Homo sapiens
aggggttggtcttgctgtctcaagagtggcaaaggtggaagaaatctgcgtataagtggacccacgcgtggatccatgcatttcaaacccatgttgttcaagggttcactgtagatggattgacccatgatggctcattaaaaggttaaatgcttaaagttaataaatggttaaaagctcaagt

SEQ ID NO: 255294 - DNA, 340 bp, Homo sapiens
tataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaa

SEQ ID NO: 255295 - DNA, 389 bp, Homo sapiens
cgctgccatatctggtcctggtgattgcaggagtagaggagagacacaggcaagatcaaaaggctgtcatctcagaaaagattgctaattgattgatcttcctgtctccagtttgcccttacaccaattcatctaccaaaagatgtctaaatttctctctctgaagaaatgctgtgctaatgttggtcgcagtaaaactccaatggctcccaccacctaccaaggaaatttcaaagccctccatgacatagatcctttccaaaactttatgctgatgctgcagctcaactggaaaactcatttccttccctttccctttcttctgtatctccacatgtcaaggtcttggtgattattaaagcccaagaaaaagtaaatcttttaatgaa

SEQ ID NO: 255296 - DNA, 219 bp, Homo sapiens
ggggtctagggtgctggtgatgttttctttcttgatctggtaactggttatagggatgtcaccaaattgtcactctgaaaattctccaagctggacacataagatttgtccatttttttctgtttatatactacattccaaaaaaaaaaaaaaggaaaaaaggaaacaccaagacaagttgttctgaacttgaagtaaaaatatcagtatgaactcaag

SEQ ID NO: 255297 - DNA, 250 bp, Homo sapiens
aagtcatatgagctctctgagcctcagtttccatatctgtaaactaagacaaagcttgccctacctccctcctgcaaggagctgttgagggatcaagaaggctaaggcagggaaggagctctgaaaactgtgatcgcggcactactgatgactgatcagcgcctcccctgcctggccctgggccaagctggggtgactggagggtgaagtgtgaatgggaagagggagaccccaatgtgccttttgcagc

SEQ ID NO: 255298 - DNA, 532 bp, Homo sapiens
aacacttgtgtattgcacattctggttcctctttggcaaattgccttggcattaagatagtaaattttccttgccacctacgctggttgagtcaggatgcttaattacttggaggtaaaaagcacctggctgaaatagccatccctgaggctgcctgttgaggataggagatgcttcatccatctttagatcctttcttggaaacgctgagcctggccagccatgcaggcttttccaagctctgatgctgccctgtgtccacaatagcatccccacagcctggatccatcattcccagcattatgatagctcctttgtctccttggaagagcccaaaacccacagctgaggcctcagggcttttctaatgtgcttagaacaggggtaaaggtaatgccaaccaaaatggggaaacctgtattcctgctcagtcactgcttagtcagcataaatcactccagaggatagtttgttactgacctcaaagactcagttacaaagatgatcaccatagcattgtttacagtagcac

SEQ ID NO: 255299 - DNA, 356 bp, Homo sapiens
actgaattctcagtgagtgcttctgtttggtgtgattggcagccaaagacagtatagaagcagaacagccagcgtccatgtctgacctaactcagggctgccgtcaatcagaaccaccattattttaaatgcaagtcagcaaccactctcacaggcaataagcactcatatttcatcttgagatcttatgtcactagaaagaggtcttttcctttaaacacattaatgctgagagaactgaaaacatttcacttccaaaggcaggtgaaacactgaaaaaaagcttcactaacttattgctacaatttagataactgagcacttgccagctattcttccaatgggattctacgtga

SEQ ID NO: 255300 - DNA, 483 bp, Homo sapiens
taatattgggaatttcccttggtgctaagaatggtgctgaggcactcgaacctttgtgcttcgtgctattgaattcctgtacattagctttctaagcacatttctaatttgtacacttaatgccttcatcttgaccagcctaatcattcacacagctagtaatgctaaattattgtctcacaatgccccttatctttggtgtgcatgtgtacctatatttatttaaaagggttaataacagagcttgtaattgtggaatgttcgctggtgaacaaatggcagaaggactcacgcaagtttatatcatcggcctttgttttccagagctcccccaaacagattttgattcttttctccctagaaatagtgttacctgtcatacaagcaactgattggtagggtctactactgaattccttattcctggaattagttcacaagatgtatcgtcttaaatgtactgatatgtgaaaaggagatacc

SEQ ID NO: 255301 - DNA, 721 bp, Homo sapiens
ccagctttctgaatccacaattccatctctccctcaaggggccattgtaatggcttcatatttatggagtgtatgaaaagtacatatgggctttggggaaaatggctcttcaggcacacctatcaacacaaaccatgaactgaaaacaaaatctagggcttcttaatgacatgaaatggactatcccagattcataaagacctttttttcagcctttttttttttttttttgcaaaaggatactgtttcctttttgcatgcttactgtgagcgatttcactaaggttttcttaagttgaagcccatggttaatttttcagcttcggaaagaacccaggctttttgaataggcacacattttggagacaaacctcggcttcacaagtgtaatttcttgagaagagaatttgctcaggaaggttttgtcactgttatttgggctcctcccattagcatttctttttcctttcttggttggcttaaccactcattagtgatgacagaacattacaccactgtgacatgacaaagacggctggaagggacacagccctgccagccagatggcaacacatggatgtcaaagagcacaacacccagttgtttggaagtggctgtcctttgaagagtcgcttaaatttatgtggccaatattttcgtcttgtggtatttatttctagtggtcacaagtcaacactagggagtgggagagacattagtt

SEQ ID NO: 255302 - DNA, 351 bp, Homo sapiens
gctgttgggtgacctgtttagagggataattgagaggtgaggccagctggacttcctgagttgagtggggacttggggaactttcctgtcttacaagcggattgtaaaatgcaccaatcagcactctgtaaaacgcaccaatcagcaggattctaaaagtagccaatcacagggaggattgaaaaaagggcactctgataggacagaaacggaacatgggaggggtcgataagggaataaaagctggccacccccccccagccagcaaggcaacccgctagggtcaccttccacgctgtggaagctttgtcctttcgctcttcacaataaacgttgctcactctttgggtc

SEQ ID NO: 255303 - DNA, 635 bp, Homo sapiens
tgagtgaacaatgaggaataccagaagagaaatgaaaactttcaaaaagaaccaaatagaaattttaaaagtgaaaactataacaacagaaattgtaaaatcctctggctaggcttcacagattgaaacagaaaacaagatctattaatttgatttcagatcatcagaaattatacgttatgaaaagtagagttaacaaacaacttcagtggagcagaaaaagtatctgaagaaatagtagccccccaaatctctaaatttatgaaaaacctaaacttacccatcaacaaatcttaagacaaccaattctgagaaatcaaacacacagtctctctcaagcacatcacagtaagattgctagatgtcaaacacaaaattctgaaagcagccaaaggaaatgatacattatatacaaggtaacaaggataggcaatgatgcatactctcctgacttctattcaacacagtattgaaaatcctagtccatgcaacatgtcaagaaaaagaaacagtctgggcacagcgctcatgcctgtagtgccagcactttgcaaggccaaggtgagagcatcacttgaggccaggagttcaagatcagcctggacaacatagtgatatcctgtctgtaccaaaaa

SEQ ID NO: 255304 - DNA, 100 bp, Homo sapiens
ctgtactcagctgcaccagtgtattttcccatccaaaacatacacaggggaggcttgatgccaccccaggaaacagaataaccccttctagggacttctt

SEQ ID NO: 255305 - DNA, 333 bp, Homo sapiens
ctccccaactccatcttaaaaaatccactgccttaagtgacagaagctctggctttaggccaggcacggtggcacaagcctgcagtcccagctctttgggaggctgaggcaggtggatcacttgaggtcaggagttcaagaccagcctggccaacatggtgaaacctcatctctactaaaaatacaaaaactaacaggatgtggcaggtgcctgtaatcccagctactcaggaggctgaggcaggagaatcacttgaacccaggaggcagagtttgcagtgagtcaagatcacgccactgcactccagcctgggcgacagagtgagatctgtc

SEQ ID NO: 255306 - DNA, 298 bp, Homo sapiens
attgtaaatggtaagtattagatacatgattctgtaagactttctacaaacagaaactcacataagtactataagttattttacagatggacaaacgaaaggcatgaaagtgaattaatttacctctcaggattaagtaacaacaaaaaaactcctaaaaccgactctatggtgttattcacttacttacttcacttatgtgggtatttgccttgtttgggttgtgattttttttttctttcactgagttattcaattttcaaaaataggactagtgcatgaaaacaaattaaagcat

SEQ ID NO: 255307 - DNA, 708 bp, Homo sapiens
gggagggggaagggggcgcggcatgacgttagcttgactgtcctgggtcatgttttttaatccagagtattggacatgtaacacagcaacaagagctgatcattttgtttaatcaccttttggatctttgccagatggtctctattgagagcgctgcaaacagagagagatgaactgcatctaacacgccaccagagctttcccgtaaatgtctgagaactgattccaacaagaatttagtctcagagcagaaagggatacatttaaaaactatgtgcattaactatacttttccccatagaatcctcacttggcatgaataatttacccactcttatgctaatgggatcatgaaagtatccctctgtctttagtgcagctattctcagctttcagtaattaccccacccagtgaaaataacatggcttctgcattgaacggctgactcgtacctgacaattagaaagatcatggctgacagtggaagagtctagaactggacagagaaacccttgtagcccaaggaagagcagagccatagagtaacactggccgtgagtgggaatgcatgccggtgagaagtggcaagaagggtaaaaagaaaaattctccactgtcaagcttttctttctttgacttattatcgagattttacttaaataaaaatatggttctctttcaattaccagatgtgaaagacattcatg

SEQ ID NO: 255308 - DNA, 410 bp, Homo sapiens
gactccatgtcaacaaaaatatgtatgtatacaaaaattagccaggtgtggtggcgtgcacctgtagtcccagctacttgggaggctgaggtaggtggatcacttgagcccaggaggctgaggctgcagtgagccgagattgcgccactgcactccagcctgggcaactgagtaaggcactgtctcaaaaaaacaagaggtgatgtgtgtcagctgaggcctgaaggatgtagtaaaatttaaccagaaggggagcatgaggttaaaaaggatattgataccccatcaggagtaaagaagaccagtgtgcaaactagtaagcctggggaagagtggcacaagatgaggttggggagatagaagtaaaggcaagtgactactcctttgccatcattcttagcctggtctgg

SEQ ID NO: 255309 - DNA, 1362 bp, Homo sapiens
  misc_feature (212)..(212): n is a, c, g, or t
  misc_feature (283)..(283): n is a, c, g, or t
  misc_feature (367)..(367): n is a, c, g, or t
cggttcagattcttcctcggcaagtttcatccagagggtaacggagcaacatccacaaatcacagtgaaaataggaacccgtaatgctgtggtcatctgacttgtcattggagccaaaaagccacaggcaaacattctcaaagagcctggaagaactcagggagtgccgcagccatgtgcgtgtctttaaaatctctgtgatagttacatcngggcaaagtgaatcacaaggaaaaggaaactggatattggggttgggggagggaagatgcagggaaagaangggagggggagggaatcctcacactagtgcaaaacccatggaaaggcagctttaaagggaaaaccaaatatgcttcaagttgtncttaaaatataaaaatcaagagacaggcattctctagcatgaaggacacaggcaacacagaacccatgatgcttgaaaagaaagaaaaaccatttcacaataaaatagagcctcaacatagaggaaaaagccttggaatggaaaagtcatgaaaaaaatgatgagaactgaatgcaacaaaatgtagaagactgccatctgcttgtctccactgtggtttattcgtttcagggttttaaatgacgtaataaaaagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacttccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcccg

SEQ ID NO: 255310 - DNA, 270 bp, Homo sapiens
catgaccctcatgaccatggcccaccagataaaacccagcttggcattcaaggtgctgcagagctggcccttcctcccttcactctatacacaggcacttggaggtgcctacacatctacttgcccttgccctctccttagtttggccaattcttattcatcttccatcacaggcctatgtgaagagctaggaagcccttccttagctcttcactgtgttaagtgtatttcaccacctcccattctttccacagtagaccctccctccca

SEQ ID NO: 255311 - DNA, 277 bp, Homo sapiens
gggatccctcaagactggggtgggaggtactaaaaaagcccccaccctcagggccaggcttgggtcagagccaggggtctgaggaagcctggggtttccatccttaccccaaggagacgatacagccctcctttggtggggctcagcgtcccccagagcccacccttgtcagtgttgacttagtgggactgccaggtgtgtgggggttgtgtgtgtccgggggacatgggagtggagattttaatttctaccatgataaaaatgcgagacctgtaca

SEQ ID NO: 255312 - DNA, 152 bp, Homo sapiens
gggaaagcaaacagtgtatgtagtatttctaagtgacatgctacacgttataagaatctatttttgaaatcttatacagattatgcagaagtcagaataacaaatacaacacctcaatttttttatagagtctagcgttagtttactataag

SEQ ID NO: 255313 - DNA, 463 bp, Homo sapiens
cttggagaagtcatacaacggtgaaataggaagtggaaagaaatgcatccaatttagggagggaaaaggatgtaaggaagaatgaatcagcaagtagccctgcaccatccaatatggtaaacactaggtgaaaatatttatgttttgaatataaattaattcaaagtaaaaaattaaaaattaagtttctcaggtgcactagccatttacaaagtactcagccccatgtgtctgtctagcagctattaggttggacagtgcagacatagattacatccattattacagaaaattcttttggacagtgttggagcttgtaaaggaagagagaagatggaaaagcctgaaggatatgttatgttagaggagagtctctccccacctccacaacaactcaagccctaagtgagtgtatgtatagcctgtgagtcagatatgaggtaaagaagttgtatttattaat

SEQ ID NO: 255314 - DNA, 436 bp, Homo sapiens
caattgggaaatttgaacatggagcttgtatcaggaaacgctgttgtattgatgtaagatttcttgaatgataatgttattgtagatatgtaggaaaatgttcttgttctaagaagacacatgcttaagtatttagtggtggccatatgcgatggctcatgcctgtctgtaattccagtaatttgggaggccaaggcaggaggatcacttgagcccaggagttcatgaccaacctgggaaacatagtgggaccccatttctacaataaataaataaataaataagctgagcagagtagtgcacaactatagtcccagctactttagaggctgacgtagaggatcatttgagcctgggaggtcaaggctacatgagccctgatcacacccctgcacgccagcctgagcaacagagtgaggccctgtctaaaaaaaaa

SEQ ID NO: 255315 - DNA, 525 bp, Homo sapiens
ttctccatagtataaactgtcttagtcatctttataagaagaagcccagtgtttttaccaagtaagctattcatacatgtttttggacagctgattgtataaaggattacatgagttctacaaagttcattcttcttggagtttttattcactattagaatttttttttctcaatgactgttcttttttttttttgttagaaccgcactttaactagaagcctcatgacagatgtgttgtatgtggtgctggcggagaagactggggagaaggaggggcagaaacacttgctgggatttccacagaacttctgaaaactactggggaagaaaagctagtgccccgtctccagtgtgggagaggcattgcagaaggtggcagctcatggccagcccacagcgttcttgccagttcctctagaacaggggtgtccaatcttttggcttccctggccacattggaagtagaaaaatttcttggtcacgcataaaatgcactaacactaatgatagcttataagcaaaa

SEQ ID NO: 255316 - DNA, 496 bp, Homo sapiens
aacaagctacctcgtcagaaattaagatattaaaagcaagttgcaaaactatagcatgattctgtgtgtacagttacatgtacaggttgagtatcccttatctgaaatgcttgcgttgtatttaccagttcagcatcccaaatccaaagatccaaaattcgaaatgctccaatgagcatttcctttgagcattgttgtcactcaaaatatttctcatttttggatttggggtgctcaacctgtataataccattggatatacatttgatccttgaacaatgtgggagttaggggactctgaccgccccccgcccctccccacagtggaaaatttgcatataacttttcactcccccaaaacttactattaagtgcctgctgttgactctaagccttaccaataacataaacagttgattaacacatactttgtatgttatatgtattatataccatattcttataataaagtaagctagagaaaagaatgttacta

SEQ ID NO: 255317 - DNA, 219 bp, Homo sapiens
  misc_feature (10)..(10): n is a, c, g, or t
  misc_feature (65)..(65): n is a, c, g, or t
taactatttncctagccaccggacaggtaaagagacagagactgagaggcgagacctcacctcanaccatgtggcaggacagctgccactcacctgattccatgtggcttgagagccacggagccagagtagcacttgggtcatggcagggctgagcccttcacctaaactcacacatgggtcatggcagggctgagcccttcacctaaactcacacat

SEQ ID NO: 255318 - DNA, 551 bp, Homo sapiens
ctctcttcccagtaacactcagtatgtctgcagatgcaccccttgctgtagagtataagattgccggatatggaacatttaaagtattatttggctcccaaaattgaggatgaaaaaggattttagaaattcttagaatccaagaaaataaaactaagctctttgaaaattgcttctgagattccagcgtgtactgaagtcatttccatcaaaaaatttatgcctctgaatacacaggtagatgcggttttctgtaaataacatattttttcatctatcttctagaatctatttaaagtacaaaatccaaagtcaaatctggtctcattaacctagagagatatctgctttacttacaaatattccttctgatttttataacaagagggttataaaagggatcttgactctaaatgcaatttttaagaattgtgtttctgatttaaataaagtttaatctgaattttaaatgtcagaaaagaaactactatagcacattggcagagtaattttgtcttttgaatctactaataaaaaatgcagtttgtatt

SEQ ID NO: 255319 - DNA, 664 bp, Homo sapiens
gaatagatcatttttttcagtcttagatagcaaagttcaatgttttagaaaccataatatgactttgatgccctttaaataaatacatttgcagggctgtatataaatacgattaagttaagggcatatctatttcccttttagaaaaggaaaagataactcctccctattgtttagcaaagttttagggaaaatgtaagggagttaaaggagcatatcttgtttgtttgtgtgttttggaatgtatacaaagaaccttattttattcattttttttcttttgctaataaatagttgtttgttgttgttgctttaacccaatctcaacaactgcaatagaaaaattttctaccttatgaaaatatttttaagaactacatatttggctgcagttacacaactggaaggccatgttagacggcaaaatggttttctagaacatgaaatggaatatacattgccctcatttctataaaccaggactctaacaagggcttccacatttagcaaatgtagaaaaatttctgatactagtggcattaaatcctaaagttctattataaaattaatcttcattaatctttttttgtacttcatgaaagaaacgttgattcaagtaattatttcacaattttcaggaaatctttttcccactaactttaac

SEQ ID NO: 255320 - DNA, 550 bp, Homo sapiens
tcaagtgtctataactacatcccctccacaccctactcctaacctcgaagtccaccaaaattccttcacgatcataagagaaagacccagacagtttcacagatgtttaggggtcaagcccgggggtagttgccaccttttctgccgacatttcactgaccagaaatcagtcccagggcttcagccagctgtcaaggagactgggaaaagtagtcaagctgtatttgcagagagctggatccaaccagaactgggggtttgcagaacaggcacaaagaagcaagtgaaaggcaaagaattagtgaatgtgagcgaacaggtgaatatcaaaattgacctatgaattcaatttggaaaaggcaaatgaggagaggggtgaaggaagtgaataggtggcaggataaattgactttttaaattttaaagcttatagtgctttgataatatagtaaaggttaaaagaaccatctggggcttaattacatttttaagtttccttgagggctgtcacatttgtctgagtagcaaaagcctgtataaaatagccgag

SEQ ID NO: 255321 - DNA, 458 bp, Homo sapiens
  misc_feature (63)..(63): n is a, c, g, or t
  misc_feature (232)..(232): n is a, c, g, or t
cagggcatattcatgtgtacccacttggctggacactgggagcagagtcagaaagtgggtatngaggcacttctctcaaatgactttacaatttaggagaaaatcctggttgcaatgtaattcttccagaagcaatgactaaatcagtcaattcagcattatagaaccatgcaagtgtgtgcattaagccctggaaatactggaggcattttgtggggcagcccatttgaancacattggtgctgtgcttctgtgatttggtaaccagcagccacatgggccacctgagtcaccgagctgcctaaaatccgtagtgtacaggtgatgagggggactcctgagagaagggggtgaactaggtgatggcatcctagtgagaggtgacagcgtgctggcagtggtgacagcgagcccttgctcgctctgggcgcctcctctgcttgggctcccactgtggc

SEQ ID NO: 255322 - DNA, 393 bp, Homo sapiens
ccaaatatttaaggttgaagttttattgtcaattcagtggaaattcaagtcggagtcagccataaggatgatcaacaaggtctacataagcaaccccatccccaactcacacccccaaaaaaacctgcctggacaccaagcttcagcgagctttcctggttggcaataattcatgcacagaatcacacattgctgccaggagaatgcagcattgtctattactttactgggagaggacaactgaatgcctgtgcttggaattctcctgaactctgcccatgtacctccttccttgaattattttaatctgcattcttttgttgtaaaaaatcatatcaacaaacgtcacaagtttcagtgagtgatgtgagtccttcttgggaatcataagaa

SEQ ID NO: 255323 - DNA, 536 bp, Homo sapiens
gacattcaggtgtatggatacaagaaaatttttccccttttttcactaaaccatttttatgaactgtcatattgcacagaaccctaacacagagatatattaaaacagctgttcaggctgcattagaagggctactccacggtattcttgtagaacccagtgtggatggtggcccttctgggtgagagcaatatggcactcgcactggtgcccacccccttctcacccttaccccttgggtgttcatgggatcaactctctgtgccataagagttcctccatatttagtatggaaaaccattgactcgactcacttcgttattttacctgaggcagttggagtaagtgaattaccaaaggcatgcattctcaaaaaatgctctcggtgggaagtggcaaaaaaaatcgtactatacttatatatcaagtaagatacagtacagtacataaacagatgtatttctgtgatattaaaactttatgtcggcttgattaggaaaaaatggtctcagaagcctccttggaaggcgataacg

SEQ ID NO: 255324 - DNA, 604 bp, Homo sapiens
  misc_feature (496)..(497): n is a, c, g, or t
tgggtagtaggctataccttctaggtttgtataagtacactctatgctgttttacaatgaaatcgcctaatgatgcatttctcacaagtatctacattggtaaatgatgcatgactgtttatcaaatgaaaggcctaaattttgaagtgtcactctaaaatttttgtgtgattgtttctatgctataaaaccacaataatttctggccgggcatggtggctcacgactgtaatcccagcactttgggaggctgaggcaggtggatcacctgagatcaggagttcaagaccagcctgaccaacagggagaaaccatgtctctactaaaaatacaaaattagccaggcatggcggtgtgcacctgtaatcccagctactcagggggctgaggcaggagaatcacttgaaccagggaggcagaggttgcagtgagctgagataatgccattgcactccagcctgggcaacaagagcaaaactccatctcaaaaataaanngtcgaatacaattcactgcccgtcgtttacacgtcggaactggaaaccctgcgttcccaactaaatcgcttgagacatcccctttcgcagttgcgttcgggcccccc

SEQ ID NO: 255325 - DNA, 386 bp, Homo sapiens
ctgatgaaatttctttctaggtctgctactaatcagcacttttatatctcatcctgaaagataggaagattttaaaagataaaaacattttaggctgggtgtggtggctcacgcctgtaatcccagcactttgggaggccaaggcgggtggatcacccgaggtcaggcattcgagaccagcctggccaacatggtgaagccctgtctctactaaaaatacaaaaattagccaggtgtggtggcgggcacctgtaatcccaggtactcaggaggatgaggcaggagaatcacttgaacctgggaggcagaggttgcagtgagccgagatcgtgccactgcactccagcctgggcaacagagactccgtctcaaaaaaagaaaacaaa

SEQ ID NO: 255326 - DNA, 183 bp, Homo sapiens
tcttttcttttcttttttttgaaaaacaccacaagagtgatactgtttctttttcagtgaatcagtatcagaaggtagatgatactggtttgtctcaatattggtgatgttagctttgatctcttggttaatgtggagtttgtcaggtttctctgctttaaaattactatttccgtgtttata

SEQ ID NO: 255327 - DNA, 451 bp, Homo sapiens
agaaaaaaaactaggtggctgggatatagggatgagagagattgacttttctctgtatgtctttctgtaccttttgaatcttaaatcttgtgaatctaatacataaagataatcaaaatttctgataaactagtttccagttggaaagtgtaaagggggagttagttaattgagggaagatggcataaggaatgggaagatgactggaatggctcacaggagctacttggagatggaggctcaaactctggttttcaggctaaatgtctattgcataaattattttttctgtcctctaattttaagaaaaaggcaaatgcaaatcactgttttaaggtaccacctaataaaaattcaactgccattttattaggttcaggtgaacatttctgtgggaactcagctgtctgctctcctgctatcatgctatcaggctggtaaaccacttaag

SEQ ID NO: 255328 - DNA, 575 bp, Homo sapiens
accccagcgaatactcaagttccttatataaaatggcatatagtatctgcatctaacctatgcacatcttcctgtatactacttaaaatcatctctagattagttatcactgatacagtgtaaatgctattgaaatagttgctatactgtattaaagtttttagtatttttattgttgtattggtttttttaaatcactttttttgcccctcaaatgttttcaatctgcgattggttgaattctcagatgtggaacccatggaagtggagggctgactgtattcacagagttgtgcaactgttaaccactatataattttagaaccttttcaacatcccattgtaattgatagcaatcacttcccatttcctctcaaaccccgcagctcctgacagccattaaactgtgttctgtctctatgcatctgcctgttctggacatttcacatatctggtcttttgtgtctggcttttattttagtatattattttcaagattatcaaattgaagcatgtatcataagtattgcatttatttttgtggctgaataatactccattttgtagatctatca

SEQ ID NO: 255329 - DNA, 282 bp, Homo sapiens
cacgagggtgaactcagttaggaactttcttctttatcctaagggcaataggaagcctaggacggtatttaagcaaattctggttagcagaagggaggctggatcctgctaaggactgggaatgtagtgatggatcagaccaattcctgggccttgtcagcaaggaaaggactgaaagagccgcagacaaaccagcactcacaatacaatacactcagtgcaacagcggagaggtctgcgagggctatgatggaatcccataggagggctacctaatcttgc

SEQ ID NO: 255330 - DNA, 376 bp, Homo sapiens
acatattggaaaagtagcaaacaaaatattatgctattgtgttaaattaaaaattatgcagaaatgttcttagtatttcatcaggagagaggtcatttgaaattgatggaatagaagaaggcctgggaagatatacagaactgaagccaggcagtggagaataggttgggatttaaatgaacagatggggaaaggccattctgagaaaaggccattccaggcaagggttacaacataaaaggccacatgttgtcacaggacaccaaagcaagtgaccagactagagtgaattactgtgggaggagcagagagaaatattagatagctgatcagtagagtatgattgtttatattctttaaaaagattagacttgcc

SEQ ID NO: 255331 - DNA, 444 bp, Homo sapiens
tgctcctctaataccaggccttttccctctcagtgcccttgtaattgctgttccctctgcctaaatcaccatggttggaaatacaatcttacattaaacctggaggagagagacttcatcctgttgcttttttaagtgccttttattggtgaagaaatgccatggtactgaggatgggaaattaagtttcaaataacagaatgtgtttatactagaagtagcaagtccaagcattcacacctatgccagatgaaatactgtttttcatccacctacctgccattcttgctcatttatatctcttctatatgaagcagtcctgtcctttagatgaggtgggaatttctaggagactctctaatgccactaaagtgttcatttcatttggctccatttttgttcctctttactaccttttgtgattgagggtgaattagagggcag

SEQ ID NO: 255332 - DNA, 457 bp, Homo sapiens
aaggtgtacagcttaagttttgacatgtgtataatcccatgaaatcatcaccacattcaagatagtgatctatccatcattccccctcaatttctttgaacctccttgtagtcccccctttccttccctctttctgcttccatccccaagcgactactgatctgtctgctgtcactgtagattagtttgcattttcttaaattttgtataattggaaacataagttatctacttttgatttttgccctggctttttttagtgagcataactattttgagatccatccatgttgttgctagtgtcagttgtttattcttttttttattgccaagtgatatgccattgtatagatatttcacacattttttaaactcttcacctgttgatggacattttagtttccagttttgttgtacctttctattacaagtaaaactgctgtgaacattcatgtaa

SEQ ID NO: 255333 - DNA, 553 bp, Homo sapiens
ttaatccagacattggtggctggggtggcagaggcaggactggaaggggcattgaaccatggagttctagtctcctggagctgaaacaacctttaaggagaaactgaggcctggggcagaggtagggaggactcactgaaggtcatgcaatgcaccccctgtgagttcctggtggcatcctgggtcaccttggtgaaagtttgggaactctggcactagcccctggaaaaacagtaaggtataaacagatatgacccacattctcatggagcctggggcctatttggaaaggagggtggagagacaggtctatgaaggaaatcacaatgaatcgtcagcaccacctcctccaggaagtcctccctgatttcctaggccgggttgtgtttctgtcctcagaattcccatggaacctacagtgacatctgtcaccacagctgctgcagtttattgaaatgatctgtttatatgtttgtagaatcacattccctagagtaagaaagagaaagaattttaaaatatatatatagaataaacacataactcacctgca

SEQ ID NO: 255334 - DNA, 378 bp, Homo sapiens
aaagaattaatggcacatctcatagttctttcatttgctggctgattcattccagagtggttttgaggacagaatgaagcaagatgaaaaacagcactttgaaaatggagtgtgtggtattcatcttagatacacttttagagaagaagaaatgtgtctcagaaaaaggacctcttctgactcaaatttagcttacatccccttctcaaccatatcccaggtgataaaatatgacacccaggtaagcagtggccttgtggactctgaagaagttcttaacgtgtccacggcacattctcattttgtctggctctaaactactgtctcaagaaagctgcaaatatttgaaagtaacaataaagtgttaacagtaattct

SEQ ID NO: 255335 - DNA, 729 bp, Homo sapiens
tggatgcgggacatgaaatcaagaattattttggagcttgaaggttttatgtttgccctactgggtttcagatttgcctgaggcctgttgcccctttcttttgcccaacttcgccatttgggaattggaatatttacccaacacctgtactgcattgaatattggaagcaaataacttggctttgatcttataggctcacagatggaggaacgtaccttgaagttcagatgagatttcggacttttgagttgatgctgaaacagcttgagatttttggggactactgagagatgataattgtattgtgcaatatgagaaggacatgagatttggtgggcataggtgtgaaatgacattgtttggatgtgtttaccctccaaatctcttgttgaatgtgatcttaaacgttggtggtgggcctagtggaaggtgttgaatcatgggggtggactcttcataatttgcttagctccatccccttggtgatgagcaagtccttgctctgttgtgtcacatgagagctggttgtttaaaacagcctgccgtgttccccttcttgctattcatttctctcttgacacgtgatacactggccctcactttgccttcctctgtgattggatgctttctgaggtctcacccaaacctgagcaggtgctggtcccatgcttctactgcctgcacaactataaaccaaataaatattttttctctataaatttaaaaaa

SEQ ID NO: 255336 - DNA, 484 bp, Homo sapiens
taagagcaggactcccctcaaccccgggcatgagttgagggttgaggggttcccttaactggtggatgcttattcactgtttactggatgaatgaagtataaagtgtgggaagtcaacaacagaacagaacttattttcaagaagataaattagagaatgcaaaaaagctacagactaaggtagctaagttaaccgaactctctaacagtattgaaaatagcaattctttactcagaaaattctaaagggaatacttaatttgacagaactcctaataaagacattgtagccagatccagagccttccagcaagtgacactcagcaaacatttgggacagctgagagaattcaacaaagcccataccgttgtctcttgtataacatctcctagtacattcacctcagatcattgttagtcttacttagcagaaaatgtataaacacttaccaggtagtaaaatcaaatatcttggtataaatgt

SEQ ID NO: 255337 - DNA, 413 bp, Homo sapiens
tcacttcttagcttttcttaaacactctatatttcacattgtaaaactcttacacaaaaccttaccaggtagctactgtgaattatatattcccaaatacaccttgtccttttccagctcttcactagttttaactttgtcccaatccatttaaaaattctcttctgaaaggcatgctcaaatgcagctctaccatgaagacctcaatgattatcctcctcttaaataccttaacccttgtctataacaattgtactataaaagtgaaaattgttacaattttaaataaaattgttactcacaactttaaataaaattattactcaaaagaagctcctcctggacagcaagaaatgtacctgttatatcttagtatgtcactgtgatattaaatatttattataaataaagga

SEQ ID NO: 255338 - DNA, 952 bp, Homo sapiens
tcatttgacagatgggggagaaatggaggcacaaaggatttgtcacttggccaaggtcacaaagcagactcgaagctggtcctgtgacttgctcttgcccctgtgcttgtccttttgggagaggctttatctgttcatggaagtcaaggatgtttccttcaaatattttcccctcagcccctgcttttgaggatctgcactgggggagggagaacatttcttctgtggcttctcatgtctgtgggacacacagttcgtgacgaatatgaaataaaatggaaatagctcctgcatcctcccacacagacgagctgagagtctgcctctgatgtgagagccagcatggaaggagcgatggctctgactgtccccttctccttagttcccaactgccaagccaggaatcagacctgggagtgcaggcatgaagctccagttaggcaggccccagccttcctgcagcatgacttatgtctggtacccctgcgggttgcattcctgctacttctcataaggtagacacaaattggaggcctcctcgatggcaggcagtgcatgaggaatgctgggatgctgcagggtgctgcacatgtttcctgccttcggtgagctcctgatctactaccaaagtccgcctctgtcactcctccctacgcatcataggttggactcgagagcctgcagatttcctttaatgtcttcctgggcagagcaagttgctaagctggggctccagtccacaatcatcaagtgccacagaacaaagctgtgaggtcagttgtagcagagatggcttatgtgtccaccaaagcctacatcgtgggaaaacagctagactaaccagccatgcaagttcgggactaaccagccatgcaagttcggactaaccagccatgcaagttcggactaaccagccatgcaagtactggactaaccagccatgcaagtttcg

SEQ ID NO: 255339 - DNA, 503 bp, Homo sapiens
ataatccccacgtgtcgagggtgggaccaggtagaggtaactggatcacgggggtggtttcccccatgctgttctcatgatagtgagtgagtctcacaagatccgatggttttataaatagtgtctggcatttatcctgcttgcactcactccatcctgccattctgtgaagaaagtacctgcttattatttgccttccctccatgattgtaagtttcctgaggcctccctagccatgcagaactgtgagtcaattaaatctctttcctttaaaaattacccagtctcaagtacttcttcatagctgtgtgagaatgaactaatacattccatgaacaagatcttatttattgctggaaattttacttaagtcatatttctttttgaactcatatttctatccccactgatttttatcctacataataaattttatgcttgaaagtctttgtattgatcatatttctctgcaacaaggaattgtatctaaagatggttttaaa

SEQ ID NO: 255340 - DNA, 662 bp, Homo sapiens
aacttttctcgtgtgtgctgtgtactatttgtgagtgagcaatgaacgctgtggctccctggaggggctgtggtgggaagtttcactgcgatcaagtagaggtggtgcctttggacctcttctcctgaacctgcagggagaggcgcagaatattcacaaggtgaagatgcaacaattcaaatgagtgtccaggttttcagggtggttgctaaaccccaaaagaccgatagcttcgggcaaaagactgcagaaagaacagctttacatttttacggaagcaatgggaaatataccctgtaagccttgaaaaattcccgaagggattcctgttcattcctgtggatcctaatgggccagcatagacctgttagtcaaaagaggatttatctacattgcacactcattcaggcaggcagggaagtcaacgccactttcagatgtttgtagagcatgaactctgtccgttcccacgccctccaaaggctgttacacagggatgcccgcttctggacagaagtgattcatgcaggatgagaaccatgaccacagaagattttgtgcatgtggttatttcaatatttaatttaagtgtatgcatgagtgttcaggataaaaatgcttggagtgtactttaattccattaaaaatgtatacattattca

SEQ ID NO: 255341 - DNA, 468 bp, Homo sapiens
aacttttctcgtgtgtgctgtgtactatttgtgagtgagcaatgaacgctgtggctccctggaggggctgtggtgggaagtttcactgcgatcaagtagaggtggtgcctttggacctcttctcctgaacctgcagggagaggcgcagaatattcacaaggtgaagatgcaacaattcaaatgagtgtccaggttttcagggtggttgctaaaccccaaaagaccgatagcttcgggcaaaagactgcagaaagaacagctttacatttttacggaagcaatgggaaatataccctgtaagccttgaaaaattcccgaagggattcctgttcattcctgtggatcctaatgggccagcatagacctgttagtcaaaagaggatttatctacaagaacatcattgagaagctgcaggacatcatcacagccctggaggagcggcacatgcgctgggagcggcacatgcg

SEQ ID NO: 255342 - DNA, 454 bp, Homo sapiens
atgacagtgtgaccagaatggaagaaatgcatgaaaaagaatttcagcgggaagaaactgagcttgcctgggagttggcagatctcttattggcacagtacacaccatcatttgtgttacttcagttggatcctggctaattctcacaagaagaaaacatgtttcacaaaagaaagatgaaatcacagaaacatttcttttctagaggctctaagggagaattcacagaactgtagaaagaacccactaaagttagagacgagcctcaggcctatttttcagtttctttttattttctatttttcagtttctaggtgaaaatggctgcttttctgtgacttaagtttttccatttatatgaagtgggactgatttgctcagtaggagtaatagaagtataaaaatcataaatgtgaagcaaaaagaatacaacacctatttggaaaaagtacca

SEQ ID NO: 255343 - DNA, 462 bp, Homo sapiens
gagcagcaaagagaaagagcctggatggtagagtgtgaaaaggggggtggttatggctgcctcctaagccatttggtgaaaagactaggctgtgaaaggaaacggaagaaattcttgatggctaatgctgggtggtttttatttctaattattccttataacagctcataatgattagaatgccatatggagctggagttggggcttcacttgtgagagaataagctccccttcttaatctatgccatgtctagggaggctagctgaagactttttattttttatttttaattcttcctttatctttgctccagcaagaatcaaatccagttaccaaaaatgtatttacttcagccaacctggggttacagaatctttaaatgaaaatgttattgcttggctgggcgcgatggctcacgtctgtaatcccagcactttgggaggctgaggcaggcagatcac

SEQ ID NO: 255344 - DNA, 336 bp, Homo sapiens
catgtgcatgtgtaggattaagaggtgggtaatgaaaaagaagacaacatggccaggtgcagtggctcatgcctgtaattccagcactttgtggggcgaaggtgggaggatcacttgaacccaagagtttgggaccagcctggacaacatggcgagaccctgactccacacaaaataaaaaaaaatcagctggtgtggtggcgtgtacctgtaatcctagctgattgggagggtgacatgggaggatcacttgagccaggaggttgaggctgcagtaagccatgatcacgccactgcactccagcctgggtgacagagtgagaccctgtctcggaa

SEQ ID NO: 255345 - DNA, 678 bp, Homo sapiens
atgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcagagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaa

SEQ ID NO: 255346 - DNA, 325 bp, Homo sapiens
cagatggctgtttgaaaaaatgctaagaaaattctattcagtgtcaggtcagaaagatatttcaggctgacaccttgtaacactgtgatatcagaagaccactgcaaatccacacctctgtatcaccttagatgtaaaagagatattgttaaatatctacttgagcccttcccaaaaaaaggatttcacagaaacccaatctgacataaaatgataattctgacccagatccccttatggtcttacacagtcaagcataaagcaaactgtttcattacggacaatttcagatcacgatgccagcattatttatttggtccacatc

SEQ ID NO: 255347 - DNA, 751 bp, Homo sapiens
tgtaaaaccggctcttggggaggcagaggcaggaggacagcttgagcccaggagtttcagacctgcttgggcaatacagcgagaccttgttcttgaaaaaggaaagaaaatgaacaggcaagccacagactggaataaaatatttgtaaaacacgtatctgacaaaagatcagtatccagaagaaaaagtcaagcaacccaattttaaaatgagcaacagatttgaaaagacatttcacaaaggaaaaatatatgaagagccaatcatgaaaatgtgctcaaccgcattagtcatcaggccaaagcaaattaaagccataatgagatgataccactacacgcccaccagaatgactaagatttcacagagtgacagcaccaaatgttggccaggatgtggagcaactagaactcgtatccattgctggtgggagtgtgaaatggaagggccactttgggaaaagatctggcagtttcttataaaactaaatgtatacctaccctatacctactctaggtgtttctacagaataaatgaacgcccatatgcacagaaaaacttgtacaagaagaaccagcgtaacaggtttactcataagagcctccagatggaaacagccaggggtctttcaacaagagaatgactaaaaacccacagaatgttcacacagtggacgttactcagcaataaaacagaacaaatcgctggcacctgcagcaacatgggtagctctaagaaacactcaaactg

SEQ ID NO: 255348 - DNA, 500 bp, Homo sapiens
agggaggatggaggatgagggaccatggcaaggttgagtccagtgtgatgcctcctatgtagagagaccccatctgtgggggggtcatggctgcccacctcatggtggttctgatggcaaatgggcaaatgtagtggtgatctcagggcaagtgcaggcacagtcagtgctcaggaatggcagcctatgagctggctacatttctcttaaaatcaccaatttcattgttgcccagcatgccatcagcctatagagtcaggtgccccagatattaaatccctgttaattaagagggtcaagttataagttcattcaccaaacacttggtaagcaagtctgaagtaacagcatatgcaagcgcaaggagcacaaatattataacctcttacaggaaaataaacacacaaaaaacatacaaacaggtccccattaatatggccccaaacggctaatggagattcattcttatctaattattaaaagggttgtttgtcaaaaaa

SEQ ID NO: 255349 - DNA, 3236 bp, Homo sapiens
agggagggagcgagggagggagcgagggaagggaaaggcgagcgtgagctgcctcaaatgcttggaataattccgcttccgtttggaaagccgcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataa

SEQ ID NO: 255350 - DNA, 1647 bp, Homo sapiens
agggagggagcgagggagggagcgagggaagggaaaggcgagcgtgagctgcctcaaatgcttggaataattccgcttccgtttggaaagccgcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgcta

SEQ ID NO: 255351 - DNA, 358 bp, Homo sapiens
tgttcacgaggatcttctcggaccagttgtgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtttctcgaaaagcttctgcacaacttggggtaccga

SEQ ID NO: 255352 - DNA, 169 bp, Homo sapiens
gcggccgcctactactactactactgctcgaattcaagcttctaacgatgtacggggacatgtctttgctcttagaattgtcactcagcataatgagcatttaacatacaaaggcaatgtactgttttgtgttgatctatgtaaaagaatacaattcttttttacataa

SEQ ID NO: 255353 - DNA, 4144 bp, Homo sapiens
gcggccgcctactactactaaattcgcggccgtgcggatcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttacttaatgttatatcttggatattgtattaccctgggtattaaaaagaactcctttcacattttaaaataacaatctgagcacttcataaatccaaatgcgtatctccagtctgctcgagctaggatatagcggatacgcaccttgtcaaaggaggcaactacgactacgacaacgaattcaaacgtaggctcttgtacaatcatcgtgactagggattaccggagac

SEQ ID NO: 255354 - DNA, 3959 bp, Homo sapiens
gcccggcggtgaatcggccgaggcgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttacttaatgttatatcttggatattgtattaccctgggtattaaaaagaactcctttcacattttaaaataacaatctgagcacttcataaatccaaatgcgtatctccagtctgctcgagctaggatatagcggatacgcaccttgtcaaaggaggcaactacgactacgacaacgaattcaaacgtaggctcttgtacaatcatcgtgactagggattaccggagac

SEQ ID NO: 255355 - DNA, 4236 bp, Homo sapiens
tctgcccaatcaagccactcccaaaatgttatcttcctctcatcagcactgaatctcacccacactaaaaacaccaaaaacaaaaatcctatagatctcttaccaccactcaactactctccaccttcccaaactatctgaaagtagcaggttcatacttgagttttctaaaaattgtattttatttttgacattttcacctccccttcatgcctcaactgccacctggcttctctacctcttcgctatccccagtctactccagcaccctccactctctattgctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttacttaatgttatatcttggatattgtattaccctgggtattaaaaagaactcctttcacattttaaaataacaatctgagcacttcataaatccaaatgcgtatctccagtctgctcgagctaggatatagcggatacgcaccttgtcaaaggaggcaactacgactacgacaacgaattcaaacgtaggctcttgtacaatcatcgtgactagggattaccggagac

SEQ ID NO: 255356 - DNA, 3260 bp, Homo sapiens
agggagggagcgagggagggagcgagggaagggaaaggcgagcgtgagctgcctcaaatgcttggaataattccgcttccgtttggaaagccgcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataaaaaaaaaaaacccccccacacacg

SEQ ID NO: 255357 - DNA, 3118 bp, Homo sapiens
gtgctctcccacaagtgcaagagacaggaataagcaggtaaggcagttcggaggagggtccagtacgccaacagcaagaactcttgggcagtggtgggcccaggcagcccctcactccacgttacggtacttggtgaagaggttgtacaacactcgtagtgtagatttcaggtcacagttgactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttacttaatgttatatcttggatattgtattaccctgggtattaaaaagaactcctttcacattttaaaataacaatctgagcacttcataaatccaaatgcgtatctccagtctgctcgagctaggatatagcggatacgcaccttgtcaaaggaggcaactacgactacgacaacgaattcaaacgtaggctcttgtacaatcatcgtgactagggattaccggagac

SEQ ID NO: 255358 - DNA, 2270 bp, Homo sapiens
agggagggagcgagggagggagcgagggaagggaaaggcgagcgtgagctgcctcaaatgcttggaataattccgcttccgtttggaaagccgcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggcgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttacttaatgttatatcttggatattgtattaccctgggtattaaaaagaactcctttcacattttaaaataacaatctgagcacttcataaatccaaatgcgtatctccagtctgctcgagctaggatatagcggatacgcaccttgtcaaaggaggcaactacgactacgacaacgaattcaaacgtaggctcttgtacaatcatcgtgactagggattaccggagac

SEQ ID NO: 255359 - DNA, 465 bp, Homo sapiens
gtagccatatttctccttgaaattagttcagcctctgtccctctggctacagtgctgggctccttcacttcccagggccaggtcctggggctcctgggtgtgcaatggtacatgctgtctgcatctctcttgccaggtcttgaatgtctcctttgcctttgagctcatgcaagatggagggttggaaaagccaaaaccgcggccagaaggtactttgctctttcctgggtttgtgacaacagagtgagaccctctccctgcacatgagtactcagattttgtagcagagggaagcattttctgaagccttcgttgctggggaaggtgggactcggtgcagctgctcagtcccagagaccctttgtgagctgccagctgcacagccaggggaagaaaagaatctgaaatcccacacatgccatgcgtgggatcgcggggatcagggaccgagcagaactgctgctg

SEQ ID NO: 255360 - DNA, 3440 bp, Homo sapiens
  misc_feature (1510)..(1510): n is a, c, g, or t
  misc_feature (1849)..(1849): n is a, c, g, or t
  misc_feature (1986)..(1986): n is a, c, g, or t
  misc_feature (1992)..(1992): n is a, c, g, or t
  misc_feature (2017)..(2017): n is a, c, g, or t
  misc_feature (2281)..(2281): n is a, c, g, or t
  misc_feature (2283)..(2283): n is a, c, g, or t
  misc_feature (2285)..(2285): n is a, c, g, or t
  misc_feature (2287)..(2287): n is a, c, g, or t
  misc_feature (2578)..(2578): n is a, c, g, or t
  misc_feature (2585)..(2585): n is a, c, g, or t
  misc_feature (2641)..(2641): n is a, c, g, or t
  misc_feature (2648)..(2649): n is a, c, g, or t
  misc_feature (2690)..(2690): n is a, c, g, or t
  misc_feature (2694)..(2694): n is a, c, g, or t
  misc_feature (2727)..(2727): n is a, c, g, or t
  misc_feature (2756)..(2756): n is a, c, g, or t
  misc_feature (2810)..(2810): n is a, c, g, or t
  misc_feature (2836)..(2836): n is a, c, g, or t
agggagggagcgagggagggagcgagggaagggaaaggcgagcgtgagctgcctcaaatgcttggaataattccgcttccgtttggaaagccgcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcggtaggagagttgagtgctgcaatggatgtgtgtttaattgcaggtggttggatcacctacttgtagctagaaggagttattctcagtttacagtggcttacctggaaatggattacaaatgtgtggagcatggaataacagctcagtgaaggctttagatgtcctcttggaatgtttcatatgaatgaattgtagagggagtctccatgactaggtgggcctgctccttctagcagccaagaatcatcagctagatgaaaagaccccactgtatattaataactagaaagcacgcctccgcctctccagaaaagcatgcctgtgtggcctctgtcggtatatttacatgcatgggcctgagtatgcatttttagacctctgtcaccttcagatgcatgtgtgtgtgttcctctgtcatctgtggacttgtgtgtgtgtgtattcctccctgggtcactttgcagctgttcatgtgaaaatgtaaggacaatggggagagaaaggagaattcaggggtaatgttagtgttgaaaggacaaatttcagcttgaatggagttaaggtgtcccccactgctcctaatctaactgtggcccaaaccgtcccctcagattctcgacttcaatccttagctgccctctgggcacctctacctgaatctgctttagactgaattcatccacttttctaaagctgtttcatcccctctgagttcatagaatcctctcccttcctcctctgcccccatgtatacagggatcagcaagacccatttctacctctcctgaatacatcctctgccattttgacttctctgaactattgaaaaaacttccaaactcacttctttgcttcccatctcacctcctccaacctattccctacacagctagcagaggaaacttttaaaatcacaagtccagtcttgcctgnacttatttataactcttagtgcctctctcctgctggacaaagtccaaaccccttggcacaacattcaaagcattccatcatccgatgacccccagctgtctccttggtctcacccacacatgtggctcatccgtgtagtaatacgtgtaaagtgcttaggatagtgcctgacacatagtagatgctcgataaatgtctgtcatcattggttttactattttttttacataccattgctgcatttttatatatgccacacatattaacatgcctgtacctttgatcatgctagtccttctgcctctaaggcctgccttcctcctttacccaccagggganaccattattgctcatccttctgatctctagaattaatcaaattaatcaaatgtgcctccctattatagcctttacagtactgtcacttttttttttttcttgagacagattctcgctgtcacccaggctggagtgcngtggcntgatcttggcttattgcagtctcgncctccagggttcaagtgaccctcctgccttagcctcctgagtagctgggactacagggcatgtaccatcatgcccagctaatttttgtattttttctggagacggggttttgccatgttgcccaggctggtctcaaactcctgggctcaagcaacccgcctcagcctcccaaagtactgtgattacagcagtgagccactgcgcctggccctatagtcacatttagaaaagatagtcatatacttttttttgtgttcctccccncncncncacaaatgtttctctctctgagggactatatatacacttgcacatatgtgcatatatgtataggtgtgtagatataaacgtgtacacacatatctgtatacatacatgtaagtatatatacatgccttattataagactttccatgtcatctgtagctgtttaggtaaatgtgtataggcttcccaagggcacgagccatgtcctatatattatccaggcttctccagcaccatcaggtgtctagcatatgttgcctagcacttaatcaatgtatattgaggctgggcgcngtggctnatgcctgtaatcccagcattttgggaggccgaggcaggcagatcacctgaggtcangagtttnngagcagcctggtcaacatggtgaaaccctgtctctactaanaatncaaaaattagccgggcatggtggcgggtgcctntaatcccagctactcgggacgctgaggcnggagaatcacttgaacctgggaggcagaggttgcagagagcggagatcacgccnttgcactctagcatgggggacagagnaagactccctctcaaaaaaaaaaaaaaaaaagtgtattgaatgaatgaatggctaatgtaatttctaggaagttaaactgatttggttctcagacatcagtattaatgagtgttaatatttaaaggcttgtaaactccaactgaatacagagaggaaatgaaaaagcttcggcacatgaagacatggctaagccgggagcctcaccacgcatctgtcccagtgactacagcttttaactcctccagcagacatctagtcaggatctgaaactgccaaaatgttctatgctaggctgtcaaagcaaggtagaacatggccacagagtaatggaacatggttgtggaggaatcttgcctccaggaatggttacaaaaccatccagcatcacatctatgcaaccccacgttaggcattgcgtacaagcagattagatcatttcacatttcacccttcatgctgaaaaggtgattcactatggaggtgatgcttcttttgtgaacttaagtttagaccctaatctcaaaggtctgaggcagggcatacacattcaaagcccataatgggtaggatactcaggtggagggaaccagtttgcggtaaaaa

SEQ ID NO: 255361 - DNA, 4330 bp, Homo sapiens
agggagggagcgagggagggagcgagggaagggaaaggcgagcgtgagctgcctcaaatgcttggaataattccgcttccgtttggaaagccgcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttacttaatgttatatcttggatattgtattaccctgggtattaaaaagaactcctttcacattttaaaataacaatctgagcacttcataaatccaaatgcgtatctccagtctgctcgagctaggatatagcggatacgcaccttgtcaaaggaggcaactacgactacgacaacgaattcaaacgtaggctcttgtacaatcatcgtgactagggattaccggagac

SEQ ID NO: 255362 - DNA, 4311 bp, Homo sapiens
gcagcatgcacgtggctagaaacagccaccctagttttgattgcgaatgatcatcagtcacgagcacaacttctgacaacagtctctccagcttagtgcagtcttaactggggccagctgatcgtctgctcttcagtaaagcagtagcgccctttggattaggtgttcacccaggttcaatcagctgtggcctagaaggggccacaaggaggaaacacagttgccaaggtgctgtgagtctgtgtgtgagagacagacagaaggacaaagagccagagtgagaacttgagatggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttacttaatgttatatcttggatattgtattaccctgggtattaaaaagaactcctttcacattttaaaataacaatctgagcacttcataaatccaaatgcgtatctccagtctgctcgagctaggatatagcggatacgcaccttgtcaaaggaggcaactacgactacgacaacgaattcaaacgtaggctcttgtacaatcatcgtgactagggattaccggagac

SEQ ID NO: 255363 - DNA, 3644 bp, Homo sapiens
cgagctcggcaccccgactccacctcagctcctgctccctctgcatcagagcccttcctttcttgggggatgggccttgccctcttctcttttcccttcctgtacctttgactaacgctcagcttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttgcatgttctaaagttgtgtatgtgtgtgcacatctgagcacgtgcacatgtacacctgagccaaaaacacgagaacccactgatctcaccactggggcaagctaggtcagagcttagtgattcacactgaaattggcaaattggatttaacccaattaatagtgtgtgtgtggcaggagtcatgtccctcacatcctttgtacaaatgaaaattactcttaattccttcagatttataataactctgtactttggtttcagggtgacatttgggaaggattttgtttagaattaatggagtggcacattttgcagcctttttgcttgattgcatgtaatggaaatgccctatattttcctgcaaaataagtactaaattcattatcgttaagcaaatgtacaatatgctcaggcaccgcagagagctgggcacgggcccatgtgagcatcactttggaagtagggctcttcaacagggacccttgaactttaaagaaaggaacttctttttgccttctaattgatcatttagactattctggctaagtctgcccacatgtaattaccggctaattcaagcgaggaaaaatgtaagtcatttagaccaaagccaagcagtttctttgcgtgggttactcaagggcttgtggttacttgtatctcctctatgtgaacttgactttgaaagacagagctctagtgtgccagcctgctaagtcctgtaagaatagggaagggcggaggggggtgggcagtgactaggggacgagaagcatggggaaaatatttgcactctaaacatacagagatagaggtggggcttgtggtacttaacacttgtagccatcaactgactgagaccttgggctaaataatcaattgtgctgatattacatctcgttatggaatgttcctaaatatgccaggtagacaccagcccaagtaccctcctccagaagtctgtgactaccttgtcactactttaggcccattccacaaagcccatctctggtttgagaattcattttgatctgtatctacaccacccaaagttaggcctcctataatgtccaaaacattcctttcagcctttttatttcttactgtactgtctcttactgtactgtctatctgcagtaattgaggacccataaaatttagataactacatgtctttgctcttagaattgtcactcagcataatgagcatttaacatacaaaggcaatgtactgttttgtgttgatctatgtaaaagaatacaattcttttttacataattagtgaaattttattttttattaggaaacactaaatagtgtaatatttcttttgcttttaaaaaaattcctggtagcaaatcaagataaataattgcttcattttcttgagcaatactgaagcaggatgaagtaagaggaatgcattcatttaaacatgctttgctttatgaattttgtctcttttttggtctctttttcttatattcaagttacaaatgtacaagtatccttactaagagtgctccttttgtattttacatatatacagtatgaaaatacattggaacactaggaaagtttttaaataacagttctaatttatcagaaaattgtgttttgggattgagttctttgtctcagcccagaatcccaggtcctgggcctggttttctaatgctgtcatctcagttcgatattttactttagaacctggaatctcctacttaatatatgaccatgactttgaaaggcaaaagaggaatcaagaataaataaaacaaacttaatcttcatctttaaaaaaaagaaaaaagaaaccaaaatgagaatcaacacttcataggctcactgggttttcttttcttttctgttaatttaaactcagttatttttaatgcttaatacatacatggtgcaaaatttaaaaagcgcaaataggtatctagtggaaaacctaagcctccctctctcctccggcacccattacctctccctggaggcaactgttttgatccatttcttacacacactgccagagatactctaggcatgtaaagcacaaacatacatataaaatctgcgggcttcaaaaaatataagtaggatgtcatctatactgtcatacactttgttttttatcacttacttaatgttatatcttggatattgtattaccctgggtattaaaaagaactcctttcacattttaaaataacaatctgagcacttcataaatccaaatgcgtatctccagtctgctcgagctaggatatagcggatacgcaccttgtcaaaggaggcaactacgactacgacaacgaattcaaacgtaggctcttgtacaatcatcgtgactagggattaccggagac

SEQ ID NO: 255364 - DNA, 2594 bp, Homo sapiens
agggagggagcgagggagggagcgagggaagggaaaggcgagcgtgagctgcctcaaatgcttggaataattccgcttccgtttggaaagccgcagcctcagtcccgccgccgcccgctgcgtccgcccagcgccagctccgcgtcccgaccggcccgcggcagcctgcgccgcgccatggccacctccccgcagaagtcgccttctgtccccaagtctcccactcccaagtcgcccccgtcccgcaagaaagatgattccttcttggggaaactcggagggaccctggcccggaggaagaaagccaaggaggtgtccgagctgcaggaggagggaatgaacgccatcaacctgcccctcagcccaattccctttgagctggaccccgaggacacgatgctggaggagaatgaggtgcgaacaatggtggatccaaactcacgcagtgaccccaagcttcaagaactgatgaaggtattaattgactggattaatgatgtgttggttggagaaagaatcattgtgaaagacctagctgaagatttgtatgatggacaagtcctgcagaagcttttcgagaaactggagagtgagaagctaaatgtggctgaggtcacccagtcagagattgctcagaagcaaaaactgcagactgtcctggagaagatcaatgaaaccctgaaacttcctcccaggagcatcaagtggaatgtggattctgttcatgccaagagcctggtggccatcttacacctgctcgttgctctgtctcagtatttccgcgcaccaattcgactcccagaccatgtttccatccaagtggttgtggtccagaaacgagaaggaatcctccagtctcggcaaatccaagaggaaataactggtaacacagaggctctttccgggaggcatgaacgtgatgcctttgacaccttgttcgaccatgccccagacaagctgaatgtggtgaaaaagacactcatcactttcgtgaacaagcacctgaataaactgaacctggaggtcacagaactggaaacccagtttgcagatggggtgtacctggtgctgctcatggggctcctggagggctactttgtgcccctgcacagcttcttcctgaccccggacagctttgaacagaaggtcttgaatgtctcctttgcctttgagctcatgcaagatggagggttggaaaagccaaaaccgcggccagaagacatagtcaactgtgacctgaaatctacactacgagtgttgtacaacctcttcaccaagtaccgtaacgtggagtgaggggctgccctgggcccaccactgcccaagagttcttgctgttggcgtactggaccctcctccgaactgccttaccctgcttattcctgtctcttgcactgtgctctcccacaagtccagctgcaacccagagatagtggaaactgaaattaggaaggaaatcatcaataactcagtgggctgacccatccctcccaggcgctggggaccaacctagcaatgaaggttgggaaggttgttcccttcccggtgccaggtccagatttccctccatgatttgggaaccagcttaggcaaaagagtccccacaagatgaaaataaagatcctagttaccattcaaaggatgctaactgtgtgtcaggccccacactaagtgctctgctctgatatactcaaggccattaatcttcaggactcccattgacgtaggtgtttcattccccttttacagatgaggaaactaaggcttggaggttaaatgacttgccagaagttggaatttttttcctctttgaacataacctctcccttctccctaaaggtaaccactattctgagtccaatcatcaaggttttgcttttctttttagctaagtatgcattcctcaatagtagacagtacaacatgtttataacaagccaattacattatgttctttacaaaaaaaaaaaaaaaaaaaaaaaaaaatttggggggggccggggcccggaaaaattttaaaccctttggtgggggggggggccccggttaggttaagtcggaacatctgcggctctaaagcggggtccccccaagagaaacatcgcggcctaggacacaggcggtgcggggttttctccccaattaaaaaaagcggcgcgggggcacacgcgcctttttgtcggcaccaatccccgatgggggttcgcggaagcccaacggggtttcttaccaccagggatcccaggggaactcgttaatcaatagcggcgcgtggtggaatacacaaactaacacaacagccagctccatcccgagaaacagcgcaccaacacgcggataacactataacatcaaacacagaagtcggtaacccatcacacgcacgaaacacaactcacgccggcaccgaaaaaggcagcaaaacacgtaacaaacgtgatcccacaccgcacaaccaccacgccaccaacccaggatagacactacatagactatcctaataaaagatatgataagcacacttataggcataaacagagttacaaataatacgacgaacatatatcatactaacgagtataagaatgcttgga

SEQ ID NO: 255365 - DNA, 308 bp, Homo sapiens
cggcgtgttgacaagccttcattcatttactcatttcatgttcccatcagttgctggggtgggagcagataactgtgtctgttttatcttcatgtccctagcacgggacaaagggcggtataagtgcccaagaaatgttgcagtaaacgaggctatcaggctctttcccagggactcgctgtggctgggaccaggctccctgttgggcactgcaccaaggttagctgatttgaccttcataatggcagccctgtgagagaaaagggatacctgaagttacagtacaagttcatggctgaactcaaact

SEQ ID NO: 255366 - DNA, 427 bp, Homo sapiens
cggatcacgatgacagaagatggagaccatcctggctaaaacggtgaaaccccgtctctactaaaagtacaaaaaaattagcctggcgtggtggtgggcacctgtagtcccagctacttgggaggctgaggcaggaaaatggcgtgaacccaggaggcggagcttgcagaaagcagagatcgcgcctctgcactccagcctgggcaacagtgcaagactccatctcaaataaaaaaatgttaaaaaagaaaattcagcttttctttttgtctttcatgcccttgatacttgctttttgtagattattctgaagtttgattttttttctaatatttcttcatggttaaattcacataatatattttggcaagaatgccacaatgccgaagttgtccttctcagtgcatcatatcaggaggcacatgat

SEQ ID NO: 255367 - DNA, 394 bp, Homo sapiens
gtgggggtagttacatgggtttctataattattaagttttatgtacccttctgtttgtacatctcactatgagagaaagtggatcagcattcatgcatggacccaactctccaggcttttgacatcatggaggtttcacgttcagccgtccctaagatgaacctaagacacagcacaaaggttaggatgtaggggagcaaaagatgctaagtacgctcctcccctgcctcctctgcagtcctttgaatttgcatgctagaattactagagcaaaagctcagctaatctcctggctggcgtgattgttattatcatgcggcgcacacaggcatattcatccagatttaaagggaagaaataagcctccctcatggcactgctgataaacaacccc

SEQ ID NO: 255368 - DNA, 245 bp, Homo sapiens
cacaccgagacacacaacctctgacctttccaagcatgcagacagttttgtgtcaacatgctgaagaccacaatggaaatatttgaccctaaagcaacctgcagtcctgccctgacactatgaattgggacgcaacattctctggaggccttgctattaaaggactttggggacacgctggggcatgggctggagttgttgtcctgtcacatggtaactctcggagtggccctggttcccggtca

SEQ ID NO: 255369 - DNA, 1134 bp, Homo sapiens
ttgggcacattagagacaaatgtgctatactttacggcttagcctgcgcccggttcttatttatcgtcaactgtggacaaaatgattttgtttcatgagacaaagggggaccaccaacttctacggtaatgtctgccttttgctagatagactggctattacataaccatatgtagtttatttttaaggagaattacatatttttcttcacatgtcactgttagaagtaaatcccaatagtaagatttccctaaacaaagtatttcttgtaacatataactcataatatttagaaattacagactttaacctttagaataatcatggtttgttttgtttttgaacttactacctcagagtcacatggtatatatcccctatgatacctgtaaaagacatctaaattggtcaattcttaaatattttattgtgctaacacaaaagttttattttatttggagtgcataagatacagaaacaattctttatgatcttacatctctgtttttttaatattgcaaataacataccactttgacataggcagtttctcacttacaaaagtaaaatttgaaatgatcagtggtcaccccatctgtatatttttgccaccactaccagaagagccatgtcattaaaaaaaaaaaaaaaaaaaaaaagttcagaattagagaaataggtattgacagggggtaggaatggttcattttatattatcatcaagtaaaagtaatagtcatacagtatagttcaatgtagtcttttttttgttgctctttaaaaagagaaaaaatagatggtactgaaggacaaatactcaggcttacctaagctttaaatgttagttttttctgggtacatcttcatctctggttactactgtccacgacaaattgctaggattgaaatctagaatcaagagtgtagacatttctaattgttcttaataaatattaccaaattatcctcgagtaaagagtctctagaaatatgtaaactcagagaaatccatgttaaagctctattacccttatattctaaaatttagaggtactatggtgggaggtcttgggcagtttgggaactgagaggtaagaggtatcaaagaagacactgctgaagatcagttctgtt

SEQ ID NO: 255370 - DNA, 487 bp, Homo sapiens
gctctctgaactttcctctctccttcttccacgttgaatcaattactgagcccccaaagattttacctccgaaacatgttgtggcaaagtcagtgtgctgtgtttgccagacccagttcctttttgttctgggctctcagctggactatatagtccagcctccctcaagttagatggggccacatgtctgagttctggccaccaaaatatgcatgtgagtgatgtgctggccaccccccagacctggaccctaaacctcctgcaggatgctccatcctatttcttcccctcacccctttgctggccctctgcagagaactagctgaaaattccagggcccaagggaatggcagaacttctgcctgaaagagccaggattcctgaatgactgtgtggagcagagttctccttccccataccccaggccccatgcaggcccacagtggactgggaagtgaataagaaataaactcttaacatgtgaaaa

SEQ ID NO: 255371 - DNA, 301 bp, Homo sapiens
gcagcaccaaatcaacagatccacggggaaaagtcactcagctatgcaacatcttgattctccaagctcttggagctgcttaatccaactgcactaatgttcgttgtgataaccaattagtgttaccatgtgacccttctcacctaccagaagcaacttacagggcgcaatataatcagggcccaggccagtgcacctcggatgtagatcaacagcagaaaccagcctgatgttctcaccacactgacccaacaaccaaccctcaacatctcatgaacacacaccactcccaagcccgtcc

SEQ ID NO: 255372 - DNA, 318 bp, Homo sapiens
tagatctagaggtcccgagagtgggacacggggatgggacaggggaaaagtcactcagctatgcaacatcttgattctccaagctcttggagctgcttaatccaactgcactaatgttcgttgtgataaccaattagtgttaccatgtgacccttctcacctaccagaagcaacttacagggcgcaatataatcagggcccaggccagtgcacctcggatgtagatcaacagcagaaaccagcctgatgttctcaccacactgacccaacaaccaaccctcaacatctcatgaacacacaccactcccaagcccgtcc

SEQ ID NO: 255373 - DNA, 297 bp, Homo sapiens
tgacttgcccaaggtcactgagcagtgtgggagcccaggtgcaggcaggggctctgatctggcacaggaccagtccaggttctgggttagggaggggagaaggatttaggtggttcagggaccatgaatgaggtgctctggggaccagctcggctacccagcctgaggtgctcctggaggaagccgagcagtgctgctagagctccggccgcctgtacatggaggaggcctgcacacccctctgccatcccagctccagcccaagcttcctttgccctcccagcagctttgccttcc

SEQ ID NO: 255374 - DNA, 314 bp, Homo sapiens
ggtggtaaaaagaggaagcagtagacgctaagtggaataaacagcaaaaagaaaaatagaaaaatcaaaagttggtgccacaaaggtaaaaagatagctttaacacagcgataggaatagttaatactgtgaaatgctatggagggcaaagataaaaacagaactatgtcggccagtcgcagtggctcacgcctgtaatcccagcactttgggaggccaaggcaggcggattacgagatcaggagatcaaaaccatcctggctaacatggtgaaaccctgtctctactaaaaatacacacacacacacacacac

SEQ ID NO: 255375 - DNA, 328 bp, Homo sapiens
  misc_feature (243)..(243): n is a, c, g, or t
  misc_feature (261)..(261): n is a, c, g, or t
  misc_feature (274)..(274): n is a, c, g, or t
  misc_feature (288)..(288): n is a, c, g, or t
  misc_feature (313)..(313): n is a, c, g, or t
  misc_feature (325)..(325): n is a, c, g, or t
  misc_feature (328)..(328): n is a, c, g, or t
gagggcaccgacgttttcagctggctttcatacccgatctacggggcttctcaagcaggggagagctaactgagagagctcgccagagcggttctagctcaagccagtgtgcactgcctaggatggggcacgccccaccctgtgctcacagaataacacacgcagccaccttccagggagttcggacatgaaagcgtgacctaagtctgtggcccaaggtggcctctgcaggtttttgtactnatcacgatcctacttatncttatgacaagcntggatatcatttantgatgctaccctcactgagaattcngtggactaatantan

SEQ ID NO: 255376 - DNA, 624 bp, Homo sapiens
gtggtctgcgattagaggcatgttagttaggcatgctaataatgggatggcgaaagttgggggtaaagcaagtcacctagacctagcagcctgaggtggacttagtgggagctttgtgccttgggggaggctgggaaggcactggccgtgatcacggctctcagtaaactctgtgataatcactcagagtaacctttagagttcaaacattgtagtacattttatctccatatgatttgtcttcctacacaaatttttattgtttcttttaatgtaattatatttatgtagctgtataactatatgtttagttatctctgaggatttaaaagtttacctcttgacgcagttaaatttatccaactaatatatattttttaagtgtttactaagtgctaggtacacttttatgtgctggagatatagcagaaagcaaagtgccctcctgaagcttacattctagatgggagagccaagcacacaaaataaataagtaaattatatagtagattagaaggtcataagtgccatgaagagaaataaaacccaggagggaattagagaatggtaatggttggacttggtaatgatgtcatttaaataaggtagtcattgcagacctca

SEQ ID NO: 255377 - DNA, 433 bp, Homo sapiens
tctgccacccgggttcaagtgattctcctgccttagcctcccgagtagatgggactacaggcacccacccacattcggctcatttttgtatttttagtagagacagggaccttgccatgttggccaggctggtcttgaactcctgacctcaaatgatctgcccgcctcagcctcccaaggtgctggaattacaggtgtgagccactgcacctggcccatttcctatattttttcatttactctccctaacaaatctacgtactatttttaatccctgttccaaagttggggagaccaaagcatgcttaaaaacattgttaattaactagtgagaggcagaccatgaggcctaagtttgcagtcccttgtgagaagcaggcacctagtgtctctgagatgcgcctgtgtgagccttctacgaataacctttttt

SEQ ID NO: 255378 - DNA, 271 bp, Homo sapiens
ggtgctcagcacagcattcctttaaaactgggggaaacgggctgggcctgtaatcccaacactttaggaggcccaggagggaggattgcttgagcccagaggttcaagtccagcctgggcaacacactgggcatggtggcatgtgcctgtaatctcagctacttgggaggctaaggtgggaggatcacttgagcccaggagacaaaggctacagtgagctgagatcacactactgcactccggcctgggtgatagagtgagaccctgtctc

SEQ ID NO: 255379 - DNA, 277 bp, Homo sapiens
acaaaggccatcttactttccccgtgtactatttggggtgtactgctgaattgattgtcccatcaatctgatgtctcattaagtaaaatgaaaaagttgttaaaaccaaagataatgatagtcatgatgaagattcaaatgattcttctatctcaaaatgataacattcagatagggaacaaatttctgacggaactcaacactggaacttggttttagcatgaccattgtctaccccattacatacgggttgttacttggatctggattgactttc

SEQ ID NO: 255380 - DNA, 464 bp, Homo sapiens
ggctataatcaaaaagacaaataagtgttagaagacactgctagtggctatgtaaagtggtacacagcagctttggaaaacagcctggcattacctcaaatggggagtatgatcactaggtatgtacctaagagaaattaaaccatatgtccgcacaaaatttgtacataaatgtgcacagcagcattattcataagtcaaaaggtagatttccatttatatgaaatgtccagaacaggcaaatctacagagacagaaaatagattagtggttgttgagggatggctgggatggaggttttgggggcaacagctaagaggtatgtggtttctttttagaataataaaagcattctaaaattgtggtgatgcatgcactactctaccaatacactaaaaatcaataaattgtacattttaaatgagaattgtgaattatatgccaataaagctgttaaaaaatta

SEQ ID NO: 255381 - DNA, 404 bp, Homo sapiens
agaaggccacagatgacttcataaccctatgcatatgtacatacagaacccacatggagtgaatgttgcctattaacaaaactgtgaaatctgagttagaaacaaagctcagcttggactgaatatataaaaaaatcagtgaacagaagatattttcaaatggacacttacataaatacagcattccaagggaaaattccagcctcagatgcacttatttcatgaagactcaatattttatagcaatggttttccaaaattattagcaactcaagggatgagccgctgtccacttcatctttggaacatcagcttctagcacaggggctggttatattagacattcaataaatgtttgttaagcaaatgaggaataaatgagtaaatgtcaatgtgatactcaa

SEQ ID NO: 255382 - DNA, 315 bp, Homo sapiens
tggggaatctcagagtcgccacagccaaaaccaaactcctgcctgtcacctggaaactgctggcccagctcccccaagtcagtgaatggcaacccattgccccccgccaggttgcacaggccacagtcctaagaagtggtcacccgccacccacctcagccccacacacccaacctgggggccagtgtgcccaaccctcctctcctcagccattctggaggctccaaagcccccaagggtctcccgtcctccctctgcacctgcgctggtctcttccaggatggtggccagcatggctgctcagggtgctggcgg

SEQ ID NO: 255383 - DNA, 822 bp, Homo sapiens
ttggaaggctgaggcaaaaagatcacttgagcctgggagatgaaggctacaatgagctgtgattcacaccactgccctccagcctgggcaacagagcaagaccagtctcaaaagaatatataaatataacatttgaagtgctttgacaaggttatagaagacctcagcacatgtaatattgtaacagcttagtgagcctgtctttcagtgtttcttttaatatccctatagacccaagtttctatattcatattacctacagaaaatagaaataactgcttagtaccactcctcctgtaagcaaacaggaagctttctttgtgctagatttgtaaagcagaggttgaaactgggctaccacgggtccagagaagtgttcccagctcttgttctcttgcctgtgaagtgtactatgagagcctaaggcaataaagaggccaggccaccttcttgacaggcctctgtcccattcactcctttgagtttatttcaccagctgtggggaagttcagaatgaagtggctctataagggctcctggagacattaaaacttaccaatgggccaggtggtggctcacacctgtaatcccagcactttgggaggccacagcgggtggattgcgtcagcccaggagttggagaccagcctgggaaacatggcaaatccctgtctctactaaaaatacaaaaattagcctggtgtggtggagcacacctgtgctactcaggaggttgaggtgcgaggactgcagtgagctgagatcgtgccattgcactctagcctgggcaacagagcaagaccctatctcaaaaaagaaaag

SEQ ID NO: 255384 - DNA, 364 bp, Homo sapiens
cctcagagaagcacttcctttctaaggccctgtactcttggcctggggcctgcctacccctcttcagccaagacagagatcttcaggaactccttcctctcccgcacccacccccacccacaagctttcctgcatcctgggtgctttggcctcctgccctccaggctcactggaggtggagttggcttcctataactttactgggcacctgttcccagttgctgtgccctcctacagcaccggggtctctgcttaaacaatcatctcccctctcttctctctctttagcctcttccttcacctcattccttcccatcgccatttgaggatggttaagtcatgctctttgaaaagctgttccctg

SEQ ID NO: 255385 - DNA, 472 bp, Homo sapiens
cgaccctctcctatatcacggttcaatacttgtcattgctctcttcttgcccctttttgggtctaggcatggtaaagcttcaaagctctctgccagctcttgttggtttctcttaatcctgaccacacctttgtaaatagtgtcttccttcagctttctccaattatccctcttaggtacatttctgccaggaccctgaccaaggtagtccctttgtacaccagagagataaccccagcattgttctcagtactctactcgattataagacgtctcccccaccacctcatctctcctcccttacgactgtcttcactgacaacctggtgctctccaataatcatgcacatgctgtacttgatcactcaatgcttgtgtcttttgtcacagcatttctttgaatggttttctctcccaaagggcaaggctgtgctttaatcatcttggtaacccaagtgctgatcagcgaacc

SEQ ID NO: 255386 - DNA, 564 bp, Homo sapiens
ttattaggtgacacaagcttgtttgtatttttagtttgttaagtattttcctatgaatgaagtttgaatttgaatttttgcacagatatggaattgatcctaactttttttctttttctctttaatctgtccatgtgctctgtgtagcctggctttgctgtcaaagtcatagaatgcagtttgatttatttgttatttgttaacgttttctgaagtaatatgtgtatgataaagatgaactgatatttgaaattaggtaaaacttacatagaaaacgtttccttctggttacatttgaggggaaaatttttgttgcagttttaaatcctttaatggaaatccatttcttcagtcttttgtctctagtcaaatttggtagttaatatttttccagagaacaatatgtacattcaaacttttaaaattattgttcagttgttcatagaatatgcttagtagttttctgttgttgttgtttttgtttttttgagacagagtctcactgtcgccaagatcgtgccattacactccagcctgagcaacaagagcgaccctccatctcca

SEQ ID NO: 255387 - DNA, 321 bp, Homo sapiens
aaaaatcttgggagatggaaagaattgtcagttctaatactaattcaatggttaataatatagactttttaactgagaagcaacatagtttgttgcagtggttctcaaagtatcatctgaggattcctgacaagggggtacctgaaaccctttcagggggttcatgaaccgcaagtctatgtgaaagtttttctttatattcaaccaaagcagcatatctaatgaagacaccgacttaagaatccagtgtcttctattaaatcagatgtaaaagacattagcaaaaatacaaaaacaatgctagtctcactttttttgttt

SEQ ID NO: 255388 - DNA, 455 bp, Homo sapiens
ttttcttctactcattttataccttagccctagtaactttgctttctgtttccataattatcataatctgttataattgcaacatatttggctttttctaactttgtccattacagaattctactgaagtggtttgttattagggacaaatttttccatctggccaacaacttggaaatggtatggatgattcttttactgtcacccaccgcctttctacctcatatcactaataactcccatgttttatattctggccaaagttcagctttcttgtcaagttatttctttggctttgttacctatcttctggtttatccttcttctattagaagccctatgttctctgaatgttcttcttacctgaaagtcacagattatctctaacccagattagcaggtttttcatttaaaaactcttcagatttccctaactacaggcatcctttctttga

SEQ ID NO: 255389 - DNA, 251 bp, Homo sapiens
ttcttttttcctccatcaatgtgcctgaggtttcttaatattgttagtatgttcaaaaatttggccttgttgattatctttattaaatttttatatgattaattcctgattttacctttgttatttaactacttttgttttatttgaatctattacattgctctttttctaacttcttaaattatatacttagataattttaacctctcttttatatttatatatccatctctatatattgctgaagctgc

SEQ ID NO: 255390 - DNA, 2719 bp, Homo sapiens
  misc_feature (2)..(2): n is a, c, g, or t
  misc_feature (5)..(6): n is a, c, g, or t
  misc_feature (2703)..(2703): n is a, c, g, or t
  misc_feature (2712)..(2712): n is a, c, g, or t
  misc_feature (2719)..(2719): n is a, c, g, or t
gnacnnggagagaaatggctgaaagtggaaacccggagcggtttggggcgcttcgcaaagttctccagctcggcgagccggcggtgtgtctaccagaggctgggggccagtccatctggtcctgcccgacgccacttccaccccgcgagctctgggaaaggtctctacgtgacgccaagggccgtcgcggccccggggagagggatcgaaagactcactctgcgaggtgtttacactggaggtgggggacgggaagggactgggcaaagttacctggactcaactaaattcctgcgcttgcttagtgttgacatttgaataggatccgagatgttctgcttttatcccgggcagccctgatatgtcagcaacaggctgaggttccagacctgaaatcgcactgcaagaaaaaggggtttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactggggtacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactgggttgtcctatcttgtggatgatcccctgttatctgtacgaacctccaccatcaagaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctctgtcttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggtggnggggtcggngataggn

SEQ ID NO: 255391 - DNA, 470 bp, Homo sapiens
tgaacttcttcctcctggcagtgaatcaagctttcttcgaagaaatccttttccacacttgatgtggccccagatacaggactcgtcatactcttacccccaggagtttgcaggaggctaggacacaccagccggctggccccgggaagagctggcagcgtttccgctgaagcttcctgcccacccactgggcccgaggcctgttccgcatccagccccctggccccctccactccccacggcaggcgcgctagcgcattctgagcatatggagaaggggttactccgcagccccctgactcatcctgctgctgaataagcctggaaggtgactgatctagggaacatgccagtttgctatcagggcctgatcactgggatgcagctccccggggacgagaaaatgaaaaatatgactaaactgtcctcccacacgggctgtcattaaaacagtgctcgctatgtcacag

SEQ ID NO: 255392 - DNA, 2662 bp, Homo sapiens
  misc_feature (2)..(2): n is a, c, g, or t
  misc_feature (5)..(6): n is a, c, g, or t
  misc_feature (2646)..(2646): n is a, c, g, or t
  misc_feature (2655)..(2655): n is a, c, g, or t
  misc_feature (2662)..(2662): n is a, c, g, or t
gnacnnggagagaaatggctgaaagtggaaacccggagcggtttggggcgcttcgcaaagttctccagctcggcgagccggcggtgtgtctaccagaggctgggggccagtccatctggtcctgcccgacgccacttccaccccgcgagctctgggaaaggtctctacgtgacgccaagggccgtcgcggccccggggagagggatcgaaagactcactctgcgaggtgtttacactggaggtgggggacgggaagggactgggcaaagttacctggactcaactaaattcctgcgcttgcttagtgttgacatttgaataggatccgagatgttctgcttttatcccgggcagccctgatatgtcagcaacaggctgaggttccagacctgaaatcgcactgcaagaaaaaggggtttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactggggtacggagacatggtgcctaagacgattgcagggaagatcttcggctccatctgctccttgagtggcgtcctggtcattgccctgccagtccctgtgattgtttccaactttagccggatttaccaccagaatcagagagctgataaacgcagggcacaaaagaaggcccgccttgccaggatccgtgtggccaaaacaggcagttcgaatgcatacctgcacagcaagcgcaacgggctcctcaacgaggcgctggagctgacgggcaccccagaagaggagcacatgggcaagaccacctcactcatcgagagccagcatcatcacctgctgcactgcctggaaaaaaccactaaccacgagtttattgatgagcagatgtttgagcagaactgcatggagagttcaatgcagaactacccatccacaagaagtccctcactgtccagccacccaggcctcactaccacctgctgctcccgtcgtagtaagaagaccacacacctgcccaattctaacctgccagctactcgcctgcgcagcatgcaagagctcagcacgatccacatccagggcagtgagcagccctccctcacaaccagtcgctccagccttaatttgaaagcagacgacggactgagaccaaactgcaaaacatcccagatcaccacagccatcatcagcatccccactcccccagcgctaaccccagagggggaaagtcggccaccccctgccagcccaggccccaacacgaacattccttccatagccagcaatgttgtcaaggtctctgtcttgtaaaaccactggacagagggccagagtgggtagtggggaatgaaggggactggcatgttggtgggtggtcactgagaccactccctcccccctttccccactatttctgcctgccccattgtacccctagcactgagacttgtgcctggaaggaaaaagaggtagcaaaggggcacctgaggttcacgctgctagcgtggacatagccctgtgatactgcatctcactggggccagaggaagggagggtggnggggtcggngataggn

SEQ ID NO: 255393 - DNA, 970 bp, Homo sapiens
  misc_feature (2)..(2): n is a, c, g, or t
  misc_feature (5)..(6): n is a, c, g, or t
gnacnnggagagaaatggctgaaagtggaaacccggagcggtttggggcgcttcgcaaagttctccagctcggcgagccggcggtgtgtctaccagaggctgggggccagtccatctggtcctgcccgacgccacttccaccccgcgagctctgggaaaggtctctacgtgacgccaagggccgtcgcggccccggggagagggatcgaaagactcactctgcgaggtgtttacactggaggtgggggacgggaagggactgggcaaagttacctggactcaactaaattcctgcgcttgcttagtgttgacatttgaataggatccgagatgttctgcttttatcccgggcagccctgatatgtcagcaacaggctgaggttccagacctgaaatcgcactgcaagaaaaaggggtttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgtgactgatctagggaacatgccagtttgctatcagggcctgatcactgggatgcagctccccggggacgagaaaatgaaaaatatgactaaactgtcctcccacacgggctgtcattaaaacagtgctcgctatgtcacag

SEQ ID NO: 255394 - DNA, 1994 bp, Homo sapiens
  misc_feature (2)..(2): n is a, c, g, or t
  misc_feature (5)..(6): n is a, c, g, or t
gnacnnggagagaaatggctgaaagtggaaacccggagcggtttggggcgcttcgcaaagttctccagctcggcgagccggcggtgtgtctaccagaggctgggggccagtccatctggtcctgcccgacgccacttccaccccgcgagctctgggaaaggtctctacgtgacgccaagggccgtcgcggccccggggagagggatcgaaagactcactctgcgaggtgtttacactggaggtgggggacgggaagggactgggcaaagttacctggactcaactaaattcctgcgcttgcttagtgttgacatttgaataggatccgagatgttctgcttttatcccgggcagccctgatatgtcagcaacaggctgaggttccagacctgaaatcgcactgcaagaaaaaggggtttgctgaactaactccaagctggtgtgcctagcgtccgcgcggctgccggcccaagagctggagtcaccatggcggccggagttgcggcctggctgccttttgcccgggctgcggccatcgggtggatgccggtggccaactgccccatgcccctggccccggccgacaagaacaagcggcaggatgagctgattgtcctcaacgtgagtgggcggaggttccagacctggaggaccacgctggagcgctacccggacaccctgctgggcagcacggagaaggagttcttcttcaacgaggacaccaaggagtacttcttcgaccgggaccccgaggtgttccgctgcgtgctcaacttctaccgcacggggaagctgcactacccgcgctacgagtgcatctctgcctacgacgacgagctggccttctacggcatcctcccggagatcatcggggactgctgctacgaggagtacaaggaccgcaagagggagaacgccgagcggctcatggacgacaacgactcggagaacaaccaggagtccatgccctcgctcagcttccgccagaccatgtggcgggccttcgagaacccccacaccagcacgctggccctggtcttctactacgtgactggcttcttcatcgctgtctcggtcatcaccaacgtggtggagacggtgccgtgcggcacggtcccgggcagcaaggagctgccgtgcggggagcgctactcggtggccttcttctgcctggacacggcgtgcgtcatgatcttcaccgtggagtacctcctgcggctcttcgcggctcccagccgctaccgcttcatccgcagcgtcatgagcatcatcgacgtggtggccatcatgccctactacatcggtctggtcatgaccaacaacgaggacgtgtccggcgccttcgtcacgctccgggtcttccgcgtcttcaggatcttcaagttttcccgccactcccagggcctgcggatcctgggctacacactgaagagctgtgcctccgaactgggctttcttctcttctccctcaccatggccatcatcatctttgccactgtgatgttttatgccgagaagggctcctcggccagcaagttcacaagcatccctgcctcgttttggtacaccattgtcaccatgaccacactggggtaagtcagcgctggtggatgaaaccaggacggaggttggagggcagctggatgacctctgaaaccttggatggtgtcaccatgggtagaggaggagggagtcccttacccaagtgttgggggcaggggaagttgctctatccgaagggtaaagcccatgagtcatctgtttgggggtggtagcttgctgggaattgagttttctttttgaggtcggggcatgtgttttatagagctaagaaaattaagtcaccaattcttttttcagccatgccttgtgtgcgtgtgaagtctcggggtgaggtgatgtctgcatttgtatatgcatttgcgcatatggggcagcgtggggagaaggtcagggcagttgttggggagggaggagactgttgagaagttcgg

SEQ ID NO: 255395 - DNA, 422 bp, Homo sapiens
gacatgatgacaatgatggcccggatgctgaggacagtgaccagacatccagggtgtgcttgagaagcacgacttccacagggccttggctggctgcatccatgttgcttcacccccagattgcagatcgcgaagggtctgcggaaagttctgaggcaaggatggctctgcgcttctcagggttcccaggaccccgcgggattcggcagccggacgccacccgcccaggtctggaatctcagccccagccagcatgcagaacgtgtttcggctcctctaagcccccttaattggtttttaacaactttaccttcttttggactttatataaatcatatataaatgcagtgtgtatttttttgtttgtttctggcgtcttttcctcaacatatgtttgtgagattaaatcatgttatgtatgt

SEQ ID NO: 255396 - DNA, 290 bp, Homo sapiens
gggggcggtgggggaaaaatcctgggcaaaaatatgagaaatgaaatcctggtgttaaattcgtcctctgtaatgcaaacgcagcaccatccattgattctctaacatgcaattttctttataccagaaggtcttgtgcaattcaaaatttgcacaagtcaagaataccacttcattaaaactgtggattttagaggttcagattttcagtatgctcttttatgagtatgtccaccaccattcaaattactttttgctgctgcaacagtcaagtcacattcacacgcaag

SEQ ID NO: 255397 - DNA, 433 bp, Homo sapiens
tccaaatactacccctgcagccaggagcacacacaccctgaacacacgcacatattcccttgccctttccatggacaagcactcccgaaaagtaatcattgacatcggcacaccggtgcacacggtgtgtggactcatctatctctctgtctgtgctaagttctactcatcttcctgaggaacagcacttgatacatttttacggcactgtcgctgaacccaaacctcatttgattcccccagccttccctgggccagactttatgtatctccgtcttacagatgatgagaaaactgagcttcagatggagcaggggactccccaagacaccccgatagacacagatggcatgggcagtcacagtcagatgtcctgactgcatcccagcaggggtagggttgtgggaaatggcacacaggcctaggtttgaat

SEQ ID NO: 255398 - DNA, 170 bp, Homo sapiens
aagtaagaaagtgttcagtctctgggaacaagacagacagacagggctaacctcatggagcatatacttcagtgggttttgctttctttaagaatgtctaaatagtggctgatcaccctcctttgtggaaacctagcacactagcagccattataattaaaatttcaaaa

SEQ ID NO: 255399 - DNA, 689 bp, Homo sapiens
tgacgcagaactggaaggtgtctatggattcttcaaggtcaaaatttgtacgttcacgtgacaaggctgcagccaaaaaaatattctcagttcttcttccaacatggaatgaataagtgactgcataaaacatcagtcttctagactatgattgccagtttacaaataatgagagagaaactgaggcaccacagatgatgtcaaccgtttctggtcacttgtggattgctaagcagtcaagaaattgaagtagctactgtttagtgtcccagtcctgttttctctccactccttcccaatgacaaaggtcttatttcaaagcacaatttggtttcatgctggccagtccttcacaaaccatcgaggtaatgtttattcaacctcacactttagcgactatttatgagcagtgtttacaagttccagagattgccccagcagttattaatgctatgcaaatcaaaagccgtctaaatttgttaatctagacaaaacacaggggcaactccaaaccaacgtgtgatattctgtctctgggtttattcaagtgtaatgcacctttaatgtcaacttagatttttcaactcttcaccagactcgcagtaattatagtcaacaggaaagtcgaactcagccaaagaggcaaggcaacaggaaattgtggggaaattttaaaaacaaaaccaaaa

SEQ ID NO: 255400 - DNA, 320 bp, Homo sapiens
aaaactttgtgatcttgaaccttaggttcataatctcacaaatgagaaggctccctccacactcttggaactgtacacccactgaaacccttaagatcaaaagaaactgcctctgtggagttgaagactaaatcaatttttcagccataaatgagcatgctaacaaagatcttggaatttgtatttatggtaaaatgctttacatgcattctcattgaggcatatgagattcttaaatttaatttttgttcttgttcctgcctcaaatccaccaatgacttttcattgacgttagaatgaacattaaactctgtaacaaa

SEQ ID NO: 255401 - DNA, 257 bp, Homo sapiens
gttatgaaaaccttctaggacatcagtgtgatgatgtccagagacaggggcagactcctgatctgtggctgtgcttggtactccctcaccccttcattggtctaatgggccagctgaagaatttacacaataggaaaattggccaaagccttaacattgttaccaacctgcatttcttcatgaagaaagcacaatacttgccttaactgagggaagtttcgcaggaaggggtattcagctgtgtgagtatgtgctct

SEQ ID NO: 255402 - DNA, 518 bp, Homo sapiens
catttgtaagagcatgggccctgggttcaaatcctgttcttctacccccaactggggagacttatgctaccagacatctccgtgcttcagtttcccatttgtaaaatggatttcaagaatgaactttgaatacccttttctcttcatttttccaaacacagagatgagactcaattttacaaagtttatgtgcgtcacctaaaaaactgcacgtgccttatggtaaaaccaagtcaaaagtcatggccttcaacctgtgaaacagacagaaaggaaacccctatcatgcctgcttctctccctacctcttttcatctctgtttttccatttatggttaagaaaacaagaaaattcgccgagcacaaaagttttccctctttttctgtctagaggggaatatgagtaatgaacttttccatcagggttgtttttcctggacatagtgcaccccctccagctgctaaaacatgtgatcctgaaggagaccttaaataaacttaaatgttccttatcggtc

SEQ ID NO: 255403 - DNA, 233 bp, Homo sapiens
aaacagtgagataaaatgactagagggcaagtgtgcaggtggtctccaagactgctccaggctcacttgtttgctaggaagacttcacacagagttagttgcattcatggctaagacatagtacagcaaaaaggaaataaaacaaaatcagcaagggaaaggcccaggatgctaaccctggaggaatcaggctcaagcttccaagagtcattcggtgaagctgcacaggacgc

SEQ ID NO: 255404 - DNA, 404 bp, Homo sapiens
aggtcactccttccttcccatcaaggatgaattgaccttggtatctcctcattgctcagaaaggtaattcaagtgttccacaggtcaatcccagagtcacttcacttttgtcaggaatccctgtgtctcttactttaactggactctgggtgacctatcttgtttgcacaaatatcttaaagtgaacatgccaattagtgtctcacctctacctgctcacaacctaaacctttccaccaaactaacattgagaaagtaagtagataaaagaattattggccaggcgtgatggctcatacctgtaatcccaacactttgggaggccaaggtgggtggattgcctgagttcaggagttcgtgaccagcctgggcaacacggtgaaacctagtctctactaaaatac

SEQ ID NO: 255405 - DNA, 442 bp, Homo sapiens
caccactatgcccagctaattttgtatttttggtagagacggggtttctccatgttggtccggctggtcttgaactcccaacctcaggtgatctgcctgccttggccttccaagtgctgggattacaggcgtgagccactgcacctggctagaccgttattaaaaagtctcacgtttgctgttcttcgtgcctctaagtccattctttgggtttgtacagtgagtgtgtttctcatttcacgtccccccccccccccatattttttatagctatatttgagctgggaaacctgaggagaggttagatataagaaattctaggctcacacctgtaatcccagcactttgggaggccgaggcaggcggatcacgaggtcaggagttcgagaccagcctggtcaagagactagcctggccaatatggtgaaaccctgtctctact

SEQ ID NO: 255406 - DNA, 370 bp, Homo sapiens
ctctagccctccttcctccacaaacacaatattaggtccacattttgagactttgaaagagtaggaaaaatgccatgctatagatgcagagagcatatcatgggactttgtctgccctgcttctgatgccaggaggcactttattttagagaactgagcctcctgtatgccaatcccaaccctaacctttgctgccaatcagagccactgctcgcacgggttggctccagacctggctggttccatcacagttctcagcacccctgggatagcatttgatgcagccacggacttattatccaggtgcagccaatgtgagatcttccctgaaactctcctccctgaagtcctttaaggagcgaaatagaaa

SEQ ID NO: 255407 - DNA, 420 bp, Homo sapiens
caactagacctaagaccatttccatacagctcttctgactggggaaggcactttcttctcctctctagagtgcttttactggatccagggtactgcactctcctttgcattttctttccctttatcttgttcagccctttagaaatacttcctttagggccaggcatggtggctcacacctgtaatcccagcactttgggaggccaaggcgggcagatcacttgaggtcaggagttcaagaccagcccagccaacatggtgaaaccccatctctactgagaaacacaaaaattagctgggcttggtggggcatgcctgtaatcccagctacttgggaggctgaggcaggagaatcacttgaacccgggaggaggaggttgtagtgagctgagattgtgccactgcactccaagcctaggc

SEQ ID NO: 255408 - DNA, 301 bp, Homo sapiens
ttttttacaaactgaaggtttgtagcaaccctgcatcaagcaagtctatcagcaacatttccaacaccatgtgcttacttcatgtctctgtgtcacaatttgataattctcacaatatttcaagctttttcaatatttttataactgttatggtgatgggtaatcagtaatctttgatgttactattttaatagtttcagggtgccacaaacagtgcccatataggatggcaaacttaatccattaatgtatgtattctgaacgctccactgaccagtcatccccctacctctcttcctct

SEQ ID NO: 255409 - DNA, 472 bp, Homo sapiens
agtaatgaatccagaccttgaagactggtgtgtgtgtaaaaggcaagaagtgagaagattcacgtgtagatccaggacaatctgaatttacttctgttcagtagttcccaaaggctttttctacatggagggactcggagtgacacagcagctccctcttgtgggcagattcccctgtgtaaggtgctggaggctgaggttccagcctgcagccgcttgtgatcctgatatgtggagagttctggaagactgatgactgctgacccccttcttaacctacgccatcgccatgctggtggtggggatggggctcttggccattcctgccccttggctgcccttccttggtctgagggtacgtgggtggcccttcgggtgtgccaggagctttgtgctttagtgaccaacagtcccctgatgtgtgaaggcccatcaatccgatttaaaataaaacatttgaagtctcttcaga

SEQ ID NO: 255410 - DNA, 483 bp, Homo sapiens
gcaagattttagtccagggtggtatgtttcaatcatttttgcaacacattttgaataaaagtccacctaagaaattgtcattgttactgagagggagccatataaagtcatttttttcctttgtcacaggcaattccctccatcaccgcacctcaatatagaacatcattttgtttctctagaggcttgaggtgtctatttgtataaaagcaacatctatgatgaaaccatcatcactttaactccatggttttctcaatatggcacagaaattacatgactgatatttcaaactgacagttccattaaattataatcaacattatattctatggttttgttttttactgagacctttacaaattgcttcattttatgcttctgctctgattattttccattgctacattataagccacattctgttggaaaaaaaagagaaataagcagctgctactctttttttaatctttctgtgttttg

SEQ ID NO: 255411 - DNA, 204 bp, Homo sapiens
agaaggttgagagtgaagtgggaatttggaggttttcagaatcaatataatatgtaaaacccaagggactgaagaaattacttaggaaatgagtgtagacagaaaagcaaagagttccaatgactggatcctggggcaactctaatacttagaggttgggaaaatgaagaggaatcagccaaagacactgagaaggaagagcca

SEQ ID NO: 255412 - DNA, 532 bp, Homo sapiens
ccaaaaagaaaatactacgttattaaacttagtttctacattcttgatattccaaatattctcaatcctgactgtgcatcaaaattgcttataagaaaattaatatggttatggctcagtctacatttattaaattagaatctatagaggtggggcttctatcaattttggcctttgaggaattccacagcaaattatgatttacaggtttgagaactagttggttaaaatataaatcacaggccgggcgtggtgactcatgcctgtaatcccagcagtttgggaggccaaggcaggtatatcacctgaggtcaggagtttgagaccagcctggccaacatggtgaaaccctgtctctactaataatacacaaattagctgggcgtggtggtgcatgcctataatcccagttacttgggaggctgaggcaggagaattccttgaactcgggaggcggaggttgcagtgagcccagatcatgacattgcactccagcctgggtgataagagtgaaacttcatctccaaagaaa

SEQ ID NO: 255413 - DNA, 474 bp, Homo sapiens
cctgggaggtcgcagctgcagtgagccatgatcatgccactggcttgacagaacgagatcctgtctcagaaaaaaacaaaaccaaaccaaaccatggaagtgtaatatggccaaatatttaatttaaaatattttagtagccgtattttaaaaagtggaaagaaacaagtaaaattaatttgaataatatattttatttaacataatataaaaatatttcactattcaatataaaaattaatgagttacatcctttttttcatacttaatcttcaagagtcttacgacaaccatctttttttttttttgagacggagtcttgctctgtcgcccaggctggagtgcaatggcacgatctcagctcactgcaacctctgcctcccgggttcaagtgattctcctgcctcagccacctgagtagctgggactacaggtgcccgccaccacgcccagctaatttttgtatttttagta

SEQ ID NO: 255414 - DNA, 473 bp, Homo sapiens
cactgctggctattgtcctgttttataaatttcagtagcaattttcaaaaatttcaatgaatgatctgatattgtaaagataaagaattttggtttttaagtgaccctaaggtccatggcacataagaatatatttttgctaaaaatgaatcacctgtgctaagagggttttttttgttgttattggggtgtatgtgtgtgttttaagtaagatgtgttcatttagttcagtggttctcagccctcactgtgtatcagttcatttggggcagggagaaaaagtcagaagggaaataaagaaatgccatccatcttaattgtttctttagaaaaatgattgttatataacaagatagatttatggattgctactcataagttaatgttacaatttggaaaaagttaatactttattcaaggagctgtttaaggcagtcattcaaacagctacctttggatgcattttttgcaga

SEQ ID NO: 255415 - DNA, 375 bp, Homo sapiens
cctatccaaggggcctttacagtgcttgaactcaccaatgaggtaacagatgaagggagaatagtgatggcctttacaaagccctcctgggggccggatgtggtggctcacgcctataatcccagcattttgggaggccgaggcgggaagatcacctgaggtcgggagtttgagaccagcctgaccaacatgaagaaaccccgttttttttaaaaaaatacaaagttagccgggcgtggtggtacatgcctgtaatcccagctacttgggaggttgaggcaggagaatcacttgaacccaggggacggaggttgcagtgagctgagatcatgccattgcactccagcctggggaacaaaagcgaaattcctcctc

SEQ ID NO: 255416 - DNA, 347 bp, Homo sapiens
acagatatctctttgacatactaattttaattcatttggatatatatccagaaatgagattactgggtcgtattttaatagtgaagttagattccatacttcaagttcctaaaaaggaatagggagatataaatggtgcctcttggaaaagaattgatgataaaggcaaaaagatagctaaagttggaagtggtcagaaaaacatgtttgatgtttggggtttgtatccctttttaaataaaagagcttccagcgtgcttacaaggtgaaaggaaggatatttgaagggaagatcagaaaagagatagataggtgaagtagcaaaatgggatggtactaacagccaa

SEQ ID NO: 255417 - DNA, 311 bp, Homo sapiens
ggccaaatgattatatgcttagagcagtgcctaataggtggagcttctcaacacgattcagcatgggtggtggtggtaagtgaagactgaagaagcagccagccacagtagcacaaaagcaggcaaaacagatctgtgctgttagaattcagcacagtggtactgggaggggacacagggcggcttctagtatgccggtaatgttgcttcttgatctgggtgctggttatacaggtacgttcagtttgcaaaaataaatctattagtacagttacgctatatgtactttctgtgtatgttcaataaaatgt

SEQ ID NO: 255418 - DNA, 344 bp, Homo sapiens
  misc_feature (66)..(66): n is a, c, g, or t
cagttgcttatcccccttgttgaggcggaacttggacttgcgcaggtctcggaagcgcccatgggngcgtagtgaagtccaccacccagggcagcacggggtggtagttggggtccccctgccgccgacctgccaaccgattcagctgcatgaggtagtggaagttgctgatgcggccgtggacccaatctagcacgaggctccgaagttcctcctggccagtgggttgcccaggttgccctccctgctcctcttgagacacaatgcccgcctcatcccttgccacaggggcctcctcattctcgtcctcctcgggcctctcataagcactcaggtccagtcgc

SEQ ID NO: 255419 - DNA, 382 bp, Homo sapiens
tctcagaagaagagggctgttttattaatgggttatcattctcatcagtgaagttgtgaccactggtaaaagtctaactgctttctacaataaattcccagagaacatttaaaattattttctccaaataattgcactttaaacaatcaagaattgtgataggccaggcgcggtggctcacacctgtaatcccagcactttcggaggccaaggcaggcagatcatttgaggtcaggagttcgaaaccaggctggctaacatggtgaaaccccgactctactaaaaatacaaaaatgagccgggcatggtggcaggtgcctgtaatcccacctactcgggaggctgaggcaggagaatcgctggaacccgggaggcagaggtc

SEQ ID NO: 255420 - DNA, 460 bp, Homo sapiens
aacatgaacatggtgcagtttagctatcggaagtaatagcattcatactgggacttacttagttttctgcattcagaaagagcagggcatgaaaggaatgtcattgaagtttagaatacccatgtttgctattagcatgtgctctccccatccgaggcccctgagaatggtggtaaagccaggtagctagtcaggtaggcagcagccctgatttcgacagctctgggattttctctctcatcatcattccctgaaaccgtacattttgacacttagaactgtaactaggattttctttggttaaagttcaaagacattattttattccactcttgttttccagtagtgcttgatgtcatttctggcacctaagtgcttaataaatgttgaataaatgagtaaatgaataaatgaacaaattgaattgaagtaaataaagtatattattatcacctgtttc

SEQ ID NO: 255421 - DNA, 515 bp, Homo sapiens
agcaggcactgggcccggcaccctcatcctgctcacggcagcgctcggaccgcgcctggagtccctgcgccaagggcgtgtcccgacggctgcaccgcgagggcgggcatggggagggggaccggggagacggacgctgggatggggtcagcggcgccctgccgaatcccgagggccgagcacccctccctcagccgcactgcacctgcccgtaggtgaccaacccacgggcggacccccagacccaatcctctccagagccagggtgggatgggcagggacaggagccggaggccctactggccccgggcgaaggcatcctggaaagcatccagagcgtccagcatccctcccgcggccacccgcaggctgaccgacccctgggcagaccctcagactcaatccagtccagggcggattaaggagtgggagacaagggagccggtggccccgctggccccgggccggaggcgtccagccaagtccggagggccgagcatccctcccgcggccgc

SEQ ID NO: 255422 - DNA, 388 bp, Homo sapiens
ggcagcagcctgagatttcaaattggaacccctaggttggggtgtctgtgcgctgtgtgtggcgagtgcagaggggctgatgtgcctggaggaggagccctgctcctgctgaaaacagggccctcagctctcctgggactgctcaactgggctgagggcatgtgctccgcccatgtgggtcctgaggtctcgggggaggtggtgacagggacaggtggggctcagaaaccttgtcctctgggagaatgggctgcctaggcatttcactacagctgcctactacaaaccaaacaaggaaaaagaaggtaacagaaaaagatctgcaagctgaggtagagatgtgaacagtaatacagagatggccggaggatgagtgaaatatcatgaa

SEQ ID NO: 255423 - DNA, 792 bp, Homo sapiens
agaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacgtgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgaaaaaaaaaaaa

SEQ ID NO: 255424 - DNA, 546 bp, Homo sapiens
gaaataatattggccttggagcatgtggtatttgactgcaaaattctgatgcttgacatcaccacaatatattatttgactttgggcaaggtacttgcttcaacctcttcattcacaaatcgtaatacttgccatgaaggtttacgacaagaactgaataattatgcacatgttcatacacacactcacacactcatatgcatagtatctaatagtgtccatcttgcagttcgttcgcaatatatttccccacgttttagtgcacctaaatattcagctttgttaattcatgcaaagataaattgcagtgatatatgctaggcaaagtaatgactattccctttgattctgaaaaccaattctgtcctctgaaaaattttaaattgagatgctttgtgtcacttctgaaaagaggctagtgcaaaactgctaactctcctctataccaactatcagcagttgacaaaaacagaacgacttgtttggcatctcaatataatttaaatattgaaagtgccagtaatctaattgtcaatgttagccaaa

SEQ ID NO: 255425 - DNA, 443 bp, Homo sapiens
gtctctgtcaccaataacactgggagccttcagcaagttgcctataatctcttatgcatttctatttataggtagactggaataaatattactgccttaaatttttaaaggaaaatatatatttttttattcttcagtgtttttctatacattggcaggaacaggatgaatataagagtttgctaaatgctgagtgcagtggctcacaccattaatcccagcattttgggaggccaagaaaggtaaataacttgaggccaggagttcaagaggaacctggccaacatggtgaaaccccatctctactaaaaatacaaaatatagccaggcgtggtggcacacacctgtaataccaactgcttgggaggttgagatgtgagacttgtttgaacctgggacatggaggctgcagtgagccaagattgctccactgcactccagcc

SEQ ID NO: 255426 - DNA, 423 bp, Homo sapiens
ggacatcccggggttgcggggcccggactggggtgggggtcgccggaccgggggtcaccgacgctgggccactggagggggacggtatcggcccgggcccgccaatgtcgtcctgccgatccactcccgggtgggacgggagaggaggagggcgccccagcccctgcttccctacagacgacctctccaaaaagttgtgggcgcttgtcccctccgtgcaccccactttctgccctgtcttctctccctttgttcgggatgttgagctcatggggctctgctggggcgggctggcaccttggctgtagcccaggcccgtgcgcctgccagaacgtggggtgcagtgtggcaaccccggcccgaggccccacatgtctagagcaggacctgcacccctgccaggtcctggacaagggagggagg

SEQ ID NO: 255427 - DNA, 313 bp, Homo sapiens
gggattacaggcatgcaccaccacgcccagcttattttgtatttttagtagagacggggtttctccgtgttggtcaggctggtctcaaactcctgacctcaggcaatctgcccacctcagcctcccaaagtgctgggattacaggcgtgagccactgcacccggctcaccactagtttttagccctttttgttgggggtggggtgggggcagaggagaggcggatacagaaacttgtgagaatgtgatgaacgctctgaaccccctataaaaaatgtgcatgtaaatatatactctcaacatttaaaagattt

SEQ ID NO: 255428 - DNA, 829 bp, Homo sapiens
ttctctttaaagagaagaacttttttattattatttttatctccaactgcaggtggtgtcttttgccaaggtctctgtatttttctttcagttgtctttgggaggggatgttaagtcaaatcactaaaacagggttctctttggattaaaagttctggatttattgcaactattttccttgagaaacattctcagcatcaggattgataaacaaatgtagatgattaaaataggataattggttttagataatatcttctactgccaaacttctggcaaatttacctgtgaatttcaaaatgttataaaatctcttgatatgcttttgtttttccttttagccattttctcttcaatttcttagtccctctgccctctgtaaatgtgttgagtgatatagctatcagatgtattgaaggcaaagttctcgcagaggtctctgttccagctctgtaaaggtcacaggaatcgtgaaggagctgagaaatcttcctctccggcccactgtctgtggcccattgtcattgtttcctcatgaaacattgcagagtttgaatcctcagtaactctcattgactggattagaggtgatggccacagcaaatgggagagcaaaatgttggcctacagagaatgacacaattttattcgcctttggtgttagttgccatagtgctgtatttgaaaatcgatgctttagccaaaagctgaatgaccaccgtttccgtagtttccactgttttgtctgcatagaattttcctgaactacaagcaaaaatgtattttgtccaatgtcacaaaagtgaaaatgttactaatcttagatgtg

SEQ ID NO: 255429 - DNA, 393 bp, Homo sapiens
ttatggagttattgaggaaaacgttttgttttgattcctaatagtataactgaaatggagcataagagacgggagttagcttgtatattgaacaaggtcatcaaaaccttgtcatccgttactatcttcccaatcactgatttgtttttaaattgctccgtcctaagttgttacatcactgtccaatagagcagcaacaagcctcacaggctactaggcacttgaaatgcaactaggctacattgagatgtgctgaaagtataaaatacccatcaggtttgaagacttaaaggacaaaagaacagaaactgtatcattaacatgtttcatatcgattatattttaaacaattttaaaatataatgagttaaataaaatattaaaattaattgc

SEQ ID NO: 255430 - DNA, 377 bp, Homo sapiens
agagtcacctctgctgcatggctttattttaaaggaatttgtctcttgggagttttcaggaaaaaattacccttgcaagctggttttcttcaaaaggcattctttgctcaatgttctttccttctacacatcacacgaattcctacttcttggccttggtagtctactgtactccactttaattccttccctatatttcttctgccattttatcacagcctgattctgttgctgggtcctctgtgaagtcttttgtaataattacacctacatcaacctttctcttttgtaaacttctattgtctgttccttagacttttatttatattttttgaggtataattgatgtataataaagtacctatttaaagtgtaaa

SEQ ID NO: 255431 - DNA, 294 bp, Homo sapiens
actgtgtggtatacacacaagaacacaactactggagtcatacacaacttggtttgaaacatactctacgacaaaactgttgtgtggtgttaagcaaattaatgtctctgaattccagttttcttatttctaaaatagtggtgattctaatgcctagttcacaatgtgttttgagaattacatagtctggaaaagttgaaagtgttgtccattgttaaatggagatgatgttctttagtcattcaacaaatgtttgctaagtatctcctatgttgtagtcaacagaaactgata

SEQ ID NO: 255432 - DNA, 459 bp, Homo sapiens
agtgactagaaagtgatggcccaaagaccgagagagaaggagagctcaagcagtcttattgggcttgtgagatgaaactcggaattcatgggccaccaagcagaaagaaccccgataaccatcccaggccttccattgggatccccaaagggctacagcctggaactggaggttgaaccagaatttgactcatctcaaagacagaagcccaactgtgaatctgttcaatctctaattagattaaagtgatatgcccatattctaaaagtgatacgtcacttccagaggcaatgggaagtcctctagagaaaggtcaccatcagcaacgtcaaattatctctgtttcttgtatacatgtccagcaatccattaaaaaccaaccaaacgaagcaggcaagccaggagataagaccaaatgaccaaaaaggagaaaaaacaaagaacagaaatagatccaca

SEQ ID NO: 255433 - DNA, 819 bp, Homo sapiens
ctcacctggccttcttaaaggaaaagggaaggagaaccataggccatggtgagggaagggccgcggtcgggctgccctaccccagggcctgtgggctggtcccctacagagcttgctaaagaaagaggaagttcccgtcctctggagggacaaaagtgtgagcactgcggggagggggtaggttcctcaggctctttgtccaaaatgtgggccttaactggtggaattgtgagcagtagatgagatcatcgagtgaaaggcacttccatcagcacctggctcacagtcagtgttcaatgcaggatttttgaaaaccataaaatgttggtggttcctgtcctgtcctctagggtttgggtgaggaggcaggtgtgagggagagtcttggggtgaagaggtttgagccttctcctgctctgtccgtggagcaagtcaaataaatgctgagaccgtcagctcctcatttctccttgaccagcaatctgatgttcccttgggttgagggttttgttttcttggtccatcagcagtttcatattgaaaagattacatttctgaaaacattgtccaaacggaaattccctctgtgggataaagcaagactcacattacttactgctaattgtggcgtgaaggtcaagatcagaaatggccattttgaggaagcgtgtgctccccccacagcagctcctggcccgggggcatgagcatggctgagggtgtggagtcttcccctaggttaggaatgggagaaaacagggtctccacttgcaaagaggtgtccacagttccagaggcaaatgctgttaataaaaattc

SEQ ID NO: 255434 - DNA, 1508 bp, Homo sapiens
acttccccgggagccggagagtcccgtctcacggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255435 - DNA, 1994 bp, Homo sapiens
agcggccttaccctcctaagagttcctctgctgtacgactgcactcccgcaccctcccctaaatcccccctcttcggcctgtttaccttttaacttggcttcgttgcacgtttgtgtgtgtgtgtttgctcttcgcagcctcttgagcgtcttttgtacttaattcttacactgtggacgctctctcgcgcccgccatcccccgacccctctgatctccgatccttgacgatgtctagcctgcattgattggcccttttccctgggtatggcagatctattgcttgatgatcctctccccccaagaattctaacacaggagctgtcctgaggctctggatgactttattcttcaaatggctttaccctcccagtagctccagagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255436 - DNA, 1529 bp, Homo sapiens
acttccccgggagccggagagtcccgtctcacggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttcttcttccttgactctgaaatg

SEQ ID NO: 255437 - DNA, 1366 bp, Homo sapiens
acttccccgggagccggagagtcccgtctcacggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255438 - DNA, 586 bp, Homo sapiens
acttccccgggagccggagagtcccgtctcacggttgccctggcagcgcgcgaggctggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacagggtgagaggggccttctatcaaaatagaggactcctatgggaattgtaaggcccttggagttcattcagttcaatcccctcatttacagataaggaaaactggagccaggtgtgcttccagggcctctcaactttcacagcccaaggctagatttgggttgccagggctagggttctagttctacctctgattactgaattctggttaaaa

SEQ ID NO: 255439 - DNA, 622 bp, Homo sapiens
gggtgtcaacatggaactctggcttttctttgccccttcaggtgggggttgagtggtctctttgccttccgtccccactgcttttccttggacacctttagtccgacacaagctggcttcaatcttaagctgttccaccatcttgcgtgcttgcccaatactcatagtgctgtcctgaggctctggatgactttattcttcaaatggctttaccctcccagtagctccaggtgagactgagagcaagaacctggcccatccctctccattgtctgagcaggtcaccgagggaagcgggcaggacgcgctggcagagtctgacggggccctgctgtgggtggagcaaagggtgcctcatatctctggggtgcttggggtcggccacaaaggtggtaggaaatggggtcgacagataggtgagggtgggccttgtgcttcagataacctcacatggtcaggcaagggttagggatgggatgcaaggagcctaaggggctcacaacaattactgacctaaggaagggcccaggagagggaaaagggaggagttgtgagaagggacaggggagctcagaggagagcacagaagaacttcttctcccggaaggggttctccgaagtg

SEQ ID NO: 255440 - DNA, 2003 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255441 - DNA, 1665 bp, Homo sapiens
agcggggtacggccatcttggaatgggagtggctgtgggcgcagccatcttagagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255442 - DNA, 1644 bp, Homo sapiens
agcgggtggtcgcagccatcttagtagctccaagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255443 - DNA, 1644 bp, Homo sapiens
aagcaggctggtaccggcccgcgagttaggcaagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255444 - DNA, 1795 bp, Homo sapiens
acttccccgggagccggagagtcccgtctcacggttgccctggcagcgcgcgaggctggtgagtcggcagccctgtggcagccggcgggctggtttccatggttgcacgattaggtaggggctccgggcgctttgcccacccccgagctggaggggactggcgggaagcggcggttggctgcagggcgctccgccgggcgtggggtgtagccgtgtcggtgagcgagctctgctcgaggcggagaggagaaactcgggaagcaattgtggctactctaaggctactggtttcgagtcaggccgtgcgaccttaggcaagtcgcacattctctccgtgcagctgcctagcagtgtggattcagtatcaccgtgtgtgtaaagctctttctaagaatcgtaaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255445 - DNA, 2386 bp, Homo sapiens
  misc_feature (2017)..(2017): n is a, c, g, or t
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttcaaaaaaaaaaaaanaaaaattacaaaaaaatactataaacacaataactatatataatcttactcaattctactcatattccttcaattattaatcatacttattcctcaaaaccctaacaaaaaaaaaaactctggggggggccccggtccaaatttcccttattggggtcgttttacaaataattgcccccttttaacaacgtgggattggaaaaacccgggggttcccaactttaatcccttgggaaaatacccccttttcacgtgtgggtaattccaaaaagcgccctccctattgcctcttcaaacaatggccacctttattggatattggaaatatgtagcgctataatttttgtaaaaatcgggaaaaatttttta

SEQ ID NO: 255446 - DNA, 1452 bp, Homo sapiens
acttccccgggagccggagagtcccgtctcacggttgccctggcagcgcgcgaggctggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255447 - DNA, 2024 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttcttcttccttgactctgaaatg

SEQ ID NO: 255448 - DNA, 1836 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255449 - DNA, 2210 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccaggtaaaggtgttggctggggagctgttgaggtgggctaggttgagctgggctgggccagaaggagtccctgcttcatccagtatgaggcttagggtatcaccgactgagacaagggtcaaaggaaaggcgaggaaggtgaggttggcactgccgtccaggcacagccaccctaaccctaacctgtcctctccctctttggaggtgcagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255450 - DNA, 1341 bp, Homo sapiens
acttccccgggagccggagagtcccgtctcacggttgccctggcagcgcgcgaggctggtgagtcggcagccctgtggcagccggcgggctggtttccatggttgcacgattaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255451 - DNA, 1780 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggtgaggggcatcctgcagcgtgac

SEQ ID NO: 255452 - DNA, 1693 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagttcctgaagaaaaggggcagactcctcacattccagcactttcccacctgactcctctcccctcgtttttccttcaataaactattttgtgtcagcttc

SEQ ID NO: 255453 - DNA, 1012 bp, Homo sapiens
cggacgcgtgggtcgacccactgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255454 - DNA, 1541 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagtctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255455 - DNA, 1868 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255456 - DNA, 1137 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacagggtgagaggggccttctatcaaaatagaggactcctatgggaattgtaaggcccttggagttcattcagttcaatcccctcatttacagataaggaaaactggagccaggtgtgcttccagggcctctcaactttcacagcccaaggctagatttgggttgccagggctagggttctagttctacctctgattactgaattctggttaaaa

SEQ ID NO: 255457 - DNA, 1689 bp, Homo sapiens
cttattctttgttatatagctgtgaatgagaatcaaggtggtttgtcccagcatcaaatgactggagaaggaattccactgaggagatttagcactgggcgggagggaacacagtggaggaaagggaaggggtaattggcagagtggcacaatcatttggagaaaggccatatatatgaaacaatgactttgctatcctgctatctctcgttcctcaaagccagtccagtaagctgttttgtccccacctccctggggaaaggagtcactcttttccctcaccctctctttccaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255458 - DNA, 2027 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttcaaaaaaggaaggggagatcccgtg

SEQ ID NO: 255459 - DNA, 1453 bp, Homo sapiens
gattactagaacagaaccaccggctggtgcagtcccatgaggctaagtgtaggattgctaacatttggctgtattcctatagaggatcgctgggcctgaatactggcttgaaactcatgatttcccgaccgcactgggtcggacagaccgcatccagttatgcaacaatattctggtagggcaccatgtgagagtggtcataagctggtagtgctagtgcacgaggacgtcaaggctgatggtcgaatgatcagagttatggctctctctgcggcatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255460 - DNA, 1918 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatgggccccacggttcaagcgctccctgcggaaggattgcacgcttttggctggaaccggaggccagaccttggcctaggcgtcctggctccctggcgttacattgctttcctgggcacctagtaccttaagaagacctactgggggcaagcttcttgaaacccg

SEQ ID NO: 255461 - DNA, 1805 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacaggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255462 - DNA, 1780 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttgcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcaggttaacatccgaaaaagagacaattcccggaaggaagtccaacgaaggatctctgctcatcagccagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255463 - DNA, 1925 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggcagagcagaagcagctgctggaggtggaactctacgcagactatagagagaactcgtacgtgccgaccactggagcgatcattgagatccacagcaagcgcatccagctgtatggagcctacctccgcatccacgcgcacttcactgggctcagatacctgctatacaacttcccgatgacctgcgccttcataggtgttgccagcaacttcaccttcctcagcgtcatcgtgctcttcagctacatgcagtgggtgtgggggggcatctggccccgacaccgcttctctttgcaggttaacatccgaaaaagagacaattcccggaaggaagtccaacgaaggatctctgctcatcagccagggcctgaaggccaggaggagtcaactccgcaatcagatgttacagaggatggtgagagccctgaagatccctcagggacagagggtcagctgtccgaggaggagaaaccagatcagcagcccctgagcggagaagaggagctagagcctgaggccagtgatggttcaggctcctgggaagatgcagctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255464 - DNA, 1453 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaatcatctccacttcttcgcgttcggtgatgctgcattaccgctcagacctgctccagatgctggacacactggtcttctctagcctcctgctatttggctttctttgctgacggaggccaacctgcctgctcctgctcctgcttctgcttctgcccctgtcctagagactctgggcagctctgaacctgctgggggtgctctccgacagcgccccacctgctctagttcctgaagaaaaggggcagactcctcacattccagcactttcccacctgactcctctcccctcgtttttccttcaataaactattttgtgtcagcttc

SEQ ID NO: 255465 - DNA, 1223 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgttgccaatgtctcgctgactaagggtggacgtgatcgggtgctgatgtatggacagccgtatcgtgttaccttagagcttgagctgccagagtcccctgtgaatcaagatttgggcatgttcttggtcaccatttcctgctacaccagaggtggccgaagcgatgttcactagtcacgactgcgttgatcttccattaaccgttcctattctgctactcacgacagctgtatatcacttgtcttcatcttagc

SEQ ID NO: 255466 - DNA, 1003 bp, Homo sapiens
agcggccttaccctcctaagagttcctctgctgtacgactgcactcccgcaccctcccctaaatcccccctcttcggcctgtttaccttttaacttggcttcgttgcacgtttgtgtgtgtgtgtttgctcttcgcagcctcttgagcgtcttttgtacttaattcttacactgtggacgctctctcgcgcccgccatcccccgacccctctgatctccgatccttgacgatgtctagcctgcattgattggcccttttccctgggtatggcagatctattgcttgatgatcctctccccccaagaattctaacacaggagctgtcctgaggctctggatgactttattcttcaaatggctttaccctcccagtagctccagagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccatggtcaacgaccctccagtacctgccttactgtgggcccaggaggtgggccaagtcttggcaggccgtgcccgcaggctgctgctgcagtttggggtgctcttctgcaccatcctccttttgctctgggtgtctgtcttcctctatggctccttctactattcctatatgccgacagtcagccacctcagccctgtgcatttctactacaggaccgactgtgattcctccaccacctcactctgctccttccctgtctccgattccgctgcattgggatcctctagaatcagccgca

SEQ ID NO: 255467 - DNA, 1218 bp, Homo sapiens
tgtctggatggctggtacctgaaggatgaaggatgctagaaggagctgctcagatcctggagcataccaactgcctggccagtgggggagcctagctgcctgcatccctgcgcacacccccactgtcgctagttcactgcctgcccctcccccattgcaggcatcctgactctgggctagagacctccccaacagagctgaggccaaggccgactccccctctcaaatggcgtggtctgggcctatgacggcccctgcagtggagtctgtactggctgcgggggaccctgctcatttgaaaatctgacatcagctgggcagtcgcccccctcctcctttcctccctctactctgacacagcacttagcacctgaatcttcgtttctctcccagggaccctccattttccatatccaggaaaatgtgatgcgccacaggtatcagcgtctggatcgccacttcacgttttagccacaagtgactcagtggaagatccagagtcaacagaggctcgtcaggaagatgtctacagaaaaggtagaccaaaaggaggaagctggggaaaaagaggtgtgcggagaccagatcaaaggaccggacaaagaggaggaaccaccagctgctgcatcccatggccaggggtggcgtccaggtggcagagcagctaggaacgcaaggcctgaacctggggccagacaccctgctctcccggccgactcgcaagatggcgccgcagaaagacaggaagcccaagaggtcaacctggaggtttaatttggaccttactcatccagtagaagatggaatttttgattctggaaattttggtaccttccctagtgaatatctagggttctcttccctagttttgcattttttctgttttaaaataggagcaatttctacgggagaaggttaaagtcaatggcaaaactggaaatctcgggaatgttgttcacattgaacgcttcaagaataaaatcacagttgtttctgagaaacagttctctaaaaggtatttgaaataccttaccaagaaataccttaagaagaacaatcttcgtgattggcttcgagtggttgcatctgacaaggagacctacgaacttcgttacttccagattagtcaagatgaagatgaatcagagtcggaggactaggcaaaggctccccttacagggctttgcttattaataaaataactgaagtatacatgag

SEQ ID NO: 255468 - DNA, 303 bp, Homo sapiens
aattgctgctattaaatctttttcccacttccatgcctatgtgcatgcaattcctctgtcctgatgtacccacatggccaaatcttacccttattctaactctcaatttagagaatctccatccatcaaacctacactgacctttcctttccccaccactaagctaaaatgaacttctctctcatctctgaacatccattgcattctatctgtgcttttcttttgacattattacccagttgatacaataattatttaaaaacatgaaatctcattttctagatcctacatagtgagtgttac

SEQ ID NO: 255469 - DNA, 288 bp, Homo sapiens
acaaaaaataccataaactcggcagcttataaacaaccaacatttctttctcacagtctggaggctgggaagtctatgatccaggcaccagtagatgtggtgtctggcaagggtttgctttctggttcctagccggcaccttctcactgtgtcctcacaaggtgggaggaatgagggagctctccggggtcttgtttactcgggcacgaatcccattcatgagggactccacctttatgacctaatcagctctcaaatgcctcacctcgtaataccattacattgaag

SEQ ID NO: 255470 - DNA, 405 bp, Homo sapiens
caagagtgtccacgtatatttagcagaatatacaaagttgcatattgaatccttattttaaaagtgaaacaggctgggcgtggtggctcacgcctgtaataccaacactttgggaggccgaggagggtggatcacctgaggtcaggagttcgtgaccaacctggccaacatggcaagatcccatctctactaaaaatacaaaaattcaccaggcatggtggtttatgcctgtaatcccagctactggggaggctgagacacaagaatcgcttgaacccgggaggcagaggctgcagtgagccgagattgtgccactgcgctccagcctggatgacagagcgagactccatctcaaaaaaaataaaaaataaataaaagcaaaacagttatggtgggatgggagta

SEQ ID NO: 255471 - DNA, 829 bp, Homo sapiens
agcggaggggagcgggcgccaggccggccgggcaggatgcgctaccgggcgtcggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacgggaacccccagagctacctgtacctggtgaagggccagtgtgccaaagtctcctccatcaacgacaagagtgac

SEQ ID NO: 255472 - DNA, 1386 bp, Homo sapiens
ggccgggagcccccgtgcacgaggcaggggtcacggccggggatcgctggggccgaagaacggccgcgtggacccgtgcgggggggggggggtcccacgacccggaggcgccggcgcagcctggtggagacttagatttacctgcggggagcgggaggcggggaagagcggcctgggctgcaggacccaggaccctgcgcgcccttcgggccccgcccgcagccctgctccgctctgggttccggagaagccgcctaaacccgccccttcccgttctccgcccctggggcccagcgcgccccgagtgtgacgggcggggggctccggggtggccggagaaggaggatggccacgcggccctcagtcctcacgctccggcctcccgcgcacacgcctggctctgagattcattcattcatccaggggtccgggaaggggtgactgagccccaccgtgtgcctcgctgcgtgtagggagtgggagccgtctcctgggagggactgacaaggaaacagctgattcctgcggggtgcgataaggaggcgctgcgtgtttgggagaatcaggaaggggttctggaggaggtgacacctgagccgagtctcagtgaggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacgggaacccccagagctacctgtacctggtgaagggccagtgtgccaaagtctcctccatcaacgacaagagtgac

SEQ ID NO: 255473 - DNA, 1064 bp, Homo sapiens
agattttccttgttctgttttgtttggagacggagcttcgctctgtcgcccaggctggagcgcagtggcacaatctcggctcactgcaacctccgtctcccgggttcaagcgattctcgtgcctcagcctcccgagcagctgggattacacaggcgcccaccaccacgctcagctaatttttgtattttctagcagagagggggtatcgccatgctggtcaggctggtctcgaactcctgaactctgatgatccgcccgcctcggcctccgaaagcgctgggattacaggccctgggcagtgacggggttcgggtgaccatggagagtgcgctcaccgcccgtgaccgggtgggggtgcaggatttcgtgctgctggagaacttcaccagcgaggccgccttcatcgagaacctgcggcggcgatttcgggagaatctcatctacacctacattggccccgtcctggtctctgtcaatccctaccgggacctgcagatctacagccggcagcatatggagcgttaccgtggcgtcagcttctatgaagtgccccctcacctgtttgccgtggcggacactgtgtaccgagcactgcgcacggagcgtcgggaccaggctgtgatgatctctggggagagcggggcaggcaagaccgaggccaccaagaggctgctgcagttctatgcagagacctgcccagcccccgagcgcggaggtgccgtgcgggaccggctgctacagagcaacccggtgctggaggcctttggaaatgccaagaccctccggaacgataactccagcaggttcgggaagtacatggatgtgcagtttgacttcaagggtgcccccgtgggtggccacatcctcagttacctcctggaaaagtcacgagtggtgcaccagaatcatggggagcggaacttccacatcttctaccagctgctggaggggggcgaggaggagactcttcgcaggctgggcttggaacgggaacccccagagctacctgtacctggtgaagggccagtgtgccaaagtctcctccatcaacgacaagagtgac

SEQ ID NO: 255474 - DNA, 575 bp, Homo sapiens
acaaaacttagcacaagttcaagaaaatttgctatagctcacttggtaaaaattctgtgttaaatggctgggcatggtggctcatgcctgtaatgccagcactttgggaggctgaggtgggcggatcacctgaggtcaggagatcgagaccagcctggccaatgtggtgaaacccctactaaactgtctgtactaaaaatacaaaaaattagccgggcgtggtggcaggcacctgtaatcccagctatatgggaggctgaggcagaagaattgcttcaacctgggaggtagaggttgcagtgagccgagattgcaccactgcactccagcctgggcaacagagagagactcagtcaaaaaaaacaaaaacaaaaacaaaaacaatagaaggtttattctctcaccctctttttcttgtctctgtcctgtttgagtttgtgctggtattttctgctattttaaaataatttggtcctttaaatgtctatcagcttctccctacttcctaacatgcctcacacataggcctcatggttttccaggtggaacaaccctaagatcataatgctgttgat

SEQ ID NO: 255475 - DNA, 424 bp, Homo sapiens
atgggagagggtctaggactcagacgcacccttatgaggatactacatgacccattacaaggcacaaagtaattaccataggcaaaccgctgatgagagctcactccagtttggaatatattcatgtttccatataagagaaaaattcgtccctggttcagttcatcttggcatcagtacacggatgggattcagagacatgtaggtgtggaataccagattccaccaaacttaaaaagctggcatactaagttgataaaacgatgtagagtgtgaagttgagttgagaatgcttatgccatacagtttatgtatcttataatagccttaatcacacttccagtaattttccctatcattgggtgctaaaaaataaaattaaagaattagaataaaaaatatatatatacctctttgagtggaa

SEQ ID NO: 255476 - DNA, 272 bp, Homo sapiens
tgacaacaagcagcctgtcccaggtgccaatagtgtggaggttgggggaccctggcttagaggaaagaggtgacaaaccctaagatctttgaaggaggcttcccggggagatttacatgctctggcaaggttccctgttcccggggccacgtcctggatcctgagatgctcccacgcttcaccctcctggaattttgctgtatctgacaccactggccactccctcttgcagttcttcctgttggcttccaggtccccacctctgctggctt

SEQ ID NO: 255477 - DNA, 428 bp, Homo sapiens
ttacccattccttaagattaaattgaaattagagttctccttgttttctataggaaatcaattttaaaagacatctttcttttaaagcttttataggtatatcatggtttggaatcaggtcaaatgcaagcagtttgtgtcttaagttacattctacaagtgattttatttattttgtttgtaagttgattatctagaattctaacaggtatctatctctgtaggtatggtattctaaaactaagttaggtctccaagatgagtcatcaagcatacacacacagacagacacatgtttatgtcaatagtagtataaaatcgaaccatcttaaatagcatcatttccatgggacataatataccattatattttctactcagagtatccggaagatgtctcatagaaactccctctccatagctactta

SEQ ID NO: 255478 - DNA, 297 bp, Homo sapiens
ctgagaaggtcccctgcctgcttgaggaaccctgtggagccaggaaagccatttcttctattaggagcttgcaaggctgtgttgttgggcctggccggcctcaattcttcccacctgaagcagaagaaagggttgctcccccacaccctgttctcctccttgcctgcccagagcccccagactccctgcgcacttgctcctgttcttctggtcctcgcaattacatgcatggatttctactaaattgccagtccccgccttcctgtctactagcttggcccccctccaggaggaact

SEQ ID NO: 255479 - DNA, 431 bp, Homo sapiens
gtgtatttagccctctgactagcatgtattatattaggttgttaataaaggtttgttaaagggatgcatgaatttaggagaaaagaaagacgaacatcatggggaaggcatgggagacagaaaataatactaattgatgtagcatagtcattatgagcttgggcagagtcagacagtcctagattcaaacgttagctcttccattctctgtcttcagtttcctcacctgtaaattgggctaataatagtaccttctgcactgtacggtagttaggcaattcctataaagagataagcacacttagggccgggcatggtggttgatacctgtaatcccggcactttgggaggccaaggcaagtgaattccctggggtcaggagtttgagacccttgggcaacatgatgaaatcctgtctctactaaaaatac

SEQ ID NO: 255480 - DNA, 743 bp, Homo sapiens
attgtatttcacatatataaatattaatgtgtaattttatattatcaggatcattctatgcattcttttctgtaaccacagaaaatatattatgactgtatatagtttttataatggttgtacaaaattatatttcagagaaatacttaatttattaaactatttatggataatatctaggttgtttataattttataaccttttttatactctagaggaaatttttgctaaatattttattcatgtgaaagaatatttattatatagttaagtgaaagatacagtagactgaatatctacagagcctgttcccaacttatggaaattctagccaataaattgaaattttttgcatgttcattcccaatggtacatgtcttttgtgatctggaaagtttatcttattttttaattactttatggtttgattgtatatgtatttatctttaagatacaaattgttggccaggtgcggtggctcatgcctataattccagcactttgggaggctgaggcaggcagatcaagaggtcaggaatttgagaccagcctgaccactatggtgaaaccccatctctactaaaaatgaaaaaaatagctgggcatggtggcacacccctgtaatcccagctactcaggaggctgaggcaggagaatcacttgaaccaaggagacggaggttgcagtgggccaagatcacaccactgcactccagcctgggtgacagagcaagactctgcct

SEQ ID NO: 255481 - DNA, 621 bp, Homo sapiens
gacagggtctcactctgttacccaggctggagtgcaatggggcaaacttggatcactgcagccttgaactcctgggctcaagcaatcctcccacctcagcctcccaagtagcttggactataggtgtgcaccaccatccttggctaattttttaaatcttttgtagagacagggtagtgctctgttgcccaggctggtctcacattcctggcctcagttgatgctctggtctcagccttccaaaatgctgggattacaagtgtgagccactgcacctggcccccaatttcatcctttacaaagactactttcaaccataaatcaacggaaacttcagctccctcagacatatttgggatccaaggatattttcccaaatgattaatgctaatttcatatcaatacatttttgcaaaacctacaaaaatggactagtaaagaaagactcttaatttgggaaagacagttacttggagagaagagaaacttaagaggcaggtcgagttcagtgttcagaaatgagaggatcataaagagatagccataaaaatgtttctccctatattgcctgctgatagggtgtatcagtgaaggtcttactaaggaccttgtaccttttca

SEQ ID NO: 255482 - DNA, 434 bp, Homo sapiens
ggttggaaggttgcttgtgcctaggagttccagatgaaccttgggtacaaagtgagaccctgtctcaaaaaaaaaaaaaaaagggatatagtgtcatccgttcacttcttgccacagctggaattggtcaccactgaggcattatagtcctaaccctaacggggtaactaacatttcattactgtcaacagcgagtacctcactctagaaaacagtcttttatgtgtagtgccatacaaccccttttgctttatgtaaaagctgtgtctgctacagctactaaaaagtgaaggtgcttgtgattttatgatacttctgaatgtttctggtaggaaactgtgctactgtccttttgttgtcatgcagtctgagtgagggaagccattgctttggctcagaaacctctctcccacacaccttcaactggaaattca

SEQ ID NO: 255483 - DNA, 1167 bp, Homo sapiens
tctcctcccacacatactcttttagcataatggttgcagtgaaaacaattccgtatagcctctggttattaagtaaatatttatatatttctattaggctgaacacatttatgtgtacttggctcagttaaaatagggcatgcaggaatgtatgtgggggagcatgaagaggacatgaatctgttacctaaattaatatacattgttacttatgttggatcgcaaaagtggtagtataaggtgaacattggcccagttagagatttctcatctagaacagagagtattattttcaccttagtgaccatgagccagtgaagagcaacttctccagatccagtccaaacttgacctaagtctaatgttccccaaagattaggctcttattttctgtcttcagacttagaccaaaacttgaggggtttactgggaaaaaaaaaatctacaatgaggttgacttagaaaaaaaaaaagaatccatgctctatttttgagtcataaggatatagtgtcatccggccgggcgcagtggctcacgcctgtaatcctagcactttgagaggctgaggcgagttgatcacctgaggttgggagtttgagagcagcctgaccaatatggttaaaccccgtctctactaaaaatacaaaaattagctagacgtggtggtgcgtgcctgtactcccagctactcaggaggctgaagtgggagaataacttgaactctggaggaggaggttgcagtgagctgagatcgtggtactgcattcaaacctgggcaacatggggagaccctgtctcaaaaaaaaaaaaaaaagggatatagtgtcatccgttcacttcttgccacagctggaattggtcaccactgaggcattatagtcctaaccctaacggggtaactaacatttcattactgtcaacagcgagtacctcactctagaaaacagtcttttatgtgtagtgccatacaaccccttttgctttatgtaaaagctgtgtctgctacagctactaaaaagtgaaggtgcttgtgattttatgatacttctgaatgtttctggtaggaaactgtgctactgtccttttgttgtcatgcagtctgagtgagggaagccattgctttggctcagaaacctctctcccacacaccttcaactggaaattca

SEQ ID NO: 255484 - DNA, 328 bp, Homo sapiens
gaaaatgctaaggaagagaaaatacatttactagccactaagtggagtgtatcatcgtaacgggctcccctgattgtcttcacgttgagtaggctgtgagcaggaggagggggcggttgtcttgctgtctcaggagtggcagaggcaggagaaagtccacatataagtggaccacacgattcaaacccctgtccttcaaggattgtgaagggcccaggggagggacaggggatctgtgggtataaacagacttctattttattttatttttgagactgagtttctctcttgttacccagcctaggcacaagagcaaaactcgctctca

SEQ ID NO: 255485 - DNA, 435 bp, Homo sapiens
gacttcctgggctcaagtgatcctcctacctcagcctcctgagtaggtgggactacagatgtgtgataccatgcccagctaatttttaaaatttttcgtagagacgaagtcttactgtgttacccaggctggtctcaaactcctaggcacaagatgtcttcctgccttggccatcccaaagtgctaggactgctgatgtgagccactgagccctgccgattcttctgctattttaatcgttagctagagaacagtggccacatgttcatttatgtgtatgtttttctattctagatcataccctcttgtaggattatctcagcccttctaggttcatgacagcacccttcattcacgtgggtggtgcttagcatatatttgctctttctaaagaatgccccaagacaaaaggcagttcttgttgttcttctcctt

SEQ ID NO: 255486 - DNA, 418 bp, Homo sapiens
taacacattaacaataataaatatttatcaaatacctgctaagtgctattcattgcagtagtctctgcaggaagagatcagatgaggaattccatcttcatagggcttatgatctggttgtagtttgtcataaatatgtttatctaaagtaaccttttaataattttacctagatcattccatagaagagattaagtttttctcaattaaactctttcatggtttttataagatttcccattaggaggggatcaagaaggctatgccatataatagactgtcatgttatcaacaccagccctaaatatatatgacttctcagctcagcaagccaccatcaacttactgctttctggtctcatacttgtagctcttaaaagaaaaaaacaaatcaacttgtcttcttctctatccacag

SEQ ID NO: 255487 - DNA, 398 bp, Homo sapiens
ctttgatgttcagctttcatgatgtgatccctgctcttccttccagttgtatcccctggaatctaccccatatatactccagctgttcagaattgctgtcccgtgttttttctcacttctgccaatgaatccctcttttactgtgccctcatcatgcttgactgcagcagacagaggcatcgattttaaagtgtctcctcatacctgcatttttggtttctatatctgttttttcatggaatgtgagacttgcaagggcaaagacaggtttaatgcgcctctacatcttgaaaaaaaaacagagagcaggcctataacaagttttccaaagggatgaacaagtgaaagaaggaataaatattgattttgcaatgttactgataaaggcaaacacaaaa

SEQ ID NO: 255488 - DNA, 512 bp, Homo sapiens
tagagtgtgttggatcacttatcaattgctgcgtaacaaaccgtctaaatttgtcgctgtgaaaacaacactaatgtgactgggtgatattttcattagtctcctttatgctcactcacgtggctgtagtcagctggtagcttggttgggactagatggtctaacatgggcttacttgtgtgtctggtgcctcagttgagattggaatgactaaacttctttctctttgtgtctttcccctgggctttttcacatgatggtgggcaaattccattggacaagtgcttataaaggctctgctctgttgtgtttgctgatgttcccttggccaaagcaggtcatgaactaagctcagagtcagtgtgtgagagggctatgaaaggacctgggactgggcacggtggctgatgcctgtgattccagcactttgggaggctgaggtgggaggattgcttgagtccaggaatttgaggccggcttgggcaatacagtgagacaccatctctaaaaaa

SEQ ID NO: 255489 - DNA, 266 bp, Homo sapiens
ggaattactaggtagaactctcctcaatattgctgttaataatgatcaaaggttttgtaaagtttgtcttactataatactgctagtttgcacagtccagatttggaaataaaatattcatgtatgcagtacatatattaaccactgggtggcctaatttcactttattaaatcaacctggtaaattttcataccttgaatatgattggacttgtcctcaagattgtataataaagattttttttttgtctgtgataaagatttcg

SEQ ID NO: 255490 - DNA, 311 bp, Homo sapiens
cgatgggacagtgacagacagagggggacccagctgggcctgtctgggttcctcttggcctccctgtgtggcgttccttcttcctgcgtgtagggcagggccccttctggaatgagggtcttataacctactttcaggaaagtaagtcagagaacttctttatggccagctcttactcagaaaggcagggaaagttccagtagtgattctagtttctaatggctggctttggggaaagagattctagtttccgtgacctgctttagggaagaggatttctggtttctatgactcacttcttgggggaatga

SEQ ID NO: 255491 - DNA, 378 bp, Homo sapiens
acatacgttctgaaaatcatataaatgtgttcaacactttccctacctctcccagaaagaggaaattaaatgaatccagcttttaacatgcatgaaattttaccaccaatttcaaggggacaatgagaatatataattttctttgagatatttttatagctgttgaaacactatggaactcagcttcatagaacacttaaaatacccttagaaaaaccctacatcaaacttcatttttatcactacctctccaataaataacaataaaaatcagacttaatcatcattattctcctaccagagactatggcaaaaattatttctaacaaatatgtagcaaagtgaattaaaacgaattgttaaaattattaaagtaaa

SEQ ID NO: 255492 - DNA, 444 bp, Homo sapiens
tgcgtgtgcctgtgtgcatatgtgtatgcgtgttgcatattcagtcatggtttctgaaggtgattacaatttttaacactagcagttcaagtccaggcatctaccctgtggcttctgagtttacagattttcaccctttcacaaatgtgcaaaaatgttactggtggtcatgcagaagagatgtacttggtcctgaataaataatgactttcctgaattagttatctgaggactctcttgattgtcaatccatgaggttagtgggcgactgtgtctgtcttgttcgtcttcttgtctccccatccaagatctagaaacttagtccctgctggtttgaaacctgtgtcatgtggaagtgagaccttaaagcgagaaaatcaaagaaagtgagggaaggagatgtcaaagtctaaggcttgagatattggttgtggttgagattat

SEQ ID NO: 255493 - DNA, 486 bp, Homo sapiens
aaagtttgtaggtaagtgggagccacacagaatcatgtactctggcctgcttgtgggaattaaaatcaagtaactgctcgtcatgtgcccatgaaaatcccagagacgttttcaaactgttgtcagcctggtttttgttttattttggcaacatgtcaatctatgccagtaggagcatgtgtgctcacacttactcatctcctcattccattggtatccagtggtctatgggcaggtccctctgctaagcactgggaatacaaaggtgactgaaaggtcctcctgttaataggtaaacaaaagcagccaagaaaatacattcaatacacagcacacccagaagccaaaaaggaaattttaagaacttaaaatttaaaacatttatatggcaaaaaaataaaaaataaaaaaatccatagccaaagtctaaggacaaatactacattggttgttcaaaataaatgtgacagataaatggctacttaa

SEQ ID NO: 255494 - DNA, 755 bp, Homo sapiens
aaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccagagaaagtattaattcagaacaagccaaagaccctgagcctcaccacaaacaggccttttggagtgtgaatttgagttgaagatacaagatcggagaatgattttctggtcttaactaatcctcgtcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggag

SEQ ID NO: 255495 - DNA, 223 bp, Homo sapiens
gtacaacgcaccgtgccccacagcaccctttgagagacacctgcccagcaggaaggaggctgcactggaaacatcacctgagcactccaggcgaaaaccggtgaatcagctctagagggtggcttagatctttcccgcctgggtttctcactgccctgccccaagcagtagaaactgtaattccttcacacaagtctaagcaacatgatttcttcataaacct

SEQ ID NO: 255496 - DNA, 422 bp, Homo sapiens
gagagagagaaaagagagagagtctcttgcaaggaaaggaaacagggccagatgaggtttagagtccaaatttataatatctgtgctgcatgaagcccttagtatactcttagatgcaggaagcccctgggctgatactacaatggctgctaaaaagtaacagaacacttgagaaaatgatctacttgagctagtcagcagatatagcaaacaaaaggattatctaccagaacttgagatgataaataagagactaccaaaagactatttaaacatgaaagagataaaaggaggaatagaaaccacaaggaaagaatgattctatttaaaaaagagatttgtaaaaagaatctaacacttctagaaatgaaaaattggaattaagaccacaatatgtgttgccaaactcattagatacagca

SEQ ID NO: 255497 - DNA, 2194 bp, Homo sapiens
tgatagattggtccaattgggtgtgaggagttcagttatatgtttgggattttttaggtagtgggtgttgagcttgaacgctttctcgatgggtgtcggcaaagatccaggataaggaaggcattcctcctgatcagcagaggttgatctttgccggaaaacagctgggagggatgccttccttgtcttggatctttgccttgacattctcaatggtgtcctactgtctatttctgacccagctcatggaattttttcatcttatactgagctccagaaaggacgtaacttagcatggatcaccaatcaatcaaaaaataaataaatcactaaggattggagaactcatagaacaaggtgaaagacatgagtgccctcccaaagtctgagtgcacgaaaatttctctcttgccttgaggagcagaaaagcttctgatggacatgggcttctgtgagacttatcacacatagtgtatcgtggcatgaagcccggcacatagcaggccctgcatattgatggacaaatggatggcctgcctgccttccctgtccgttcacctgtgcaaaggcttcctcagacatgccactctgtggctcccaatatagggtgcagacaagagcaatccctgacatgacattatagcctgggaaagggctggctcactgatgagaatgtggaggcatcagcaaggatctcggtgggttgctcagagaggtgatgcactaagccttaatcctggacaccagtacccctgcagcatggcttgctcaacaacagtctttgagtggcatagaattccaaagaaaatggtgctgggtggagaatggagagagcatgatggagcagagtcccagtcactgaccaactaactggtcgtttgattaggaaacagtttggccaaagtaccacctttgagacctaagttcttttgatacctttgagaagagccactgagcctgagttgaaatatttttagcttagtcatctgtgtttgctataggagaaattgtaacacaagaaataactcctttttacatgatcatttatatctatatacatatatatacttgcatacactatcactgcattaaaaaatgagtttgggctgggcatggtggctcacacctataatcccaacactttcggaggccaaggagggacaaacgaacccttgaggccaggagttccagactaacttgggcaacacagggcgacccccatctctacaaaacataaaagatttttaaaaaattagccaggcatggtggcacatgcctgtggtctcagctacttgggaggctgaggcaggagaatcatttgagcccaggaggtcaaggctgcagtgagctttgatcacaccactgcactccagcctgggcaacagagcaagaccccatcctccacccccccaaaaaatagaaagaaaaaaaaagtttgcactaattgaggtacatctgcaagtgagactttttgtcaggaaaaggcaatatatcaggtctcctcaggacgatggaggccttatatggtgtgttaccttgaaaactgaatatcaacgttcaccttgattcaggaaagctgggtgctgtctccatgccatgaatcatgagagcaaaggatcactgcttaaaaatactgaatttaccttcacaaaagatttctaaagatttatgtaatgtgttttaaaagcgccagtaaaccatcggatcaattggaaagaaggcaactcttcagcctttgttatctagctgaaaacaaatgacaactttcaaaacattggcagtagttgttgaaaaagacgtctattgttcaaagtttctttctccttaaaggacggtgttccaatgaattcagtagagcccactttcctccactgtggaggaagaatccctaagagatactcaaatgattaaattaaaattggatcatcaaactcaagagaggcataaacttagacacagtcttgcatttttgtctttcctgaactcttctgccattttcctccttcactcgtcctgaaaatctgcaagttacataataaaactttagatatttgtctgacaaagtgtaattactcaactgaataaatgactgagaacaagttacaaaaggaatcatgaatcctggtaaacaataaagaagattcagacactgagggaaaaaaataaagctttttacttaaataatgcaaaaaaa

SEQ ID NO: 255498 - DNA, 335 bp, Homo sapiens
gtctaggccaagaacccaaaagaggctttgaccattcctcctgctggaatagatttgggggtgccttttttttgcatctctttaaatccaccaattaaagctaagaactcatagatcagaagaggtaaaaagaaatggctaaagtgagaagctatgcttgatctaaaggaatcaacaaatttgcctagagcacctgtgtagccaagctgttccccgaagtaaattcacagtggagagcgccagacccacacttgatccaaatgttcatttattccacaatgaaagaacatgttccttttgttaatgggaccaacccataaagaaaaacaatgata

SEQ ID NO: 255499 - DNA, 355 bp, Homo sapiens
ctgtgccagcctttgggttgctggcctggacaccagatgctgtgcagagttgctctggctgaggctgccttagcaacaccctctttccagtctgggaagatccagaatgtgggcaacttcgggaaatgggaaaatcagaagatacatcctggtaggactgggggcagagaccaggagagacaatctgaaagataagtattttttgaatacctaccaggtgcttagccctgggctggacctgggaaatacaaagatgaccctctagtcccagctactggggaggctgaggcgagaggatcactcaagcccaggagtttgaggttacagtgagttgtgatcacaccactgcgctcca

SEQ ID NO: 255500 - DNA, 415 bp, Homo sapiens
tgcatgtgattaacgctgtcttacgattgggctgttgatgctccgccaacattgggttacacagagttcagcaagccatctgggaagaaaactggaagaatcatgagaggatacctctgtccccttaaggtgttaggagtgtgacttggtgttgagccctgtggctacagccagtggcagtggcaccaaccgctcccaagttacactggggagaaacacatctgagtgccgtgcgtctgtacatatctatcaggagggagggggcagagggcgatacttcatcgagataaatgccagcggtgtattttaatacattcttgattcagaaggcactgtttggaattgcatatttaaaaggaaactgccatccccttttgaaggtatgtgacatttaaaagatctgtagcagaagatt

SEQ ID NO: 255501 - DNA, 413 bp, Homo sapiens
tctgttatttccattttatgaaagaaaaagtataaggggagaagacagcagaagtgttttaagtaaaaatttccacataatttcaatataaataacttgcaatgtgaaaataatatatttataaccaacaaaacattttaactgattaaaaagttaccaggctgggtgcagtggctcacgaggtctggagttcgagaccagcctggccaacatggtgaaactctgtctctactaaaaatacaaaaattagctgggcatagtggcaggcacctgtaattccagcaacttgggaggctgaggcaggagaatcacttgaatccgagagcagaggttgcagtgagctgagatcacaccactgcactccagcctgggcaacagactgagactccgtctcaaaaaaaaaaaaaaaaaaa

SEQ ID NO: 255502 - DNA, 118 bp, Homo sapiens
ccaacatatgcacacaaagaatgtttattcaagtgttgtttataatagcaaaaaatatatcagcaacctaaggttctagtaaaaggaaatcatttaaacgctggtgcttccccacaat

SEQ ID NO: 255503 - DNA, 424 bp, Homo sapiens
tcttcaagttttacagtactctctgaaactttaccatgagcttctgtgcgggggtctttcccgcagaccctgacccaatgatagatgaataacgtacactgaaacagatattctgcttgtcagtctagctaaggatctgcgcccctcacagacaccaaggaaggtgctgtaaagagttggcagccacagccttgactagctggcctggctggcatttattcagcacacattaaatgacaaaggctttgagtcaacacacctgtgggtaattaacctggtcacacccactctggagagggccatcttgcctgccaatgattaaaggttagtcttaggaccacatgagtaaacaagctatttagataaactattctacattcttttgtatccgcaccctaagctctctggctcctgaaaacagact

SEQ ID NO: 255504 - DNA, 454 bp, Homo sapiens
cgataccgctggggacccctagcaagctgtgagggatgacccatggatcacaggtcatcccgggggttgttaaccctctcccacagccaggtttccaaacatatcacaatgacaaaatgagtgtcctcagcatctcacatcatggtggcagaggagcccctgagcagaaagtgggaggagtgagaagctgggatctgttgcagctgatgccaggacatggctggggagaaggtgggcaggaggatgaaaggcaggctgcaaggtaccccattagtaagtgagagacattagcactcagcctcacgcaagggtaaactcacccagtccagcctggactcccagctcagagacgaagagctagtctaatcttattacttaatattgttagaagattctggaaagacagttttcttagaaaggaggagagcatgggcagaaagaaagaaaaaaaaga

SEQ ID NO: 255505 - DNA, 600 bp, Homo sapiens
gcgaggaccaggagaaagacgaagctcgaaattataaatgtggccaagcacgagagctgaaaacaaagcgtattttcccgtcagatgtttctacaaataaatttcgccagagttctgttttctgaatcagagaggcaagggaaatcgaacaaagacagtatttcaccctgggctggcaggcagctgttagaggtatttacggccttgccgcagtgcggcggccaggcagccgggtagggtatgcgggggcaccggaagctggggagaagccatgaagaactcagaatttcaacttaaattcaatttagggtcacgttttcggaaatggcgtgaacagatgccctctttctagggactggtcctttagacttgatagttttgcagaatgagggagaagttgtgctctctggatgtaggatggttttccccgccttgaagaacgactcaaagggaagcggtgcccaagatgtgacatttctgatccacataacaaccttcagagtgttcattggcaacgaggagatgctgcttgttcggcggaatagggtttgcaaatcagaaaggacagttgaagcttttaatacatgttttcctgaaaaa

SEQ ID NO: 255506 - DNA, 604 bp, Homo sapiens
tgagttgggcttatataattgcacccatttactcactcattcgttcaatcaattatttgttcctattttatgccaagtaatgaacagaaggtgttggggatgcaaaacccaactaattggaatttctatgttacaggagcttatgctttagtgaaattatagacaaattattatacagttttaatccagaatagtaagtgctatgggagcatgcacagaggaaacaacccaatcttaaggaatcaggaaggtttgcagaggactgacaggaaaagtgggcaggtgaagaagatgggcagtgagaggaggagtggaagcacttttgctagggaaaaacatgaataaaagggataattttctgctcttacccctgggtgatctttgcgtggtactgtccatcacagttgggagagacggctcctcagagctgctccacactgttcacagaggatgccattccaaggaaactggggaatagggaaagtctttagcttattcctctttgaggtttgtttgagatgcagtttcttcaatattttgagtctatgaaaacatgttgtatacttaaatatataccacaaaaaataaaaaaaattgcgattta

SEQ ID NO: 255507 - DNA, 566 bp, Homo sapiens
ttttccccaccggttcccctccaacccgcgtccatgtgtgacacctcgttgtactgctattgttataacccaaccagaggtccaagtatagaaatccccttatgggcgtccccacagccaggcgatataagcttttgttcttttgctagtagagatatatcacctgttaaaaggaatcgtgcttaagcatccataggacgtgtttaggatagccccaggatcagatgctctttttttttgtggtttggtccaaagatacacctgatccataataataatggtttgatggtgattatgtttagattaaaggttaagcccagattatctgtttaggaaaaaaaaaaaagaaaaaaaaagaaagaaagaaagacctgaaaagaactaattaacgctcatacatagaatttttgatgagaaccttctggctctaaagaaagtattggtcaactatactgtctaggctaatttcttagaaaataatgagcatagttaaggataactgagaaaatgtaaactatggagactgtatcccatgtcaaaattaaaaaattggtggactgatggga

SEQ ID NO: 255508 - DNA, 573 bp, Homo sapiens
gagctgattattatatttttccctttacttttttggggcactgctaaagatgtatctgaagcagggcatggaggtatgcacctatagtcccagctactcgggaggccaaggcgggaggatcctaggaattcaagactagcctgggcaacatagcaagatccccatttatgcaaaaaattttaaaaaattagccgagcctggtggcatacacctgtagtcctggctactcgggaggctgaggcgggaggatggctggagcccaggagtttgaggctgcagtgagctatggttgaatcactgcactccagcctgggcaacagagagagaccctgtctgttaaaaaaaaaaaaaaagaaaaaaaaagaaagaaagaaagacctgaaaagaactaattaacgctcatacatagaatttttgatgagaaccttctggctctaaagaaagtattggtcaactatactgtctaggctaatttcttagaaaataatgagcatagttaaggataactgagaaaatgtaaactatggagactgtatcccatgtcaaaattaaaaaattggtggactgatggga

SEQ ID NO: 255509 - DNA, 437 bp, Homo sapiens
actgcctccctttcctgcaaggacacacaaggtcgcctattttcatcacaggttcgcacctccaagccttcatccttcatgcacctccttcctttgcctgggttgccgttccttttctctctgctcttccttctcggagataacgtatattctcctccaggaagccgtcctgaatgcccccagtcagcctcacctgctctgagctcccaagtacagtcctatttttgggcctcaatttgtcaccttttgtgggacccgctggtactctgggttctctagttaatctttgacctttttcctagtacagggacggcgcacatagtagggccacaggcacagtttgttgaattaaatgaggctggagagggcgatggacgcagtcctctggagctctccaacttcctggaaagttgtaccttaaataaaaaacccatcct

SEQ ID NO: 255510 - DNA, 500 bp, Homo sapiens
gttgtcccctcaagcactccctgctaataagcactcagccttccaccccaaacatctagtctgtctggtgaattcctggtgattcttcagtggtctgtctcaaatatatcttctacgctcttttctctttagtcttaactgccatccaaggcaacattagttagtccctcattataagaggcaatataagctggtgagaggtatatacccacagtcctagctacttgggagtctgaagcaggaggattgcttgaggccagcctgggcagcatagcaagaccttgtctctttgaaaaaaatagaaagaaaatgctgggattacagtcatgagccactgcgtccagatggaaagtatctttttaaactttatatccctccctagaatttatcccctaatatatggtgtttatggaggtggttggaatcaactactttttataaatatattattaaagagttgacaacccctaaaaatcttttagatgctagacaaaaaaact

SEQ ID NO: 255511 - DNA, 704 bp, Homo sapiens
cacatatgtccaaagagaaaccatgaggttttaattgtggtcaaaagcattctacttatagacttgaatccagatggatgaattcactgctcaacagcataggtatgaatttgtttaatcaacttcgtaagaaccaagtcaagttcagatacacttactttgcagtctaattttctaggggtcccaaagttttaatacaatcatcttctctgatttcccacaggaaatgatgatcccatacatttaaaatgttttaattactcaaggaatacaggaatacatgattaaacacaaacactacagataagcctcaagtgcccttttgcttctgtctgaaattcttgtcccttctcctgcttttgtaggtaaaaactgctatgaatttgatgccttcaaagcatcatttctctctctctctctgtgtgtgtgtgtattcacaaccacattatatatattattttgcataggtgcattttacataaatggttatatatacatatatatgtgtatgtgtctgtgtgtacatatatagtaagtgttgctgttttcagctaactatatgtcatagtaatctactggctttaactcaatcctttgaccagctgtcccaaattctaggctattaaatatgataatgcactgtttattgtgccatccccttgttggaggacactggagttgtttccagttttttggctgttgga

SEQ ID NO: 255512 - DNA, 638 bp, Homo sapiens
tccgcctgcctcggcctcccaaagtgttgggatcacaggtgtgagccaccgaccccggccataaagaacttttatatgacaaaaatcacaaagtgaaaatgcaagccaggaacagagagaagatatttgcaacctctataaatgtcaagaggttaataccaagaatacataaagagcacgtcaattcagcaggaaaaagcaccaaacagaaaaatttgcaaaggatatgaataggcagtacagggtggtggaaaccaaatggccaataaatacaggaaaggaccaccaacctaaatagcaatcagagtaacataaattttaaagcatcaaagacacaatttcaaacttatcagattggcaatagtccaaaaacatcaagttattggcaatatggagcaagaggaaatcttacttattgctggtgggagactaacttgttacagacattttgctgaacaatttggaatacctaggttacaatggaaaacatgaacatctcacattccaatagttcccatttctagtgataggtcttagagaagccttcacacactgcagaagaatatttgtgtgctatttttaatagtgaaaggtaggaaaaatgtaactttacctcagtaaggaaaaggctttatctg

SEQ ID NO: 255513 - DNA, 465 bp, Homo sapiens
tggaccgagcggaggggagctgaggaaactttccctgcttggccaagggaaagctggcttggggtggggctcctcatcagctccttcacctcctcgtcttctctggacaatttcagatagacatcaaaggtggcaagaaatagtacagataattccatttgcccatacccaggttccctgaatgttcgcattttaggacttttactttgtgtgtgtactcgtgtgtgtgtgtgtgtgtgtgtgtgtgtgtgtgtgtgattttcttctgatccttttgggagtaaattgcagacatgatgccccttcatcctaaaaggtgtccatatttcctaaaaccagtacattctcttatataaccgcattgtaattatttcaatgttaattccctgcttttaataacaccatcacctcatctacaggcctcattcagatcttgccatttatcccaacaatatcctttatagc

SEQ ID NO: 255514 - DNA, 363 bp, Homo sapiens
cattgggttaatgtgagacttgaatgacagaatgtatatgaaagcttttcataaaccagagtcctgtataaacactgtcattatctccactcatgaaattcccaagcccagtgtataaactgtttgtgcattccagttttttgtttagctgtcttacaaatgtatggcattattgcataataaaatgaacatttattgaacacctcctgtgtgtaaaagcgaagtgttaggtgcttgctggtggtgggaggagaaaggaaggggtttagaaataaacaagatgtgccgggcgcagtggctcacgcctgtaatcccagcattttgggaggtggatcatgaggtcaggagatcgagaccatcctg

SEQ ID NO: 255515 - DNA, 364 bp, Homo sapiens
aggctgagctctgataagtaaaccattctctgatgtcaggcctttaaaacagcacccattggctgggcatggtggctcacgcctgtaatcccagcactttgggaggccgaggtgggcggatcacaaggtcaggagatcgagaccatcctagccaacacggtgaaatcccgtctctactaaaacaacaacagcaacaacaacaaaaccccaaaaagttagccgggcatggtggcgggcgcctgtagtcccagctacttgggaggctgaggcaggagaatggcgtgaacccgggaggcggagcttgcagtgagcagagatggcgccactgcactccagcctgggcgacagagcgagaccctgtctc

SEQ ID NO: 255516 - DNA, 278 bp, Homo sapiens
  misc_feature (143)..(143): n is a, c, g, or t
gtttatgggtttctatagtacagatgacagggcaatagtttactcacatattgattaatgttctgtttgcttataaaattgtaattgaaaacattactctcagtttaagagatttgaagtgcatcagtaaaatctaaattggnatatctagactgattagaataatatatatgtcctgcataaatcataatgttgtttaacaagggtagcatagtcttaggaatctacttgagttttatttatgcatgaataccatccacaccctttgtggatacatg

SEQ ID NO: 255517 - DNA, 695 bp, Homo sapiens
agcctccctcagacttagtttcttcgtctgaaaaatgggcgtaattactacctgatggggttattgtgagaatcacatgagccaatctatgctcatggtgcaaagcatggaactcctcttgccttctgaaattatgtgagaagatctccagcaccactccttcatcccgagactctcccagccttgcacagtccagagaaggtcactgcagattaaaatagacctaaaagacacatctaccaaatgcagcgtgtggactttaggtggattctgactgaaacccaccaatcccgcttgatccgtggttccactttccaccattgcagttgtctgtggtacaattcaataagatagtcttagggagatagaccacattcacataacttttattacagtgcattatcaattattgttgttaaactcttactgtgcctcatttataattacactttattataggtgtgtatgtataggaaaaaatatagtatacaagggctcggcattatctgtggtttcacggcatccacaggatctcggaacatacaccccgcagataagggggtacagctatataaaaatgtattcttgagaaaatcaggaaaaggcaaataaggattgggcattaaaagatgccaaagtggctgggcgcactggctcaagcctgtaatcccagcactttgggaggcctaggcagg

SEQ ID NO: 255518 - DNA, 463 bp, Homo sapiens
aaatgttttcaaggttcatcgatgttgtagcgttgtgaatgttggctttttctgtgattaacttttttaccccttatagctgtctcaggctttggcatatgcaaacatagtcaacatatctattaggatccgtatacctcttggtgttattgattgttaatgtttttctaagaatatagtgcgaattcagagctgttttaccaacatataagtttgttcaagactaaaggtttcagcagatgttatcttggcaaattgtcagtgtaacttgaaaaaatcactagaatacttttcacttttgatttttcagatattttacactgtgccacgtgttactttctgtagctgatgttctgaatagttatacctcctgctaatgtccaattgtttaaagtatattctagaatgtttcaagactgaaaaaccagtcaatggcacctgtcaactctttggtaaaaaaaaa

SEQ ID NO: 255519 - DNA, 247 bp, Homo sapiens
gcaacatagtttattgcccactcttcaatcctggagaccctgacctatattttgctttagatacccacatccattaccatttgctagactttgtcttcacttgcaactactccacctttggaaattattttgacttcattatctcactttctaaccacaatgacttattcttccagcaatcccattcccataggagttactctttgaatttattgatatcacaagcatcttaactctctattttatg

SEQ ID NO: 255520 - DNA, 465 bp, Homo sapiens
ctcttcttgaggcatttgaacaggattacagggcagtgaagcttaggattgtatgtgctatagatttagaaggtgatttttaaatccctagatgtagatgagccgctggagttggtaaaacagacatttcttccctggaggtatcttgactgcctccattgtgaagtggggaagggtatctagcccacctaatgagctgccagtgcctgattgtagaatgagtggctatcctcagtgagtaattaggatttgtatttttctctcccaggagctattagtagaattctgacatctgatacagaatgagtcacagactgagaagtaaaagttaatgatcagtgacacacagataattagagaaataaagacgatgtagtccatttccatgaaagatgaagtgggcaaaagagacattagtggaacttatctcatactctttgtcttttttctaatctttcttcccac

SEQ ID NO: 255521 - DNA, 567 bp, Homo sapiens
acactaaaagtaaagaaaactgtagagcaatatcccttatgaaggttgatgccaaaatcatcaacaaaatactagcaaatcaaattcagtagcaggctgaaaggattatacaccctgaccaagtacagtttgttcctggaatgcaaggatggttcgacacatgaaaactgatcagtgtaaacagaatgaagggggaaaaacacatgatcatctcaattgatgccaaaaaaaaagcatttgacaaaattcaacatctttcatgatgaaagcactcaatatactagaaatagaaggaaactacctcaacataataaaagttatatgaaaaatctacagcaaatatcatactcaatggcaaaaaaactgaaatcttctcatctaaaatcaggaacaaggcaataatgcccacttctattcaacatattactggaagttctagctagagcaattggacaagaaaaagtggggggtgggggagaagaggcatccaaactggaaaggaagaagtaaaattatctctattcccagatgatgtgatcttatatgcagaaaaccctaacagttcca

SEQ ID NO: 255522 - DNA, 674 bp, Homo sapiens
taacaaaatatttaacttctaaagttaaaaaagatagctataattaaattttaaaaaataaaatacccattgattatccagttttccaaaaaataactaatgtgtaacatgtaaaataaaatccatgtgtaagaacagatgactaatacctcttgcatgaagttcttattcacttccaaatttatagattacaataacaatagcattattttatatatcattttatacaattctcaggtattataaattatccttgaagtatgtgttaacagtgataaacttttaataaattatattctcccccatgtcatctgcatttgcttttttgtattcctacacaatatttcatatccaaactgaatcactgtaatttaagacaatgtcaaaatctcaccacttttgctctgtctgcttaagacccagtgccaaatatccttggaaaattggcagagtttaaggtgaaatctatagatgttgatagagatcaatgtggtctctaagaagtagatggttatcttgctcaaagtcattttttcacttaagaaatgtaaaacacttccattcaccattataatcaatagtctttgtaagtgatgcaactagagacacttgagcaggtacaaacgagctgtccagttataactgtctacctggaatattataagtccatctcc

SEQ ID NO: 255523 - DNA, 681 bp, Homo sapiens
gttggtttcctcattggtaaaatgtcaattagtatctaagtggtgttttgagcattaagcaagagaacatctgcaaagggcccagtccagtggatgacccatagtaggtgtggagtaaacgcagctttccagcagctgaatcaccaggagattttaaaccctttcaggtttagcagccaagagccatccctggatgcagggatttcaggtgattaagcagaaggagcttccccaaattcaggtttaaactggtggggagcattcactgagcctgtcttttggactgtgtcccaggctgtgaggagcagacaaagccagataagctagcgtcactgcctctgagccatccatactttcttggacagccagatgtgtaaggagctgatggcaattctatgcagatgataaaggtatattactggagtttgaacctatccctgtgggattccaaaggagacagcaattcattctaactgggaggatcaggaaaaaattacaaggcattgagcttgtaaatcaagtaagatattgaaagagaagatcggaatggctttctggaagaccgaacagcctaagcaaaggtagaggatagtagacaggaatgttggatatttctgcatctgtatcagaagagtccacattaaagtgtccatttgtgcattttacctatctatgggcctc

SEQ ID NO: 255524 - DNA, 403 bp, Homo sapiens
gcagccttgattcctaaacaagaagttggtcctaagtgcatcctcttgatgtggggcagagaagaaatctgagacagtctcatgcccccaccgccatcgtccccccacttttttgtgggggtgcccaatctgtgctctgccccctccccaggctccgctcctgtgggctgcgtcgtggtttctcctctctgtgggacgtgtgctgggcccctgggggtggatgcagaccgagcctgggcccatgtagaccaactggcgtgggtgtgagagagagagacgcatacccactcaggcacatacacgtgcacacacacacccatgcacgcgtgtgcacacacaccctggccctgttccctaccagtccccaccccctcctgctgcatgtgctcctggttccctctct

SEQ ID NO: 255525 - DNA, 440 bp, Homo sapiens
gaccagtctgggcaacatggcaaaaccctgtctctacaaaaaaaaaaatatatatatatatattagtcaggtgtggtggcatgcccctgtagtcctagctgcttgggaagctgaggtgggaggattgtttgagccagggaggtcaaggctgcaagtaagctgtgatcatgccactgtactccagcctggctgacagtgagatgttgtgtcaaaaaaagtaaacaataaaaattaaaaagtcacaataacagaagaatctgcttctgctaaccaagacgcagcagacaagttcccagatgccattaagaaaatcactgagggtttggcgcagtggcttacatctgtaatcccagcactttgggaagtcaaggcaggcagattgcttgagcccaggagttcgagaccagcctgggcaacatggcaaaactccatctctacta

SEQ ID NO: 255526 - DNA, 433 bp, Homo sapiens
gatgacaaagcaaagatttcagaaaggagcaagttttaagaataaatgtgatgtgatagaagcagaggcaaggttggcagctaactggtttggtgtgatttcatggtttgcaaccaggactgagtgtctgattctttgattttctagagacattcctaatttcatccctaactctccccagataaattctcatctcttatcaaaaacaaggtccctggaatggaaagtcagggaactccctgaggaaatgagtgtttagctgtattctcagtcatgtaggttttgttgatcatagatatttttgaattgatgctttcttgtccccatctctccttcccttaattcaagtcatacttatcactcctttcagcctctggttattccccctttctgattcatctgtcgtatggacctcaaatttaaaaagaagaaa

SEQ ID NO: 255527 - DNA, 646 bp, Homo sapiens
gtccggggagggttttttcccttctaaccacccgcgctctcacactttgcctccgctccgccgtttccatggctccggtttcctactttcctcttgtctcctccgtcctcagcctgttctgtaatgtgggatttactagaagagcagggctggtgttcgaggaggagaagttgaaatcctagagggaggaaggcggggaagccaatactacttgctatttccactgcaatgaacgtctctgtgtcatcaaaataagaacttcaaccccaaggttgaaacagccaagcagaatttgatggaaatatatttaggaacagctaaattagcagtgcgacgcgtgttttcttttcattgaagaattcagccagttaaaacgagtctaaatggaagtctgaaagctttttcttcattgttgaggaataaaatatttcgtgtatttttcgttttccagattcattcatttaacaaatatcagttgagcactttccatgccgtagggcctgtacaaggcacatagcattctagacatctgaagcatcaaaactaatcatttttattttgaagaaaatcactcaaaatattttatgtactttgtgcctttcatgaacagaatattccaagcattctctgcaaaatacgcatgaaa

SEQ ID NO: 255528 - DNA, 809 bp, Homo sapiens
aatgaatatagaatctaccttacaggggtttatgaggattaaatataatgttaaaaaaaatgcttggtctaatgcctggcataacactaagctctcaaaggtagatgctattaataagcattgtgtgtgttcctatgaaaaaattgaattattctctgtatttaattgatttgtaattgtacctaatgattaatatatctgtttctctgataatccagtttcatttgtatgagcagctgtcataattaaaagccgataaaagtttaaacaagatgcttactatgtgccaagtaccttattagtcaagattttcagtttacagtcttaaggtttttgttccataattttctttatcagaactttccttttggggtggtagaaatattcgaattgtggtgttggttgcattcaacttggagaacatactaaaaaccattgactaggacactttgggtgaattgtatgttatgtgagttttatctcaataaagctgtttttaaaaaggttaagcatatatatgttacacaaaattaaagtagtttttcagaatttaacttacagatctttcaaaacttaagagcttttacagaacttagtagaaaaagaaatgaacaaaagcatgtcgtgagtggtgacaacaggatttatttaaacctgtatttatttatttatttatttgttgttttgttgttgaaacattaacattctttaacttagaaagccatgtttccattgaggctagagtgtgtattccagaaaaatgccacactatatgttgtggaaggaaaatccacatccttttattgagt

SEQ ID NO: 255529 - DNA, 945 bp, Homo sapiens
acctaaaactgctaaaacaaaaatataaagacaaggactaggtgattaaggggagagaaaaatcatctcttttccaggaaacctttgctaaaagaagcaaaacttgactctatgcctcatggaaactgacacaaagaaaagaaactgatggattgcacaggccttgttatagaaatagatctataaaaagatctgtccacaggaaatatacaccttctcctggttctgaacttcaatggggatttgtcacctaggtctccatctataggaataccttcacatacctatctattcatgcacatattctgaaaacaggtacatacaaaattacaacaaaggaaaaaaattctattgaacacttaaaaatagaaacaggccaggcacggtggctcatgctgtaatcccaacaatttgggaggctgaggctggtggatcacctgaggtcaggagtgtgagaccagcttggccaacatggtgaaaccccgtcactactaaaaatacaaaaaaaaattagcctgtgtggtggcacactcctacaatcccagctactcgggaggctgaagcaggagaatcgcttgaactcaggaggcagaggttgcagtaaaccaagatcacaccactgcactccagcctgggagacaagagcaaaactgtgtcttaaaaaaaaaaaaagaaacaattagaatggatagctacacatcaaaatataaaaaggaaatagaaaaatagaattaattatgtgtaagcaaacccagatttggctgctgtctgctcaatagccgaacactagaagtgagagttgatgggaggaaaagcaggtttattcagagagccagcaaacatgaagatggtgatccagcatcctaaagtaccatcttaactcagtacacattgtaggctctttttatgttaagggcagggagaaaagaagggggttgaaatcaa

SEQ ID NO: 255530 - DNA, 818 bp, Homo sapiens
agccataagggagagaaaacatacatactattaagtggaagtagataatcataaaagtatcttccctgtcttcatattgagtagcctaaggaagaagagcaagaggaagggttggtcttgttgtctcaggggtggcagaaatgaaagaaaatttgtatttaagtggacccatgcagttcaaacccgtgttgttcaagggtcaactatattttgctgtcataaaccaattaaaatttttaggtgatttttaaaatcaatagataattagtttaaaataagtaagtaattgaagtttggcattgaggttagtatagtatagtatttaagttagtatatgcataattttaatagcaaatgctgaaaaataactattaaatagattagatgctatctgaatagagtattatatagccatttgtattagtccattttgtgttgctgtaaaggaatacttgaggcgctgggtaagttataaagaaaagaagtttattttggctcacagttttgcagaccatacaagaagtgtagcaccagcatctgcttctggtgagggcctcaggaagcttacaatcatggtaagacaaagtgggagcaggcacctcacatggccagagaagaagcagaggaggggagaaggaccagagacagaggaggggacatatatccaaactatatcaccattgaaaattgttgggtgggcatgctggcttatacctgtaatcccagctcttcgggaggcggtgggaggattgcttcaggccaggagtttgagactaacctgggcaatagagtgagtcctcatctctaccaaaaggaaa

SEQ ID NO: 255531 - DNA, 425 bp, Homo sapiens
aaacactgtcagtgctttcataaactgggtcactgcggctagtgctctgggatgtacaatgacagggcaggaagtgcccttgaattacacagtgagaccctctaattctctttccttctgattacaacaaggaggttgtttcagtttggagctgatggatttgaacacctttccaacacttgcttgttactattattactgttttaacaggccatatgttcagagctttttggcaggtttctggctagaatttaatttgtttgctttgtttttgttgcatttatttttgtaattaacttctgttcatggccattgatattggtcttccctttatgttgtgatcatgtattttaaaaaataaactgaagtcagacataaaagttctatttaaagaaagaaatagttatgatgttgtgcaacgtggc

SEQ ID NO: 255532 - DNA, 462 bp, Homo sapiens
gaactgttgaccaaaatgaaatagattattaatggttacatctgttagatggtaacaattactgaatggtaatttttcattagttagaaaagtttggaaagagcatctacttatatagctttttttccgatgttctctttcaaaaacaacagcagggttttttgccccattgcatggtgcttacaataattcattaatttatattcttgggatgtgctagaaacacttagtccccagatacatctttggaattgagtaataatgaatcttttctcttttcagccctccccctgccttttgtggcaaaggaaggagagaaagagaaaatgcagctagtgataagcaaactagccaaagtatctttgtgttgttattctgaagtgaggtctactcactttttatcaccatttaaacagaacttttaaaaattgagatggtatgatacaatatttcatttcttat

SEQ ID NO: 255533 - DNA, 342 bp, Homo sapiens
tgctcctgaatgctttcatccatttaaggaacatttacggcactgtgagagaggatgccaaggataccaagagacctgccaaggataccaaggatgccaagagatctgatgcatagtcttaccctcaatgggcttacaaagtactggggggagactccgatccggccgctgccatgttggccaccaagggtatgggtttggtggcctctgagcaaaatgcctgcctttggcagggagacggacctagctctgctgctgaccagcagtgtggcattggccaaccatcctaaacttcttgcatccttatccataaagggcaacacgagagctatcatttaccac

SEQ ID NO: 255534 - DNA, 424 bp, Homo sapiens
ggcaaacttttttctgcaaaaatcactttggatttgcagactagtctctgtaaactataaaacttctgttgtaaggagaaagcagccataggcaatatgtaatggaataagcttggctacatttggcccacaggtcctagattgccaatccctgatctgtagaacaaactaccaaaatagggatatacattcattagaactacggagcagctgagacatctattttgaaactagtcattcattttttccacctattagaacaaaaaatatacctcccagtacctgtttccttgacttaaccctagctaccacacaaactggttgcccaacaagcagcccataaaacaaacagtacaaataatatatattcttaaatgaatgccatatattctccaccccatgatcctacaagattgctggcagg

SEQ ID NO: 255535 - DNA, 354 bp, Homo sapiens
  misc_feature (41)..(42): n is a, c, g, or t
acccaacacacacatacactcacacacccaacacacacacnnacaacacacactgacacacactcacacacacccaacatacacacaccccccaacacacacactcacatacactcaaacacacacccaacacacacagaggagtccttctccatgctgctaacctgagcagccttctctatgcctccatcgcatctcacaactctgtggcttaagattctccagtggcttcccactgcacttagacaacaatctgtgagggtgacgtgaaggtgcaacatttatggggagcaactctggggcacagtgaaagggagtgaaggagaaaaagccccgatcattaagccagacaag

SEQ ID NO: 255536 - DNA, 692 bp, Homo sapiens
  misc_feature (532)..(532): n is a, c, g, or t
  misc_feature (555)..(555): n is a, c, g, or t
  misc_feature (568)..(568): n is a, c, g, or t
  misc_feature (578)..(578): n is a, c, g, or t
  misc_feature (609)..(609): n is a, c, g, or t
  misc_feature (659)..(659): n is a, c, g, or t
gaaatgaagactggctctgtggtttgaatgtatcctctctaccttctccttttcctccttcttcttctttgggctatgtatccttaaatcacttctttagaaaaacagcatgagaagtactttctaaatacaggcatacctcagatatattgggggttgtgtttcaggccaccataattgtgataaactgaatatcacaaaaaggtaagtcatgcaaattttgtggtttcccagtacatataaagtcctttccccattgcttgttattgttgattttgtcaatgaccagatgattgcaggtgtgtagctttattcatgggttctctgtcctgttccattgatctatgtgtttgtttttgcatcagtaccatgctgttttggttactgtggtcttgtagtatagtttgaaatcaggtagtgtaataccactggctttgttccttttacttagactagttctcactctcgtgccggttttatctggttaatattaagcactggcatggtctttataaaattaggctatttcttnaatttatatcctttagttataantttaaaagatgtnaaccattaanttacattttagaaacattctatttgacactngtattaactcgcatcatgtgaataacattaaatggatatgaaatagcagnctttaaagaaatagtgttttaaatactgtggtt

SEQ ID NO: 255537 - DNA, 692 bp, Homo sapiens
  misc_feature (532)..(532): n is a, c, g, or t
  misc_feature (555)..(555): n is a, c, g, or t
  misc_feature (568)..(568): n is a, c, g, or t
  misc_feature (578)..(578): n is a, c, g, or t
  misc_feature (609)..(609): n is a, c, g, or t
gaaatgaagactggctctgtggtttgaatgtatcctctctaccttctccttttcctccttcttcttctttgggctatgtatccttaaatcacttctttagaaaaacagcatgagaagtactttctaaatacaggcatacctcagatatattgggggttgtgtttcaggccaccataattgtgataaactgaatatcacaaaaaggtaagtcatgcaaattttgtggtttcccagtacatataaagtcctttccccattgcttgttattgttgattttgtcaatgaccagatgattgcaggtgtgtagctttattcatgggttctctgtcctgttccattgatctatgtgtttgtttttgcatcagtaccatgctgttttggttactgtggtcttgtagtatagtttgaaatcaggtagtgtaataccactggctttgttccttttacttagactagttctcactctcgtgccggttttatctggttaatattaagcactggcatggtctttataaaattaggctatttcttnaatttatatcctttagttataantttaaaagatgtnaaccattaanttacattttagaaacattctattgacctgantatacttgcttcatgtgataccataatggtatgaattgcagctttaaggaatgtgtttaaatcctaaagtaggtattgcgtcc

SEQ ID NO: 255538 - DNA, 359 bp, Homo sapiens
atttggttttccaagtagatacaataattctaaatgtctatgcatttaactaaagcgctttaaaatgcacaaagcaggccggccactgtggctcacgcctgtaatcccagcactttgggaggcccaggtgggcagatcacttgaagtcaggagtttgagaccagcctggccaacatggtgaaaccccatctctaccgaaaatataaaaaattagccaggcgtggtggcatgcgactgtaattgcagttactcaggaggctgaggcaggagaattacttgaacctgggaggcggagcttgcggtgggccgagacctgccactgcactgaagcctgggcaacagagtgagactctgtctca

SEQ ID NO: 255539 - DNA, 283 bp, Homo sapiens
tttttttttttgagaccaagtcttgctctgttgcccagactggaatgcagtggcatgaacggggctcactaaagcctcaacctcctgtgctcaaacaatcctcctcccaccagcctttccaatagctgggaccacaggcgagcaccaccatgcctggctaattttaatttttctattttatgtagaaatgcaacctcaccctgttgccctagctggtctaaaacccctgggctcaagcaatcctcctatctcagccttccaatacctgggattacaggtatga

SEQ ID NO: 255540 - DNA, 503 bp, Homo sapiens
gcatccatccctaaataatttgcttaattcctagaactgaaaatacttcctctgtttttaaggacttcagtttatgtttccacgtttataacgaagctcctagtagctatttatactaacattagcagcatacgttttgcgcatgcccatttattcccaaatctttgccaatgctgtgtattgtctttttaaataatctttgccaaattaataggcataaattatattttgatctttaaaattaacttattgttcttttttcctagttaaaaaaaaaaagacatccatattatagaaaatccaaagggacaggggaagcacaaagtaaaacccccataatgctgaattcagagataatcattaacctttgggtaatttttctttgcatatacataatatatatttgaataacaacggagttatactgtacataccatttgtaacctacttttttcattgactatatcatgactatctttccatgtcattaaagaatcttccac

SEQ ID NO: 255541 - DNA, 703 bp, Homo sapiens
ggatgatctgtgcagcaaaccaccatgggacacatttacgtatgtaacaaacctggatgtactacacatgtatccctgaacttaaaagttggaaaaaataaatgaaggagtggtctttaaccatgtttgctcaattatctctgaaattttttttaaaaaactacatattccttgtatgtttaaaattgacttactttttattataattttaaatagttgtagagaataacttgtttaaatattgatattaaaatataacttttttcatccagtgggatttaaaaatcgtacacattatccgttaaaaaatgcttgaacaatctcttcattaaagttggaaatttaacatcgtgtctttttccattgaactcctgtgtccattttactttgcaagattccattgtaatttatatagtttatgcttgtcttttattgatcatgctgccatttctctacaataaaaacatataaattgaaattgtttatattaaattttttctgttggcattaggctttcttttgcattaagcaaatattttctagtgtaacattttaattcctttaatgatttatatatatatatatataaaatatgaaatttttttgagacagattctcactgtttcgccctggctggaatgcagtggcacaatctcggctctctgcaacctcagcctcccaggttccagcgattctcgtacct

SEQ ID NO: 255542 - DNA, 295 bp, Homo sapiens
gggaggtgttctgcaagatactgggttagtcagcagacaagtcactgaggatttgacatttaaatggaaacttcaaggtcaggtaggcaaatattggggagcatcagatcaagtcaggagagaggtcctagtgtctgaaggagtggacaaggccatcgcagctcatcgttagtgcaagagagaactgccatcagccagcgcctgaggaaagctcccaatggcattgggaggccattggagagactgacgcaaggaagtgatgagatactggttggttataaagatgatttgttat

SEQ ID NO: 255543 - DNA, 448 bp, Homo sapiens
agaaatgattgactgtcacccaagtctttactgaacttggaaacatcaaataacttgacgaagcaagtcagtgaaagagctggctagaaggctggcatcccccagggtgctgggataaaattcttaactcttcatggatagcagtgaccaaagtccatagggtggaggggtggagagcagggtagggtgaggacagaagctgccaggggccaggtgaagggactgagacccgcagctgggtttgtgtccaggctcccggcttctcagacacagctttgctgtgtgcatgacccctgcatccgaccctggcatgggatcctggctcccatgaaatcaccggccaggatgtcagttctacaataaccctgtcaggaaagttaactctccaggtagcacagctggagggcagaacttgggcaagagcccaggccgctgagcaccaggccag

SEQ ID NO: 255544 - DNA, 448 bp, Homo sapiens
gattgctttatccaggtaagaggtcaatcacagtcttctgttactttgctaatacccccatatctctcactgttaagtagtctacagcctcatttgaattgttggtgccacaattttgtgacctttggtaaggtattaagcctctgtgtgcctgagtttccctttctgtaaatctggccacgatatttgtgatacccaatacatagggctattgtaaagatgtaaattacaaagaataagaataactcctggatattagcaattttatacttacaaagtcccacagtatagtgatatggtaagcagtgaaaggcagtttataatatgacatggaaaaagtctgatggacactgagagtctaataagaaaaagttccaagagaagaaatatggagcactcaaagcaagaggaagcctgggcatcttgcagaaaactattgtgtttggtt

SEQ ID NO: 255545 - DNA, 403 bp, Homo sapiens
aggcactcctgggtgactgggggccttgtgagagtctctagggggctgaccccctgctatgtgcagcagccctgctgggagatccccagcaaaaattaattttaaaaatggcttgttagccgggtgcagtggctcacgcctgtaatcccagcactctgggaggccgaggagagtgggatcatgaggtcaggagattgagaccatcctggctaacacggtgaaaccccgtctcgactaaaaatacaaaaaattagctgggtgtggtggcacgcacctgtagtcccagctactcgggaggctgaggcaggaaaatcacttgaacctgggaagtggaggttgcagtgagccaagatcgcgccactgcactccagcctgggcaacagagtgagactccgtctcaaaa

SEQ ID NO: 255546 - DNA, 445 bp, Homo sapiens
tttttttttctatgatttaaaaacaacactgacaagcccagctaaaactttcatcaaaattaccttgaaagcacaaactggcctcctttgtctcaattttccctgtgactggccttttttttttttttttttttgagatggagtctcactctgtcgcccaggctggagagcaatggcgccacctcggctcactgcaagctccacctctcgggttccacgccattctcctgcctcagcctcctgagtagctgggactacaggcgcctgccaccacgcccagcaaatttttctgtatttttagcagagatggggctaaggcaggagaatcactcgaatccgggaggcagaggttgtggtgagctgagatcgagccattgcactccagcctgggcaacaagagtgaaattctgtctcaaaaaaaaagaatggtgagacagttgaatat

SEQ ID NO: 255547 - DNA, 475 bp, Homo sapiens
aatatcaacccctccttcctcccccactgcagctgcaaacattttgttttgccattagaaatgacttacttaagggaagcagaattttacaggcagtttacaggctggtcttgttcagtagtttccaaaagccaggggagggcggaggcggccagcagtccccacaagttgggatggattggaagtgagaagtgagtcctgtgtgacggacactttctcctgcacagccgcacgcccctcggtgggctctcggcacgttgcgggcattagggagaaaggcagcgggaggccctcgctatactctgatagatccagccccctcagtcctcctggaatagcctggccctggctccgaggagagaagaggggctgttgctgggcccacagaagaaaaggcaaccccaggcataaagaggctctcagcagcccctgcccgaacgctcctggcaggcaagggccccatagcaccctgggg

SEQ ID NO: 255548 - DNA, 455 bp, Homo sapiens
attactcagagttcaggtgcagataatagaaaccacttgagcaattttgagcagttttaatataggcatatggtgcttataaacctgtgggaaggggtggaacagcaggcttccggtgggccctccagaaatgattcttaaattgacacttcaggacctatctgcttcttggcctcaggaacacacaccttagccatgatctgtgtataaaataagcaagccaactcagaaccaagctgcacctgttagattctttttagcaaaatggagtcatagtgcctggcccttctctccctttaattcaatagcaaaatcaaatcttggaagagtgtatctgattggagcaatctaaatcacttccagaactctaactgcaaggaatttggggaaataaattctttagtttttttaatctgctattgttcaggaacgaacactaagaagagagatggatg

SEQ ID NO: 255549 - DNA, 603 bp, Homo sapiens
ctgccagggcctcgaatgcgttggcatgccaaggtggtggatgcaggtttggccaaaaccttcctgggaatggggaggggggtgtctaggtgcctggcacccgaccctgactaaaacagctgaaaacagttttataaaatagtataaaattgcttacccacgaatacgtatcaaggtcttaaggaattaacaggtcaaaatttttattcattcatttattcctttgttttgcttggtcattcagaggcaaggtcagcatttgatggaggcaggagagaagcagcccttccacctggccctggagctggttttgcccctcactgcttgagccaactggaacgtggcatggtggcctcagggctgggcatggaaggccgactccaaggctgactccgagccgcctgtcagtgatgtgcaagtctttaccctgctgtgaggggtaggaggtcaactgagtcaaggagcaaagccaagaaccagatctgtacaaaagagaaaaaaaaagtcctgctgacagcctgggagtgaggctgccttgcacaggcagaacaaatgaataaatgaatgaacgaataaaaattttgacctggtaaaaaaaaaaaa

SEQ ID NO: 255550 - DNA, 267 bp, Homo sapiens
gaattcaagcttctaacgatgtacggggacatggaaggccgactccaaggctgactccgagccgcctgtcagtgatgtgcaagtctttaccctgctgtgaggggtaggaggtcaactgagtcaaggagcaaagccaagaaccagatctgtacaaaagagaaaaaaaaagtcctgctgacagcctgggagtgaggctgccttgcacaggcagaacaaatgaataaatgaatgaacgaataaaaattttgacctggtaaaaaaaaaaaa

SEQ ID NO: 255551 - DNA, 746 bp, Homo sapiens
gggacctctgccctcaatggacatgagaattatctgagacatttatttaaaatggagctatctcctgccctacctttaaatgactgatttcagcagatgtgggatgaaattctagaaattgatctcttcaagttgtgctgcagccactccacaccaggacaataccccttacaatatcctcattagcttttgatccagtcccatacctcccataatgttttcctcaaaacactggtcccttcagaggactttaaaaataagttctatagtcaaataagtttgagacttacttcacatcagatgcctctgtctagggatcacaattcatattagcatagtgaatgctgtaaatatttctctaggaaagaataattctataccagctttaagccagtgttttctaaacttacgtgagcacataaaatttcctttgtaatacttagtaacagtttcctggaacaggagatcttgatattaattgactcattgtgaatacttcctacagcccccttctagggcagaatgatttcttttttccttgcaaagtgagcctctaaagagatgtagttctgagcattatgcctcgatcagtctgtaaaaatccgggttctgtttggatacagaccgtgagggaccctgtctctactgttcaatggtagatcatctaaagaaaataaatgcaatcctgtccttcatcatggatcggcattcctgctatagaagcttcaggagatgacctcattcaa

SEQ ID NO: 255552 - DNA, 379 bp, Homo sapiens
gaggccccactgataggtgggcttcaaataaatcaaaacgaatgcaaggctttcctttgactcttccttaaaccatcccataggcttccattttcacatgtaactgacatccacctattagtgacctactaagagtgttattaaaggtactctagagaactgtaaatcagtattttactaggaattctgactgaaacacagtatttggtaaacttgccaagttactaccatatatgtgggcaaacggaagtgctaccatttccagacaatacatttgcatgaccatcattccaagttagtcagtttcccattgctgctactctgctttctaatgaccaaatgttagtttggctttaccatcatcaatttcatttgctat

SEQ ID NO: 255553 - DNA, 288 bp, Homo sapiens
gccacatatatctaaccatgagacccaacttaattcaactattctatcaattgcctactgagtgccaggaactgtggtgtactaggcctagagtaagtcgtgagcaaaacagactttttcctgctataggagcagaaaggtgtagtacctttcttcatccatcataagcgttacagttgacactcctataacaaaagacagattaacaagagaaaagcataacaaatttatttaaccaaagttttacatgaaatgggagcctttagaaatgaatagcccccctccccc

SEQ ID NO: 255554 - DNA, 439 bp, Homo sapiens
gatagctgatcatcctgcaatggttacaagtttttcttccatctgaagccatcctgagcaattgaattaggcaaggagcgctttgctcctttcaaatcagggaaaagtaagaacttcatgtaagttttgtatattgaacacatattaaatggaatatatctaatttttccagttgatataagacctttggattggatacatagaacctatttcactaaaaaatttagaggttcttaaatacagcattctacaagaataggatttataataatcgacctttcctttttaaattttcatcctctcaaaaattaactatgtcaggccaggcatggtggctcatgcctgtaatccagcactttggaaggcctaggcaggtgaatcacttgaggtcagcagttcaacaccagcctagtcaacatggtgaaaccccatctctact

SEQ ID NO: 255555 - DNA, 247 bp, Homo sapiens
ggcacatgtaccatgtgtcctgctgacagtaaaaggtgagctactttccatccaaggaacaattgaaatgtctccaatacaagacgctgtgagaaggtcatagagatgataggtaaagagttttctctgtgtttattacctctcagtggagtcattctctggattattgccagatgcaaaactcttcaagggccaggtggcaactcccaccgccccagttaagccacactcactcaatgtaccagca

SEQ ID NO: 255556 - DNA, 452 bp, Homo sapiens
gatgaggggacaactcaggaccagctctaagcagtgcagatcaccacctaaggggagggtcatttgaattgactgacatgccagcctcccttaggatcttaaatgccacccactgaaatcatttttcctgggatcttccatgtttagggggctgcccaaacccccgggtcagtatacggaacctaatgacaacaatagacaagagttagtgagtccttccatgtgtcaggcccaatgataagagcttaacattaatgttcactacaaccatatctatggtattatccctttcacccccatcattctcactcccttaactgtgctgcatgtttttcatagcatgtactcttgctaaaattatatatttatttgttttattttttgttacctgactcaaacttgtgagctctatgaaggaactctgtgttgttaaccctcataggcaggttgct

SEQ ID NO: 255557 - DNA, 817 bp, Homo sapiens
aggtccctggagctgccgctctggctcctgggcgattccggggagccattctccccaatttgccaactccctgggcatctctctctctcttcctggtcccgccacacccaaacaactcttatagttccacccggtatactggtctcttgacaggaacttttgggaaatgcccctcccccagccccttgtctggggcaacttccttgtctcttctcccccaccggtgttggggagttccttgtctccactcccaaccacagagccacaagtacattatctatgcccaggcgagtccctatgcccaggctaggagagccgcacttcttcctacagctgacacgtttggtttttggaggggaaaggggagctgtagctgaatcagtaatggaaattggtaagtgaccaaagaagtttgagacactaaaaaaatgagtcctttaacgatcctagtccttgatcctgagctcattctgatctccagttagtcatgaacagagaaatcgattattgatgactaattcaacacggaggcaacatcctccagaccttttggagacccatcgctgaggaagacttcctggctcttaggaatagctgccgtataccctccttgcctgtcgggtatatcagagcctcagagagactattacctagattaatttgattaccaaatgttgctatcttatttctttatataccaaatcacatttctgtttgtgcatactgtgtgggtttgttaacattgatgtttattttggcctctaaagagcaaggatcgcatttagcttaatatgccacagatgctgttgatggtgaa

SEQ ID NO: 255558 - DNA, 420 bp, Homo sapiens
ttccccctgtctgaagaaggggagcaggtttctgagtactccggggcgcggtgcctccccctaaacgcgaatggaacttttgggaaatgcccctcccccagccccttgtctggggcaacttccttgtctcttctcccccaccggtgttggggagttccttgtctccactcccaaccacagagccacaagtacattatctatgcccaggcgagtccctatgcccaggctaggagagccgcacttcttcctacagctgacacgtttggtttttggaggggaaaggggagctgtagctgaatcagtaatggaaattgatgaacctgtgatgtgactcctgggagtagtttgcaatcaccattggcccaaaaggagccatctacgtgctcagtggggtctagtaaaggataatattaattctta

SEQ ID NO: 255559 - DNA, 348 bp, Homo sapiens
ctatcagctcctccaatttaatgtacaaaatgagactatactgaatataccttttatatcctgttatttaacttaacattatattgtgactactttctcgaatcaatgcatataattttgtctggttttgctttctttttcatcaaagatgtacatgcacataatctaagaatcagtagttcaagtccctcttctatcctgctccccagatcaaaacttgaaatattttagtcaattcctttgggatttacttccatgtcttaaaataacaccgtattcatattctacttaccagcacgtgactatcagacatcacctactgacttctgactctggaaatgggggttt

SEQ ID NO: 255560 - DNA, 689 bp, Homo sapiens
ctgcctgccttggcctctcaaagtgctgggattacaggcatgagccaccatgcctgaccccgaattcttttagatgacaaggtatccaggttaccttcactctttcttactgtgagcctggagccacttatatgagttactcctggctgccacattcagtggggcagcttgtgtactgcacgactcccaggaggcattcacatcacagtcagtatgaatgtgcttcctggaggaacgcagtgagtaagttgtgtagccacaaatagtgaccctatctgaggccccatcccagttctcctgaatcagaatctctagtgggagcacccaggaatctacatcttcacaaatctcacaggttcctattaacactaaagtttgaaaatcactgcttagggataggttttgagagatacatcagaaggaaagaaatgtgggaaattatctcagcatctatgctgtccctggatcctttgctttccaggcttaaatgtacacagtgggtttcatggataactcagtgaatcattgccgttcagagtatgatggccctgctagtgatctggtcatcttttcatctctttccaagcaggcctctcttgttttattttctgagagcttttatattcaaaaattttaagagagaagttctatcagggcactccatattgaatggtggcccccattgggta

SEQ ID NO: 255561 - DNA, 351 bp, Homo sapiens
ttttttttgagaccaagtctcgctctgtcgcccaggctggagtgcagcggcatgaactcagctcactgcaacctccgccttccgggttcaagtgattctcgtccctcagcctcccgagtagctgggactacaggcattagccaccacaccaggctaatttttgtatttttagtagagatggggtttcgctgtgttggccaggctggtcttgaactcctgacttcaggtgatccacctgcctcggcctcccaaagtgctgggattacaggcatgagccactgtgcctggccttacatcccttaatctatgtgcacagcaattatgtctatcttaaaggatttacagcataaa

SEQ ID NO: 255562 - DNA, 303 bp, Homo sapiens
  misc_feature (303)..(303): n is a, c, g, or t
gcctgctccacacctgggtctgaccagggtgagtggatcttttggaacctagacagagcacaactgaaagggttgactgaactcccacaaagatgtcctgcaccagtctcatgcatctcgttcatcagtgcctttcataccttcaagagctcttgcctcagagcattgctatgcctgaggtgtgtctcagaagcagccattggcacagtggcttggggctgggctcaaaaatttgctctcttgaagtttggatgtgattgctctgaacaagctgctttgccacaataaatattttcaagtttn

SEQ ID NO: 255563 - DNA, 241 bp, Homo sapiens
gctgggggtttactttgtagctgaggtaagtcacttaacctcaccgcatctttctagtgtgtgcaacttgacttatcgtcattgaaagctttttattctatctgacattttacacttgtcagtctagggttgccttcatgtgggctgggcaaggtgtagtgtgttcctcccgttaggaacgactttccatggctgtgatgataaaatgacaaggtgtgaggctgatgagcgtctccgtgtt

SEQ ID NO: 255564 - DNA, 381 bp, Homo sapiens
aaaggatgagtggataaacaaaatgtggcctctacatttactgaaatatgagtcagctttaaaaggaaggcagttctgacacacactacaacatggatgaaccctgaggaccttacacttagtgaaataagccagtcataccgtgtcagcttatttataagaggtacttagagtagtcaaaatcacagagacagaaagtagagtgcttgccagtggttgaggggagagaagaaagggaattactgtttaatggggactgagtttcagtttacaagacgagttgcggagatggatggtggtgatagacacacaacgttgtgaatgcgtttaacactaccaatgtgtactctttagtatagttaggatgcgaaattttatgtt

SEQ ID NO: 255565 - DNA, 251 bp, Homo sapiens
gcagagaaaaagtcctcataactgatgtttagatgggaaggcaaagagacaatctcagtcaatctgatgtgccaggtaagaaagcctcgtgtgctgtccacaggaccgaacttcagtactaaatcaggatcaggacaaccatttgaactgagtaaactaacatatctacatccaaatctttgggtctcctttgcttctgggctactcactggcaaaagtcctgagcggctctcacaatatctgcttttcca

SEQ ID NO: 255566 - DNA, 293 bp, Homo sapiens
agaaaaatgctgtcacactctgatttaaaaaaaaatatgcaacagaaaggaaaatacattataatcatgcaactaaaccagcagccactgaggcaagttttaagattagaacagccccagatttttggagtacatgaatagaatttttaaaatattttatctggtttgctcatccctgatccccattccctacttcaccaccaatgaaatattttttccacttgaaagattaggtaactggtatgtttgagtaatcccacatgcttaataaatgattacataacagtttattt

SEQ ID NO: 255567 - DNA, 577 bp, Homo sapiens
actcatcttctactgcagtaagaagggtatcataggtattttttgtggttctaatgggtactcagaaaatccttatgtgatttaatatactcttaaaaggaccgtctgaaaccaaaacatgtactaatatccagtggcctttctctctgtatactggtttaataataacattctgcatcaaatcctttcagaaacctatgaacagaagtaaaatgatatgatacctgagaattattttaaaatgcttcagaaaagaaaatggggcagggggaggtgctgaaacaagaacagcaaaatgtggtcaatttttgaagctggatgatgtatatgtctgaaatttaacataataagttttaaaatcttcttagagagttggcagatcatatactatacacaaatattgtacatgttataggatcaaaatatgggattaaactaagggactgaaactacttatagaatgtcattctcaagccaggcacagtggctgatgcctataatcccagcactttgggagatttcttgagcccaggagttcaacactagcctggccaacacagcgaaactctgtctctac

SEQ ID NO: 255568 - DNA, 273 bp, Homo sapiens
gggcaggcgttcactgttgtgtgcggagaatattctctaaagatgcaggatggggaagagggggtggagcagagagtggggaggagggaaagaaaaaggacaagtgtggtgggtcacatgcccattctccccaccccccaccccttgccagttgcctgctcaatgcttctacccatgacatctcactgttgggaagaaatgagatctttcagtttcaaatgtctgccaaagaaaagggacggaggcttaagttctcactcaatggtcagccag

SEQ ID NO: 255569 - DNA, 499 bp, Homo sapiens
cctgggctcaagcaatccacctgcatcagcctcccaaaggctgttattacaggcgtgatccaccactttatttaaaattttagttacagttaaataaaagtatttcattgtgtactgtctgcaatcattttgttcagtaccaatgtacacaccacactgggaaacactggcatatatatagtggcacttctacatgcattgtacatcaaattgcattgataatactaagtgagcttttctgagatgattataacgggagaagagaggttcccttgtggttgcatgttatctcaacaccctttctccttccttttgtaagctgaaatatttcattggaaatttacaaattatgtagagaggatcttaagaccgtctattttcagagatacttctctcttccattggaagaatgactgtaaacttggtatcaattttcctaagagtcccaaaatacagtactgtaaattgtaatattcagactgtcttatgttctacctaa

SEQ ID NO: 255570 - DNA, 436 bp, Homo sapiens
tcccacagcctgggctggaaactatgtggggaaaaggcagggacttaaggctgaagcagaaaaactagagaaagaaaaaaaggtggagacttaaaacagaggtgggaactccaagaaaaagtgcaatatcataaaaactcagtgcacatttctcgggccgctggctcattctctatcagcagcccgctctgccttatcttccagagtacactgtctctctaaataaactatttgctctctgtttttcttcagtaaattctcttttttgcctaaattgtctcttggccaaaactttctcccaagacaaaggacagaggattgccatacttgctttctgtaagtggtttcatggtattttctatccctttttcatgttaataagaacgtttaatgtgtgatataccctctgaataaaattttaagtacataatacagt

SEQ ID NO: 255571 - DNA, 441 bp, Homo sapiens
gggaaaaaaaatcactggtcaaattatgattagccaaaatgaagttcgattaactacaattgagtataaagttcattttcttctttagaataactcaagattttaaaaaagacctacctaattgaaaaaaaatacatatgtctcatacacacatattcatccatgaggtacatgtgcccattcctgtccatttcacctgaaatacacagacaacatatacaatatgtctgtcttttcgatgcctatggtatagtaggtgttgtgtatatgttggttaccatgaatgtttgtaaacttgttaaataaatttttcatcttcaattctgcaaggcattgtaataaatattttatgcttcaagttcattgaacctgtaaattatctctctgtaatgtgcatttgtgtgtaaggttggctttatttcattaaagaaaattttattt

SEQ ID NO: 255572 - DNA, 417 bp, Homo sapiens
cccatctgaaacatgagggatatatgttaatatttcttttagttttaatgttttcttattttggcatgtgaaatggctggggaatgatctttaaaagagtttagagactagttaagcattctactctagatagaataggagaaatctgcttgaaaaggcttcataagaaatatgacttcatgtttattttttaatttattttattttatttatttatttttttgagatggagtatcgctgtctcccaggctggagtgcagtggcgcgatctcggctcgctgcaagctctgcctccggggttcacgccattctcctgcctcagcctcccatgtagctgggactacaggcacctgccaccacgcctggctaattttttatatttttagtagagacggggtttcaacgtgttagccagga

SEQ ID NO: 255573 - DNA, 501 bp, Homo sapiens
tcaagctgaactatgtgaaactagccaaggggaaaggcactcctaggggacataaaattagtgattactttgagtttgctgggggaagcgggccaggaaccagccctggcagaagtgttccaccagttgcacgatcctcaccgcaacattccttatccaatcccttaccgtgacgagtagcacagcccctctatggtttagatggcagtgctgcaaaggaggcaacagaggagcagtctgctctgccaatcctcacgtcagtgatgctagcaaaacctcggcttgacacagagcagctggcgtaaaggagagctggcctctgcttcacttttgtttcagctcagcaaaacagtccctcatctacgggatctggcaacacagagcattcctgcagctcccaaaaacagatctccatccagcacagacagacccagtccaacctcacaatagaaaaaatatctgcactagaaaacaggaagaattctgaccgaatatcggggg

SEQ ID NO: 255574 - DNA, 1687 bp, Homo sapiens
ccattgcgcttggttaactttttaaaatttcttggccaggtgtccactaaatcttaatcgtttctagcgtttgatttaaagtgagaccaccttgaacatctaaaggccagttcttgtggggagtcaatactctttgttatactcagttttaagaggaagacagtgattcaggagttgtctgggccagttatatctgtttatatattcaatattttgtgtatactcactgcttttcctaacgtgaaaaatttaccaaaatgctaattgtgacttataaggtatttaacagactcccgacaaaaagcagaatgatcagcgaaatcggaaaagaaaagctgaaccatatgaaactagccaaggtagtaataatttcgtatcaacaaaagtactcaattctaatgtacttagatagaattttctaactcatactaaataattagtttgtacacagggattcctgataaaggaggtttgtgtatcttaagggaatatcagactgtttattacagacttgccatttgatatatacctgacaaaacagtgttagttcttcggggactctttgttttccctgttgtaagctaacaatcttcttaaccacaggtttttctttacaccaagcatatattgtacaaatagaggttatgtcagagttttaactctgtcttttgttagatcagtgatttgttaatgacagccggctgaaagtgcttcatttacattactgtcctttctgcctactgctcttccatggcagttgtttagttgaatattggaacccactgggataaatctgtaaacatgatggttataatgccaaatatctttatataatcaaagaaagaaaaaatggcttggctttttttctcccattctaaggaatagaaagcccagtcttgttgcatccttcttatcttttaaaatctacagataattcattttgtctttgggagcaaaattctcccaaagtgacaagaaaaattacagaatcttaaacctgtgaaaaattcttcctttcactgcttgttcagtcctttattttatggaggaaatagtctgttcttaggctaaggtattttggctcatttgttacaagtaaagctgacacttgggtttatagcaatgtatgtagttactgaatgtatagtacattttagtgaatgatggtttatatgtgtattgcaaaaactgtatttactttggtttcattttccagggaaaggcactcctaggggacataaaattagtgattactttgagtttgctgggggaagcgggccaggaaccagccctggcagaagtgttccaccagttgcacgatcctcaccgcaacattccttatccaatcccttaccgtgacgagtagcacagcccctctatggtttagatggcagtgctgcaaaggaggcaacagaggagcagtctgctctgccaatcctcacgtcagtgatgctagcaaaacctcggcttgacacagagcagctggcgtaaaggagagctggcctctgcttcacttttgtttcagctcagcaaaacagtccctcatctacgggatctggcaacacagagcattcctgcagctcccaaaaacagatctccatccagcacagacagacccagtccaacctcacaatagaaaaaatatctgcactagaaaacaggaagaattctgaccgaatatcggggg

SEQ ID NO: 255575 - DNA, 777 bp, Homo sapiens
ccattgcgcttggttaactttttaaaatttcttggccaggtgtccactaaatcttaatcgtttctagcgtttgatttaaagtgagaccaccttgaacatctaaaggccagttcttgtggggagtcaatactctttgttatactcagttttaagaggaagacagtgattcaggagttgtctgggccagttatatctgtttatatattcaatattttgtgtatactcactgcttttcctaacgtgaaaaatttaccaaaatgctaattgtgacttataaggtatttaacagactcccgacaaaaagcagaatgatcagcgaaatcggaaaagaaaagctgaaccatatgaaactagccaaggtagtaataatttcgtatcaacaaaagtactcaattctaatgtacttagatagaattttctaactcatactaaataattagtttgtacacagggattcctgataaaggaggtttgtgtatcttaagggaatatcagactgtttattacagacttgccatttgatatatacctgacaaaacagtgttagttcttcggggactctttgttttccctgttgtaagctaacaatcttcttaaccacaggtttttctttacaccaagcatatattgtacaaatagaggttatgtcagagttttaactctgtcttttgttagatcagtgatttgttaatgacagccggctgaaagtgcttcatttacattacttgcactccagcctgggtgacagtgagaccctgtctccaaaaaaaagaaaaa

SEQ ID NO: 255576 - DNA, 626 bp, Homo sapiens
aaatgctaccgataaggtaaatggattcaaagtaataaaactacagaaagtgacctttagggagcagtgatgtagcaatcagagacagacaaggtaacagcaatcctgtgatcaattctgtgatagaagtacgcctaggcaccatgggagcacagagtgaggaactcactctaggctgaatgaggaaaggaaactcttctttggggaaagggattgccggtcctgagtcgaaaaggtcaagtaggcattaactgggctggacttggtggggatggggctgtaatacaagaactctgggtgagaagaacatgatgagattggtgaacaggatcatatttggagaggctaaagggcatgtgttaagggatgaagcaggaaaggaaaataaaaaccttgtctacaaaatatagttcatatacttaaggaaaccacccctaccagcactttttgacatagatttatcatgtttgtgtggtttccttttttctgtatttcaaacactgaaaaaaatgtagatgatttttaaatgggaaacatggatagcttcttctgtcctgacttttaaaaatgtgcttagtaaccaaatttgtttctaaatagattgtttacaagtaccatttaacttt

SEQ ID NO: 255577 - DNA, 475 bp, Homo sapiens
cttcaatattctacttccaataaaggtagaacaaccagacataagactaataaggaaacaaaggactcgaacaacactgtagaacagttggacctaacagacatatacagaacactccacctaacatcagcagaatacacattcttttcaagtgcacatagattatgctcaaggatagagcttatgttaagccataaaacaagtctcaacaaatttaagaagattgtaatcataccaggtatcttctgtgaccaaaatggaatccagccagaaatcaatagtggaaggaaaatgagaagagtctcaaatgtatggaaattaaacaacatactagttaggagaaggaaggaaataataaagaataccacataaataaacaaaatggagaatagaaaagcaatagagagaatcaatgcaagttgttttttttttgaaaagattaagaaaattaacaaaccgttatccagactaaaaa

SEQ ID NO: 255578 - DNA, 346 bp, Homo sapiens
gcatagaacatcacgttgtctttagggaatattctataattattcaaaaattccttttttgacttgaaggcatgagtcttttaagtatagcttagattttttttcctgtaaatgccttacttttcatttgtccatgctgtaacatacctgccatttcctcgcatgtaattttttaacactcatatctcagtgggctcttagaggtaatccaaggtaagaaccacctttttagttaggtctgatggttagaaagcttgagttgaagcgtgcccttctggaattgccactttgggcccaattttgtctacacgggaactgcttagagcaagtctggtttgtcttctgc

SEQ ID NO: 255579 - DNA, 554 bp, Homo sapiens
gtgagcctctgcacagcaaaaggaataatcatcagagtgaacagacagcccacagagaggaagaaggtatttgcaaactatgcatctaatgtcaagaatccacaaggaactcaaacaaatcatcaagaaaaacacaatcccatcaaaaagcgggcaaatgggccaggcgtggtggctcacgcctgtaatctcagcactttgggaggccaaggtgggcagatcatgaggtcaggagatcgagaccatcctggccaacacggtgaaaccccgtctctactaaaaatacaaaaaattagccgggtgtggtggcaggcgcctgtagtcccagctactcgggaggctgaggcaagagaatggtgtgaacctgggaggcgaagcttgcagtgagccaagatcgagccactgcactccagcctgggcgacagagtgagactccctctcaaaaataaaataaaataaaataaaaattaaaaaagtgggcaatagacatttctcaaaagaagatatacaaatggccaacaaatatatttaaaaatgatcaacatcgctgggca

SEQ ID NO: 255580 - DNA, 404 bp, Homo sapiens
gctctgcctgccttcacccccctggctttctagatgatggagtgcgaggctagactaactcctgcctcaggctaacaatgtaactttgggcttccttttgagaattaaaaatactactttcgggctgggcacatcggctcacccctgtaatctcagcaatttgggaggccgaggagggtggatcacttgaggtcaggagttcaagaccagcctggccaacatgatgaaacctcgtctctactaaaaatacaaaaattagccaggcgtggtggtgtgtgcctgtagtcccagctactcaggaggctgaggcacgagaatcgcctgaacctgggaggcagaggttgcggtgagttgagatcacaccattacactccagcctaggcaacagagtaagaatctgtgtc

SEQ ID NO: 255581 - DNA, 342 bp, Homo sapiens
tttttaatttcaataaagcaaaatctaataaaatagcatttcatatgataaaattatagttttcctaaataaaataatcctaatatacttaaaaacactcagaaaatatgcagtcatagaaaagagttatataaaaaggccaaaaaagtctaagcaatacattggctttattaaatctaaaataaaaaataaatcctgatagaactcatcaaatttgttttaataaacaaaaatctacaaagtgacagcaagagctttgatatcacctaaatattttaaaaagtgaacatgactattacatgaaagagaaaaatgaaaatacttttaggtttacatattatt

SEQ ID NO: 255582 - DNA, 441 bp, Homo sapiens
tataggcagaaatatatatatttggctattttcctctgaagaactctgactaatacaacctgtgttttaattaggatacttttgattacatataaaagcaaccctgagtcaaactgacttaaacttcattacacaataaggacaggtagcacaactttcaggactggttctttccctggctaacatttatgcatatcttatcaaagatgcagaatttattttatctgtcacatctaccatgctcataatcagtttcatcttcaaactgcagctcatactgcaagtaatcttattattacccaaacacaatcatattcaggagaagaagctaaaacattttttttctgtgtccattgatattaatgagtacatttttttttccagaagcttattagacaacttctcttcatgattgaagaattggggagttgggtctcatac

SEQ ID NO: 255583 - DNA, 383 bp, Homo sapiens
caaatggaactgatggatgccagacattgtggatatctgcaagtcctggttggtgaccagggacttgaagagtagactttcttctcaaacttatctttgtgctgttttccttccccagacctcatagtctggagcccatgtttccaggggtggaatttgattttcccagagaggagctgtgttcggcttctaggctgaggagctaagctgccgagcctctgccagccctctgtggattcgctcctgcattattcagcgcctttgctgacagagcaccatgttccactgctgagcagatcagggtgaatttccaagagggaacattgcagatggttttgcctttagggatggattttcttactcccaagtgactcacttctggt

SEQ ID NO: 255584 - DNA, 503 bp, Homo sapiens
cagctttctcagaaatgagctgggaatgatgcgattatgaggtcatggtgaggacagggagaccaagctcataaggaaggcatcttgcaaaatagctggtagatggtagagcctcacccctcccgctggttaaatgaaaatatttccactcagaagatcagcaaaaggtgttcattgaagttcatttaataaaccttagggtgtagcagctcaggctctgggatttccagtttctctttcaaaagataagggaaagcccctgtctccaagattagaattcagatccttacgagatgaagagatcctaaaaatgcatacacagttaaactctgagatttgtatctgtgatctgtggataattattctccatgacatacagacacagatatggccacacacagaagtattcagcaggggcacagatatttcatagaagacaaaatgtatattgggcaaaagaaggtcacctggaaataaaccgaaatctttttaccttaaaataa

SEQ ID NO: 255585 - DNA, 423 bp, Homo sapiens
tatcagccggttgcctgccgttgctcacatcaatgttgttataaaggaagagcattggtggccacttcccttggagcctgcttctctgtagaagctagccttatgggcttttgtgccatacgttaatgtacagataataatcttagttactgtgaattataatagcaccgtatttaaattctggactgagttagccagatgatctatacctgtgagaaatcaagtttcaagaatttgcagtgcactcacaccaagcgatttctggcatttctttctgggtgtgcagaccaccctgggcagagagggagtgattttagcttcacgtgcttcagttagggattcagcaaagcctgagaatttcccttcttaacccaaaccacgtttaatgcatcactaggaaaagcaggttggtaaaactcatcc

SEQ ID NO: 255586 - DNA, 764 bp, Homo sapiens
ctgagattgggccaatgcaatacaacccgggccacaaaatgagaatttttttccaaaaaaaaaaaaaaaaaaaaaaaacaaaaaacaaaaccacatatgtactaagtcctttcctctctcaccctttcacagtaaatgctcaggccacctagacttttttttaaatataagttttctattagatcatcacagagtctcttgagtctctgccttttttctggaattccatgtctataacattctgtctacctacacccccttcctctccctgggcttcaagaaatacatacaaagtacacagtgaaaaatctcttttctttccatgtcctgtcattcctcagcttccttcccaaaggtattctatgcatatacaagttttatgtacatgaatgaatacaggcagattggcatgttagattgtgaaccctgaaaccaggttgcctgagtttaaatcgtggcttttcttcctagatatgtgactttggggatattactagtatctgccttgtaagcttattgtgaggatttcttacagcacttcctggcacatggtaagcactcagtaaatgtttgccattactattgttgtgttgttgttatataacagcataatatattcaaaagagagcaacatttaaaatctagagacataggtttgaatacagcttcctaattactttatgcttaagtcatttaatccaagttaagccttgtatgtttctttatagtgggggtaatgacatatagttttggttttgattacc

SEQ ID NO: 255587 - DNA, 364 bp, Homo sapiens
ccagcttgtgggaaagaagctttgaggggtccctaagggcaagaaggcctttcctggctcagtccaatcagatacctgctgtggctgtgcttcttctggccacaggtccctgtctttgttggttccctgcactgacctggccaaaaggaagctgcttgcttctgggcagcagctgtcccctcccccagaaagtctaaaaggacacagaggacgtcttcagtatttccgtagaggtcacaagctaagtgggtcgctgtcgctgttttacgtttggttggtgctgagacacttcctctttcatttatgtcttattcaggccacctcctccatcccccttgaagactgaaaaaggggaacttgaaag

SEQ ID NO: 255588 - DNA, 314 bp, Homo sapiens
  misc_feature (11)..(11): n is a, c, g, or t
attcggcacgnggagagaagaggaggtagaagagggaagatatcttaggagctactccagcctgggtgacagagtgagatcccattaaaaaaaaaattcacaaattagagaataagaattagtcaaatcttagattcataactgtgtacagtggacatagaaataatttaaatatatatcatcattaaactgaaggaacagacatggtctttgagtattcattaaatacacaagtaactcagattaagccaagcttcttaatccctttatgcctagtgttccattattggaacgctaagcatgtgggagttatt

SEQ ID NO: 255589 - DNA, 469 bp, Homo sapiens
aaaccattcttaaaaacatcttactattccatagtcatagttgtatttgtgaaataagccttgtattcgattgtattgtggggcatcctgatcgctgtaataaatgaaatatgttactgttgttctctactacttgtgttttaataggatggtgctgtgttacgtttccagttttgctaagaaagtgttcttaagcactgttcattgcttaatgtatcctgtttccagagattagattttctcgtaaccaacaaatgctgtcccaaaaccaccttggcgaccttaccaaaaggaaagattctgccattttcttctaaccaggtcccagtgatatttttcatattcttctgtcaaactcagctcttatcctctacttttgtcttaggatcatgacgtgcttgtggaacattaaaactgaaagaagcagaggtatcatttagccccaccctttcatttaagagagaagcta

SEQ ID NO: 255590 - DNA, 542 bp, Homo sapiens
aaaagaatggaagcttttccacaggaattattcacgtgtattgctttctaggagtaattgaatagttgacattgcatttatatcaaagtaaaatatgtgatggttattctcatttgtattattcttaagcaataagaaatgtaaagtaatctctattaggtttctttattcggattcagaaatcttcatagttttctgtaatgtccaaatgtgtaccttcttataacagctatgggaactttctctcctctctgtaaaatggagagttatacctaccacgttgagctgttttgagagtcaatggagaaaatagtgagaaaaccactcaaatgtgttttgttacttgatgtgttctttcctctgtatgatccaacttcttacatgttttatcctattttgggtttcaatttggttcatcttcacaaagtagagcttcaagttttatttagaattaaataatattgatactggcttggaaaactgaataacacaagatttagagaaaaaatactctaagtaaaatgtcatgacaaattgaatga

SEQ ID NO: 255591 - DNA, 622 bp, Homo sapiens
tgtgaatcccgccagccgccctcactacgcctccgccatcccggtgcctcgtgcctcttcccagaccaggattcctacaccgggcgcttctccccagctgcggccacgccaggccggcctggccctgagcccacagagagcagcctcccccagactgggaaaggctgcaggtccttctagaaactcctctcctagggccttccgggggagaggctctcccaagtttgctggggcggtgagggagtcagctgaggatggggaaggccccttcagctccccatggaatagtcccaggacaaccccgaaagcagccctctccagccgggctggatccggaagaattggcgagagacaaggcacccagggaaagaagaaaaaagcccaggaagggactccagtctgccagacccggggcagaagcccttctcggacgagctttcacggagaaactcaaataccaggggctccggaaggtcggaagcctccaagctgcccaggaaaagaccaaagagatataaactacaaaagttctgggacccccaggtctttggagcctgatgagggggcagcttcgtgggcttcctctccagtctgcagcccagtgcagggcaagcgcccctct

SEQ ID NO: 255592 - DNA, 172 bp, Homo sapiens
agattgtgccatgcactccagcctgggggacaagagcaagacttcgtctcaaaaaaaaaaaaaaccaaaacctggaaacatctgaatatccattatcagtagaataaatgaatgtaaaaataagttcatttaatggatattatgcagtgatggcaatgaacaaactgtagct

SEQ ID NO: 255593 - DNA, 416 bp, Homo sapiens
tggcccatcgtccagactggaaacaaaaggcaaagccagatgttgctgatgggaatccactcatcattccagacccagccccggtcccacctccggcaggtgattctcctggctcccacagctcgtctcctctgcaccctcccacaggccagcagtcacccagatggtcccacgtttcctgctgttctctgatcactccaactgtgttatttctgcctccctaactcagtagccagggcagcgtataccttccacttcttttctacccatgaaagtgcccatcacactgctaaatccagaaccggtgctcaaaaaatacttcttaatggattgattcaatcgctgtagctgtcctaaattgttataacaattaaaatgttataaataaataaatattataaagattccaaaagaaa

SEQ ID NO: 255594 - DNA, 244 bp, Homo sapiens
atgccagcgaaagaaataaagaaaactccagttcaatatctctcatgaacatagaaacaaagattatgaaattttagcaaatcaaatccagatatgtgtgtgtgcatgtgtgtgtgcctgtgtgtataaagatataaaaagtaatacatcctgaccaagtaaggtttaccataggaatgcaggattagttttaatatccaaaaattaatcattgcaattatgctatattatcagaaaaaaaaga

SEQ ID NO: 255595 - DNA, 280 bp, Homo sapiens
gtaatcccagcactttgggaagctgagatgggaggatcccttgaggccaggagtttgagaccagtgtgggcaacatagttgagacttgtctcttttattaaaaaaaaaaaacaaaattttagcagggcatggtggtacatacctgtagtcccagccactctgggctaagatgggaggatcacagaagcccaggagaggagggcgaggctgcagtgagctatagtcataccacctcactcccacctgagcaacagagtgaggccctgtccctttaattaaa

SEQ ID NO: 255596 - DNA, 169 bp, Homo sapiens
atgctgaccgttagtggtagagttaagagagcattggaggccatcctggtggctcacacctgtaatcccagaactttggaagcctaggtgggaagattgcttgaggcaactagttcaagaccagctgatgcaacaaagtgagaccccatctctacaaaaaataaaataa

SEQ ID NO: 255597 - DNA, 128 bp, Homo sapiens
acctgtttttgcccattgttctcaggacataatgggtcattccatctggaaatacatgttcaggtccagaaaagttacttgcattatttctgttactattttctttgctccatttttttttctattac

SEQ ID NO: 255598 - DNA, 426 bp, Homo sapiens
tgaactttcttttctttaccttaattacaagtgccttcactctggcaggttcacatgagtctgttctgtaaagaattttaataatctgttttgtgattttgtgatttggagaaacttgtttaagataaaattgtgaggccgggcacggtggctcacaactgtaatcccagcactttgggaggcccaggcaggcggatcacgaggtcaggagctcgagaccatcctggctaacacagtgaaaccccatctccgctaaaaatacaaaaaattagctgggcgtggtggcaggcgcctgtagtcccagccactcgggaggctgaggcaggagagtggcgtgaacccgggaagcggagcttgcagtcagctgagatcgcgccactgcactctagcctgggcgacagagtgagactccgtctcaaaaaaaaa

SEQ ID NO: 255599 - DNA, 450 bp, Homo sapiens
tcacatttaccccagcaactgagagccaggaccagcccttcttggggacctgcaccttaactctgtttccaggaatgcaaatggctttgttttgaaccatccacagatttgcccaagcgcccattgaccggggcccagtgactggcagccgagagcatctgggcagccgttgtgttgggggcagggttctctcagtaattagcgcttgtgaccttggccccgctagttcctaagtaagcaggagtgtggagcaagtcccccgctgagggccaggcacgctggatcagggggagcccgagatgaagggggaaggctctgtctgggccagggaggacaggacggctgtctttgcaaggcgtgtgggcgtcctggtgagggtgtcccattttatctttgggacaattaattattgtcttaatgttttttaataaatccacattcctatagaac

SEQ ID NO: 255600 - DNA, 302 bp, Homo sapiens
cacacccggctaatttttgtattttggtagagacagagtttccctatgttggccaggctggtgacgaactcctgacctcaagtgatctacctgcttcagcctccccaaaatgcaggaattaccggtgtgagccactgcacccggccgtaattttatcttttgccaacttaaatgaatacctaagagataactggtataaagagtgctttttgaaagttctccaggaaaggagatctatagcttctgaatcttgcccattcgtaggtttaataactggaactacaaagttttaaagtaaactt

SEQ ID NO: 255601 - DNA, 414 bp, Homo sapiens
ggtgtatatatttatgggttacagaagatattttgatataagcatgcagtgttttataattacatcaggtaaatggggtatccatcacttcctgcacttatcctttgttacaaacaacccagtaatactctttcagttatttttaaatgtacagttaaattatttttgaccatagttttttaagagcagaaataaattttatagtgggtctatctcatacagtccacttactttgtagacaatttctcttttgctcagatttatttgagttgctaaaaaaaatagccatgtaaattctaggtttattcacactaagtgctttcctttttctcttttaatgaaaacctgtgtttttttctttccttctcagcaagaacccgtattattcaatttgcaactttctagagagtcagc

SEQ ID NO: 255602 - DNA, 439 bp, Homo sapiens
tatgtgtagtgcctaatgttcactttgaaagttcattttagtaccaaagaatatgcattttagatgttctaaatcacctctagaaagcaatgcagttttctttgaagacgtatgttttgggaatattttggccagcagacagatttattactggtgacttgctgtcagtctgtttatgacaagacagagcaggctgagagggtttacatgggggcacacagaatgtgtaggggagagcagacagtgagcttgtggcttgagagagacacaaagcccacatcaaagggaagtgaagggcaagtgagcccaggcacaccacagtcaggcaggagaagacagaaacatttgggctggggggatgtgattccatggctggaaggacagagtcttcaggtcggtcgacgcggccgcgaattcagtagtagtagtaggcggccgc

SEQ ID NO: 255603 - DNA, 288 bp, Homo sapiens
ctcagccttccaagtagctgggactacaggcatgtgccgccacaccccgctaatttttgtgtttatagtagagaggggtttcatcatgttggccaggctgatcttggactcctgacctcaggtgatctccctgccttggcccccgaaagtgctgggattacaggcgtgagccgccacgcctggccagattaaaattttaatataaggtaatttccaagtaattctgtatatcttttccaatgcttaatatatactaaaatgttggttgctgtgagctatttctttaaa

SEQ ID NO: 255604 - DNA, 418 bp, Homo sapiens
caactgacccggcaggactgaccgtctgcatttaacagggaggtccggccgcctgctctgggtttccagggcccacccataggtggccagggccctagcctggggctagagccttcacgcaccgtcagtctgaagccaagagcattaaactgaagtgcacaattggtaaaactctcagaatgagaaggagttcattatctaggaactccattacaggattcactgctgacatctaactgtggggctgtattttcaggatcccagtgacttgtcaacctctaccccatagtctacaaacggttggcagactatgccacaggccagacccaaccctctacctctcttcatacagccctaggctaagaatcgttcttgtatattcactgaaaacaataacaagagtatgtcatgactcaaa

SEQ ID NO: 255605 - DNA, 684 bp, Homo sapiens
ccattaccatgcatagttactactgtgtgtgtatatgtgatgaggacacttagaaggagatgttggtcaaaggatacaagattgcctcacatgattaacagcatttttcagtgtagctggtgtctgctgtacatcagaagggaagtgatgtaattaacacatttttctaaggtatgaatgagtgatgccttcttgatcttaccaggattatacatactttaaaaaggtatgcttaaaatatatatgttgaatcacagggtatgtttagaatctaagttaagctttagtttgtagaaatcaagcccttttgtatgttgaacggaaaatgagattttaggcaatatgagagacagattatacagtttttatggcaatgtggacaagtatccattcttgtggcatgcttgaccaagagcttctttatttcattgggaaagacccttttatagaacactgttaagtaatgcatgtatttacaactataaggaattctaatttgaaaacatttgccaatggttttgagtttccttctgggaagatggtgacaattccagaaaaatttcagcaacaaggcagcacaagaaccaatgccatttgaattggtttaacataaagaaaaccaggtggatggaaaaattctgacttttcatctcagctagggacttacaggccccctgatgaaaa

SEQ ID NO: 255606 - DNA, 530 bp, Homo sapiens
cctcctatcaaatccataatttgaagattgactaagtcacctactttgcattcagatgttgataattatcaagccagcctaggttaaaacaagttttttaccttttacaaatatatttttttaagaattgtgtatcttggggacaaaacattataataaggttaatgagaaaaggagcaacacaaatctgttttcattaatcttaacagagctttaatcacagcacagggggaaacagctgctctggaagggagactaggagcagatcagtagaagctgattatccattaatgagagggctttggtggggagccctgtggaaaacccaccagactcaatcctgccagccatttgctgaagaggtggtgtatatgaatcgcttgtttgatgtaaaaaattcaaaacagattcttctcagcagcctggggactgtcatacatcactgatctcttatctgtttatgttaaggaaatagcatccttcagtaagtaaatgtgtgtggtatttaattaaactcattgctgagctct

SEQ ID NO: 255607 - DNA, 1267 bp, Homo sapiens
  misc_feature (411)..(411): n is a, c, g, or t
  misc_feature (786)..(786): n is a, c, g, or t
cattgctcctgaagcatttccgtctgaagatttgcacaataagaccctgagtcagcaaacctgtaaatcacatgttgacactgagaagccctaccctgcttcaattccagaacttgcttctactgaaatgataaaagttaaaaatcatagcgtcctgcaaagaacagaaaaaaaagtgttaccttcaccattggaattatctgtcttttctgaagggacagataataagggaaatgagcttccatctgctaaattacaggacaagcaatatatctcatcagtggataaggctccattttcagaaggctctagaaataaaacacataagcaagggagtacacagagtcggttagaaacctcacatacttccaagtcatcagagccctccaagtcacctgatgggataagaantgaaagtagagattcagagatatcaaagagaaaaactgcagagcaacacagctttggaatctgtaaggaaaagagagctaggatagaagatgatcagtcaacccggaacatatcatctagcagcccacctgagaaagaacagcctcccagagaggaaccaagggttccccctctcaagattcagctttccaaaattgggccaccttttataatcaagagccaaccagtctccaaacctgagtctcgagcatccactagcacatctgtcagtggcgggaggaacacaggagccaggaccctcgcagatatcaaggcccgggcccaacaagctcgggcccagcgagaggctgctgcagctgctgctgtggctgctgnagcgagcattgtctctggagccatgggaagtccaggagagggtggaaagacgagaactctggcacacatcaaagagcagacaaaggctaagctctttgcaaagcatcaagctcgagcccatctcttccagacctctaaagagacccggttgcctcctccgctcagctcaaaggaagggcctccaaacttagaagtctcttctacccctgaaacaaaaatggaaggttcgactggtgtcattattgtcaatccaaactgtagatctcctagcaacaagtctgcccacctccgggagaccaccactgtactacagcagtctcttaacccaagtaaacttccagaaactgccactgacttatctgtgcatagttctgatgaaaacatacctgtgtcacatttatctgagaaaattgtttcatctacctcttctgaaaatagcagtgtgcccatgctttttaataaaaattctgtccctgtaaaa

SEQ ID NO: 255608 - DNA, 659 bp, Homo sapiens
atggcgaaaccccatctctactaaaaatacaaaaattaggtggatgtggtggctgcgtgcctgtaatcccagctactcgggaggctgaggcaggagaattgcttgaacccaggaggcggaggctgcggtaagccaagatcgtgccactgcactccaacctggcaagaagagtgagactctgtctcaaaaaaaaaaaaagaaaaaaaagaaaacttgttctccttcctgtctctccctcaccccctgcttctctaagttaacacttgcagctgagattttctgctacttcccagttctcttcccttgccctctgtcccttgaccaacctcctctccttcagagcccagctaaggctcaggacggcaactgcatcttcctgactcaacactccatcctgacccaagggactccccttaggtcagcaacacttgaggctgactcagtgcttggctgggcccttcctgggataggaatgtgttcatccccagagccagccacactccactgtcaagggcccatgctcaatctggctggggtaaggggcttatctgtgattgcaattaaggcccagactgagccagaagaatgttcctttaatgtttaaaactaatttggtcatatacaactgagatttacagtaaaaaaaaaaattgataaaa

SEQ ID NO: 255609 - DNA, 581 bp, Homo sapiens
ataattcatgaccctcatcttatcactttactccatctttttatcctattaaattatttttgacaagatgtcctggtagactaaaggtgaacagatttgctcttgctcatcttctggtggatattttaacttgctattcacaatcaggacaaccaaagtcaaggacccagatgaaccacaaggcagctagtcagctacttagaggttggttacattcgaataaaaagtagtcagggaatgggggaggtggggagttggggagtacttggcagttgggatatgatccatttttttaaacaagttttttgtagatcccttgtaaaataataataataatgttgtgaatctccatgccaagtgaaaaaggcctaaagatgagttgaatttgtgataccatgggtaaggcatggaagaactcttgaatgtgttggccattttctctaactaacatgtggtatgtatggtcccctatattagatagaagtctttgctacatgtaattcaaaagcatctcgcttttctcaggaaccaaaggcttatgatgtaggacaaagaaatcatcttagaactgtcaagcatat

SEQ ID NO: 255610 - DNA, 1212 bp, Homo sapiens
  misc_feature (707)..(707): n is a, c, g, or t
ccggtataacgccgctgactgcatccaacgcctagactgcatccaacgccgcctgactgcatccaacgccgcctgactgcatccaacgccgcgctcctcctcctcctccgcctccgccgccgttgcttgaatggtggagccgaagctcggctcgtgaacacacactgacagctatagggcaggcggcggcaccgtccccgcttcccctcggcggcggggtgtcccgtcggcggccctgaagtgacccataaacatgtcttgtgagaggaaaggcctctcggagctgcgatcggagctctacttcctcatcgcccggttcctggaagatggaccctgtcagcaggcggctcaggtgctgatccgcgaggtggccgagaaggagctgctgccccggcgcaccgactggaccgggaaggagcatcccaggacctaccagaatctggtgaagtattacagacacttagcacctgatcacttgctgcaaatatgtcatcgactaggacctcttcttgaacaagaaattcctcaaagtgttcctggagtacaaactttattaggagctggaagacagtctttactacgcacaaataaaagctgcaagcatgttgtgtggaaaggatctgctctggctgcgttgcactgtggaagaccacctgagtcaccagttaactatggtagcccacccagcattgcggatactctgtttncaaggaagctgaatgggaaatacagacttgagcgacttgttacaactgcagtgtatcagcactgcaactgcataagcgaattcttggacacttggtcatcctgtgtactggtgttaacttttgatacgaacactggcagaacggatcttcaccggcacccgcatgacctcgtcctcgtgccacatatggggcaacacgcacgacgcgaaggtagctagataacctacacacgaacagcaagcgacatactcgcacgggtcgataaaccttcataatccctgtacacccagtgaaactaggcgaacagctggacccacctcggcgtcttaaccaccgatgcacgacatgaggacacacgaggccagcggactggtagcacacaaagatacgcacatgcgaagtgagcaaacagactattctccgggcgaagcacagtcagtaccagacccacccaaaacccgctacacgaccagacacgagacaacatctacttatctcagtgaca

SEQ ID NO: 255611 - DNA, 694 bp, Homo sapiens
ccggtataacgccgctgactgcatccaacgcctagactgcatccaacgccgcctgactgcatccaacgccgcctgactgcatccaacgccgcgctcctcctcctcctccgcctccgccgccgttgcttgaatggtggagccgaagctcggctcgtgaacacacactgacagctatagggcaggcggcggcaccgtccccgcttcccctcggcggcggggtgtcccgtcggcggccctgaagtgacccataaacatgtcttgtgagaggaaaggcctctcggagctgcgatcggagctctacttcctcatcgcccggttcctggaagatggaccctgtcagcaggcggctcaggtgctgatccgcgaggtggccgagaaggagctgctgccccggcgcaccgactggaccgggaaggagcatcccaggacctaccagaatctggtgagacattcacgtcgcagagcaaagaaacttttccctgagtcgaataaaaattgaatttcccgcaattttttacagagacaaaaacttggccctagaacgtgaaagctccaaaggccatggggagggttgggaggccggcgcggggtctgcgggggccagtggccgggggtactcgtacttcggggccgcaggggctgcggacaatttatttgtgatattttgttaatgtgctagaaataaagatacgtc

SEQ ID NO: 255612 - DNA, 916 bp, Homo sapiens
  misc_feature (411)..(411): n is a, c, g, or t
tatatggagtctattcctcctcgccggtctggagatggacctgtagcaggcggtcaggtgctgatacgcgaggtggcgagaaggagctgctgccccggcgcaccgactggaccgggaaggagcatcccaggacctaccagaatctggtgaagtattacagacacttagcacctgatcacttgctgcaaatatgtcatcgactaggacctcttcttgaacaagaaattcctcaaagtgttcctggagtacaaactttattaggagctggaagacagtctttactacgcacaaataaaagctgcaagcatgttgtgtggaaaggatctgctctggctgcgttgcactgtggaagaccacctgagtcaccagttaactatggtagcccacccagcattgcggatactctgtttncaaggaagctgaatgggaaatacagacttgagcgacttgttacaactgcagtgtatcagcactgcaactgcataagcgaattcttggacacttggtcatcctgtgtactggtgttaacttttgatacgaacactggcagaacggatcttcaccggcacccgcatgacctcgtcctcgtgccacatatggggcaacacgcacgacgcgaaggtagctagataacctacacacgaacagcaagcgacatactcgcacgggtcgataaaccttcataatccctgtacacccagtgaaactaggcgaacagctggacccacctcggcgtcttaaccaccgatgcacgacatgaggacacacgaggccagcggactggtagcacacaaagatacgcacatgcgaagtgagcaaacagactattctccgggcgaagcacagtcagtaccagacccacccaaaacccgctacacgaccagacacgagacaacatctacttatctcagtgaca

SEQ ID NO: 255613 - DNA, 263 bp, Homo sapiens
gctgccgccgccggcagggcgcggggcgcggggctcggggtccccgccggggcgcggggcgggcgggggaggggagcgggcgggtaggggccgggggccgggctcacggggtgtcctctccccgcagctgctgccccggcgcaccgactggaccgggaaggagcatcccaggacctaccagaatctggtgagacattcacgtcgcagagcaaagaaacttttccctgagtcgaataaaaattgaatttcccgcaattttttac

SEQ ID NO: 255614 - DNA, 587 bp, Homo sapiens
ggggaggagcgggtgggggtctcactgtgccgcgtgcggagcgctggggacgaggggtcggaggcactccttttttagcgccggggggcgggggcgcgggccagagccggggccgagccctgggccgcgaaggcggcggactcctttctgcggcggagggatccgcggcggaggcggccacggccgtagtcgctgcctgagagttgttgtttcctcctcctcctcctccgcctccgccgccgttgcttgaatggtggagccgaagctcggctcgtgaacacacactgacagctatagggcaggcggcggcaccgtccccgcttcccctcggcggcggggtgtcccgtcggcggccctgaagtgacccataaacatgtcttgtgagaggaaaggcctctcggagctgcgatcgggtaagtcggggggctgccggggccgctggcaccgggcgattccgcccgcggtcccccgccccccgccgcccgaccgctcagcctgtgtgtctccccgtccctctctcccgcgcagagctctacttcctcatcgcccggttcctggaagatggaccctgtcagcaggcggctcag

SEQ ID NO: 255615 - DNA, 824 bp, Homo sapiens
gcttcagtgtctccactgctgaaaagggggaagtcacatacacatctgcgttattgtacagacgataaatgacaacttctcagccacaatctgaatgagaaaactaagcactgctttcttggagtccatgtggaaccctgggcctgatcctgccccggggttggtcaagcaatgaatttatttaggaaaaataccagtgaagagtgggcttgatcatgaccaattcacaatctccagaggatgtgatggctcaatagcattacctgtgcccacaactgatggtaactgagacagcaggctctgagacccagagttcctcccctctaggaattttcagcccacgtagaggaagatataaaataatgacacgaataattacaaaaccaaatagcatatattgagtaatgacacaagaatttttctcttctctttttctttgcaagttattagtcactataaagcaatggctaagagcacaggctgaggaggctggcttcctaggttggaatcccagcttcacctttcacttgctgcatggcttctggaaaattacttcacttctctgtgctgccgtcttttttattacaaaataatcagccgggtgtggtggctcacgcctgtaatcctatcactttggaaggacaaggtgggcggatcacttgagatcaggagttcaagaccagcctggctaatatggtgaaaccctgtctctactaaaaaaaaaaatacagtaattagcctggcatggcggcaggtgcctgtaatcccagctactcggaaggctgaggcaggagaattgcttgaacacaggaggcagaggttgc

SEQ ID NO: 255616 - DNA, 400 bp, Homo sapiens
atcatgccatgtacataaccactgtcagtatcagtgggggcgttttctgaatcgtggcttttgttttctgtgagctcattgccccctttcccctttaatattctagtaaagcttattttacaaagaaaaatgcctgcagtgaaaagcatttcttgatcatctttggatcaatatgtaatatttatatttcactgaatcttcatgccgtgtttcaggtttagcttctgtgtcaattttgaaatgatctgtggtaaattccatattggaaagacatgggtctcctctactgacttattttcttcttattccctgaaaagcctttcttatcaccccaggaattgtggagataaattttttcactcatgaggcataatatagttagtcgatgatatatttgttg

SEQ ID NO: 255617 - DNA, 692 bp, Homo sapiens
actcagcatggtgcctggcttatagtaaggagtcaatagagggaacttgatcatgatcccttttgttgaagttacctaggtgcctccctcctggatcctcatatgacaggacacatacacacacatgcacacacacaccaaacaggccagagaagcagcctcaagcagtggttcttaaagtgtggtccctggaccagcagcatcagcatcacctgggaacttgtcagaaatacaaataaattatcaggcccacactagacctactgactcagaaactctagaagtgggacccaccaatctgtgttctaatgagccttctaggtaattcaaatacatgcaagtttgagaattatgggcctagagcaaggggcagatgaagaaaaccagattcctggtcagaattccagtggctctctccaatgcatagagaaaaggcagagaaggatctggatagctccaggttcaaggtcagtgaacctcaccattttgcagccatcagcctggccttgcttctctgttgctggcagaagagtttggcctccatgcatcacaaagaaagtgcctttggctatgggatgaagagcatgtgccgagccactgtcactggggccagttctccactcggtgtcctgtgcacctgctctgccaggggccaaccaagcagagatgcaacaggaagctagactgaaagc

SEQ ID NO: 255618 - DNA, 336 bp, Homo sapiens
aacatcttttgtcttaattttttgcagtttaaaaaaatatttctttccaaataatggtgtaagtaattttatcaagcattatttgaaaatgtttggacctacattgaggtcattagaaaccatttctacttggagggcattaaaaactataaataaagtatgtcttaaataatatatatatgggaaacaattagtttttcaaaaaatcaaatagtttttctagggacacacacacatatatatgtgagagtgtgtgtgtgtgtgtgtgtgtgtgtatatatatatatatatatacatacacacacatatacatatatatagagagatatattttta

SEQ ID NO: 255619 - DNA, 411 bp, Homo sapiens
cagtttcccgttttttaaattgactttttcatgaggtcagtgtggccaccttacacgctgtccccacactctagatttgtctgattgtgtttacttatagtatcattttccttccggcccttgtatttcctataaactggaagttaagtctagactagagttggagtaaacaattttggcaagaatactttaaaggtaacatattctttactctgaaccacactaaaaagtgtataatgtctcatcctagtctgagggttgctgagtttaatggaacctttgtaaaaacaaaagttgctaggcgcagtggctcacgcctgtaatcccaacactttgggaggccgaggcaggtagatcacgaggtcaggagatcgagaccatcctggctaacacggtgaaacccgtctacta

SEQ ID NO: 255620 - DNA, 739 bp, Homo sapiens
ttcctcactggaaacatctactttgagtctcactcaagtgaacgcacttgaatgtgcattcagatcacccaggggattttcctaaaacacagttttaagtatgagatggggccaaagcgtttgcatttctaacaagttccctttgacatccaagctcctcatccagccactacattctgagtagcaaggttttatgtgatcctgtctgacattgctttgtatgccaatttaaaaatgctatagctgcttctgtccaggactaacatgcctgaagggtttaggaaacttgaattgtgacatacatgtgccaggcactgtttagagtgctttttatggattagttcatggcacatggttaaacccacaggcttggagaagagacagaactgggttcaaaggtcagctagggccacttacaagctgtataactaagatacattgccaaacttgtcttgcgttaatgtttctatcaaataatccttatatgacaatatagctgtgagaatgtgttcttgtatgtaaagtgtttaggactgtgcctagcaaatagtaagtgcaaaataaatggtagctataattattatggttatcatcattattatttataatagactcgttgtttttacattaacgggtgtatcttgataaggaggcatttggatacaagaaatcaaatccatcaaaaccagcatcagcaaatatagtgactttactgggtaaataaaagagtacgagctca

SEQ ID NO: 255621 - DNA, 522 bp, Homo sapiens
agacgtctctgcaagtcaaattcaccagtagcaaaaccgttaatttcctctagagctgcactgttcagtaacgtagctcctatactcatacggctattaatcacttgtaagtgtgacaagtctgaattaagatgtgctgtaagtgtgaaacacacaccagatttctaggacagtatgaaaataatgtaaactagctcataaatattttatgttggctacatattgaactgatagtatttatgaagtattgatttaaaatatactaagtaaatgagtttgatgtttctttttccttttacaatgtggctactagaaaactgaaaaatacgtatgtggcttgcatttgtgccttgcaatacatttctattggacagtgctgctcaggaacatttgtatttgtttcagtcagctcatgtatctccatcatctgaattgcaaaggtagaaaattctatctttaattactcaaaaaagttttgtgtagctctattaaagtttgcagtctctccttgattcctaatct

SEQ ID NO: 255622 - DNA, 392 bp, Homo sapiens
tcatggaaagcctctgccccactgccgcgactcaggcctggccccgggtgcaagttcaagcacagcctcaagcactgttctgttcacagtgcatagaatgtgcttccccagaatgcaggcagcggccgctgcagggaaggagaccacaccaagctctccgggctgccagcactgggaaaccacagggaaggcaccagccctcaaaggcgctgagctggacaagagcagtgacatcgtccaatcttctgaggactttctatttttccagagactgacacaaaaaaccagttcattgttttccctaacaacagatgagaacagaaaggaaggggaagcagattttgaatggtgacatttaaacccaaaacttcattcctcccagagtctcaaga

SEQ ID NO: 255623 - DNA, 363 bp, Homo sapiens
attaatatgcaataaggataggattaagtgtcttagtgttctcgtcgtgttacgctttatgttatcttttggagaaaatgccatattgtcccgttgatttagggtgttgtgtgttgtgatttccagagctagctcctggtcggcagtcgggggttggcactcacactgcatacctgacttcaccccagccattgttggctcttctagctttgggtcccctcatgcattcatagggcattcccaggtctctcttccagaccttgtgcaagacagacaccatcggggtgttcctgttccaaacctaggaggtttatcttacataagaaaacttctcaaacccatggtaactccgttttctttaaa

SEQ ID NO: 255624 - DNA, 219 bp, Homo sapiens
gtcaattatttttctgcctccattgagatgatcatgttatcttttccttcattctgtcaatgacacatttattgattttatatgtcaaactctttcatcctgtggataattcccatttggtcatggtgtatgatgttttcgatgtgctgttaaattcagtttgttagtgttttattggggatatttacatctatattcatcagggatattggcttgtag

SEQ ID NO: 255625 - DNA, 437 bp, Homo sapiens
tctaactctgccatggtgaatgtgatggaggttggagccgatcacagctggtccctggagagagggctgtgtgtgtcagatttattgtgctgcagctccagttttgttttggtttagtttttaaatccccagtgtcagttttgctgatttcagttaaaactaaagattgtgaagggagacagagacaggttcatgccctctgagttttagagattggtgatatagtcgttgggtgagggccctctgtcttatatcctttgcttaaaacatttcaccttggaaaggcagaaattagccttgttgaacttcaactccctctgcaagaggaagaaatactgaatactgtttcattattgatatctttttaatgagtactgaaagccactacaggatctttgtttcaccttcagataaaatgtttcatctttcattctctg

SEQ ID NO: 255626 - DNA, 730 bp, Homo sapiens
ggagccatattgaaaaagataacaactgctaacattttggagaaatgaaaatgggcatgaatttattgattaaagaaatgtaccaagtcttggcagcctgaatgtttaaatgtgctataataaaagataaattatgataaaaagtattcatagaatagtgacagtttgcctgtcattagactttgatcagatttctcatcaccagtagtagacaccagaagacgacaacgggcattctccaaatggtagagaaagtaactttcagcctaggttttcatacacagcaaaactatcattcaaacctgaatgagaagggttttttttcagagagaatttttgaaaggactactaaagaaaaatgccttttgagaagaacgttatatttgaaggggaagaaatggaatgcattaagcagtgattaggaaagatgttggtaaatacgatggtaaatttagataagtgattatttaaaaagtaatggacgaaggttaaaacatcctgtaaaaaataatgataagtttacaggtatagagattgtagttaaaagattctaggggccttatatgggaagatagactggtattttaaaactgtaaatttaaatttacatgtagaaattagtggtaatcactgtgtgctaccttataagagaaaaatccacttccattttatatttgtgaccacatgactgaaccatgcatactaatcagtatggtttcttggattcttg

SEQ ID NO: 255627 - DNA, 294 bp, Homo sapiens
gttaaattttaattttacccaggtcagtaaaaaaaacaaaaaaattctaaatgaaagctcccatcagtactatggtttttatattcttacctttacttttgcattcagacttctatagcagaataccatagacttggaagcttatatacaagacaaatttatttttcctcatagttctggaggcagggaagcccaagatcaaggtgctaatagattaagtgcctagcgaggccgtcctggttcatggatggctgcgtttctagtgtgtcctctcatggcaaaacggaacaaagg

SEQ ID NO: 255628 - DNA, 965 bp, Homo sapiens
tgaggcaacccacacaggcaggctggagaggagtggcaagaagctcaccttcggacagtagtgagcagagcaacagaggcccccagagacttcgcacaacggaaaagagatcaactcccgcatttgcaggggacgtgaaagtgcaatactgtgaggaacaaaaggaagcctcatctctggaagccgggaggaaaaacagtcggtgtagacagcagcggcagggaccagagctgaccagaaggctgggtcccagcaacaattagagacaggcagcagctgaggccccttctctgagaaccatttcaattgcacagtggccacagaaggctccattggcccggcagccagctctgcagagccatttgtccacaaggaaaataatagccccggcctcattgctttgggctgcagggaggacaatgacccaccatgaaaagagttaaaaagattctggggaaggggaaaggcaggcccacacggtggcaattcaagatcttttggatgccgtgagcgtgttctttaattaagcccctcttcttcagctcatcctgcagaaacgcacctgcttcccatctgccatccaaaacggcaagcacaagaatgacttcacactgtcactttcagagttccgctgtggcccacagtgatttttcaagaaaggcagccacagactcgctcgcgctttctctttctcctttcctctgaaagactctataaaaaccacattaaaaagtgtgtgagccaagcaatttcatttatcaaaggaagaaggtcatccatagcattcattctaagaatatcaggcacacggccagccctggacacaaggcatgaagaccagagggccctttattgacctaatctctattttgtcgccaaactgcatctgtgtctgaaagctgggacacacaatatttccctctaccaaaataattttattttctgcagcagcatgtaacaaacaa

SEQ ID NO: 255629 - DNA, 94 bp, Homo sapiens
gctggcgggtgggggaggcggagagctcgatgcaggtgctgtcctcctcgccacgactctgctagctgtgcagtagccctcgctccgccactta

SEQ ID NO: 255630 - DNA, 778 bp, Homo sapiens
aggtctggtcatttttctaaggagagtcagcggacagcggctggctttgaacccagggctgaatggctccaggggctgtgtccctgactgctaacccggtgggctccaggctgatcgccccctcagccaagggctgagaggggaacgttccttttgaaaagctggcggaacatcctggaaatgttcagaggcagccagaatggaaaaagatgctcaaaggggacagaacttctcaaaggggtggaggctgccctgccatgggtgacacgtggaaaacttgagacatgtgacatccaggcggttagtgggagaattggtcatgctctttggcaaattgcgccctcctcctccctccttctccctgctcctccaaactctaccctgggagggagcacttgggaccacctcagaggaggcctggtggctgtgacccagtcccaaatgtctgcccagacttggagactgcaaagagcgggagcccttccttgagcctcaggagcagtggggttcacagggcccctctagtcaccgtttttaagcccctggtctcagactgcccctccctcaggtctcctgagcttagccacatcatccacgcccttggcacagccacgggatgatgggtgtgatgcgggcatccctcgtgttggcatcctggaccgatatccagggccctgctttctccccatcctcctgcctctcccatgcccctcctcaaaactccttggcctccatcctgccctcagaatcaccacctgtgactcaggcacaccaatcc

SEQ ID NO: 255631 - DNA, 212 bp, Homo sapiens
  misc_feature (100)..(100): n is a, c, g, or t
cacagttttttgactctgagaaatttaattaaactttctaagcctcagttttcttatttataaattgtgacagataaaacctaaggtgtgagttttcttnggttgtgtgtcaaattaccacaaacttggtggtttaagacaacctgctcttattatctcaccatttccattagtacagagtctgggcacagcttaactgaatccactgttca

SEQ ID NO: 255632 - DNA, 468 bp, Homo sapiens
acttggtctgaattccctaatagacattctcctagcgggatgagtccccctttacagcactcgggaaatgcctgctcctctagctgtctctgatccacctctcctgtctttcaactaaggcccccacatgccagaccatcgttggtggacctcgtcaccagcatgaagtgggctcttggagttgtcgactgactagttcacaattagtgactcatagcatctcactcatttccttttcatcagtaggaggcagcagtctgcacttttgcatcacatttcaaagacatctgtgtgtttgttctcgtgcagaacactttgactattgtaacctctaggtccatgaatgaccctcatcttcagtaaaagtggattcacgctggcaaagtctgctttgttttattgtgacacatggaacattatggattttggtgaataaaaactaacttaaattgaagtattcttgtaaaa

SEQ ID NO: 255633 - DNA, 675 bp, Homo sapiens
tggatatatatcatttctagacttgactcattaaaaactcccatgtatggtcctttaagctttatttgctccctgtctagtggaatggagaagactgtcatggaagtcttggatggcatagggtgaagatggcagagtatctgttggccatttggaggagaattgttctctgatctgtttactcttgtaaacaagaaatacatttccattatgtgctatttcatattttgagtccatttgttgcagtagctagttgatcttgcctaataaaaacaagattattgaagaagtaaccgtaagcacatgtattaataaattcatcctgaatgaaacatcatttacttctagcttcacattattgtttgtaatcaattttacaataatacttgtataactatgtggtcctaattcaatgtctaaatcaccaaattattttttatggtgaaaacagtaagttttaagtgaaataattaaattcagcatgaaaagagctaaattaaaagaatatttctggcttatgtcatgatctattaaagtgcattttatataatcagaaatctgtcctactcctttcctttggcttagattttctctatgttgatttcttttctgcacaggttctctatggtgaagatggcaacttgctgactcagtctcagaatgcgttaaatccac

SEQ ID NO: 255634 - DNA, 431 bp, Homo sapiens
agctggaaactagatacgcactcacccagctttaagcttgcagacgatgccagtgccccagaggagggcagagctgcccttctagcctgggtccctggatgaccttgggaagtagaggatgtctacctgtcctattactggcaggagatgtttcaccattgcctttggagtctctttgctacaacctttactctagttaacatggtaacatatttattattattgtgttttccctgcatattagaaaacaaaacaacctgtatctcagggactaattgcagaaaatagccacaaggcagaacatcatttaattagaatacatggcagatggtgatttaaaattttttcattaaaacactcaagatgaggctgaaaattttcagataataataaagctggttgatttcttacatgctattaactaaggaaaa

SEQ ID NO: 255635 - DNA, 224 bp, Homo sapiens
  misc_feature (211)..(212): n is a, c, g, or t
  misc_feature (215)..(215): n is a, c, g, or t
  misc_feature (217)..(217): n is a, c, g, or t
  misc_feature (219)..(220): n is a, c, g, or t
  misc_feature (223)..(223): n is a, c, g, or t
gtgtgtgtctacatccttctaagtggagatccatgtctctctccccactccacctgtcctgttccaccattcgctagctggccatccacttggagtcagcagtgcttcctgtggtgagtgtgccctggagtttgccactgctttggtcctgaccacagctttctcaggccacgcagggctaggtgtctaggtggcagtgttttgtatctgnntgngncnncang

SEQ ID NO: 255636 - DNA, 462 bp, Homo sapiens
aagaagtctaaataaatgacacagttctttcataaaatttttatcatgtgctttgtgactgtgaaaagcctgtcattaagagggtacttaaaacagtaaaaaaatacatgagcagagattaggtcaaatcattaatcaaatttgctaactctgcccaagaaaaccctgcaaatggtatcacagaaatataaagcagagatggtcattatcaagtagggatacttgatattagttcctttataaaacaaaggaaaaacttatagaggaaatttagtgctttggatgaatttaagtggataaaagaaaccactcaaacccagatctttcatcacttaataaagagatctacttgggatgctttgtgaaaatatgttcacttatcatcttgtctccatcatttggaaggatgatggtcagtacctgggattaaagttttgtcagtggggacactgactggggggt

SEQ ID NO: 255637 - DNA, 405 bp, Homo sapiens
gacaagagagcttgatttcacatggggcctccagacctgaggtgagaggagattgtccccaggtggaaataaagatctggtgcttcccataacaagttctcattagccaaaggctatagtgttgaaaatacatgctatgtataaaaggtgacttgtcttcaaatttttcttgtaactagaaagattgtcagaattttaaatgctccaccaccctagccaacatggtgaaacaccatctctactaaaaatacaaaaatcagccaggcgtggtggcacgtgcctatagtcccagctacttgggaggctgaggcataagaatcacttgaacccaagaggcggaggttgcactgagctgagatcccgccactgcacaccagcctgggcaataaagtgagactgtgtctc

SEQ ID NO: 255638 - DNA, 401 bp, Homo sapiens
attggggaagtgataaatgtccacgaaatcttcacaatttatgttcagagattgcagtaaagacaggcataagaaattataaaagtattaatttggggaactggatgaattcttggaaatacaccatctcccaggattggactaagaagaaacataaatcctgaacaggccaataatgtgtaatgaaattgaatcagtatttttttaaaaaacataccaaccaaaaaaaaaaaaaaagccttgaataggatggatttacagccaaattctaccagacatacaaagaagagctggtactagtgctactgaaattatttcaaaaattgaggagaagacactccttcctacaatattctacaaaaccagtatcatcctgataccaaaatctggcaaagacacaa

SEQ ID NO: 255639 - DNA, 438 bp, Homo sapiens
actgttccccatgcttttttcttccttctctttacttttttttccatatcatggatttttttttttctgtgtttaacaaaaagtaagttgtttatgtagcaaggatttttatattcagtatggagtattgcatgttaatgtgtaggaaaaaatcaggctgaggccgggtgcggtggctcacacctgtaatcctagcactttgggagactgaggcaggtagattacctgaggtcaggagtttgagatcagcctggctaacacggtgaaaacccatctctactaaaaatacaaaattagtggggtgtggtggcaggtgcctgtaatcccagctactcgggaggctgacgcaggaggtggaggttgcagtaatctgagatcgcaccattgcactccagcctgggcaacggagcaaaaactccatctcgaaaaaaaaaagaa

SEQ ID NO: 255640 - DNA, 537 bp, Homo sapiens
atggagagaatagtgcattgtgaaggtattgtgagttgggacaacttgtacagagaatataacacaatggcaagtacatttgggcctaaagatatcttagttctccctcttgccactgactctttttttgtgattggaaaagttacttcctctctctgggcctcagtttcctcgttcttaaataataaaaaaatccctcatggggcatggctcctctctccctgccttcactttctgcaggcactgctggtgtgtgctcaggtgtacctgcctcttcccgtcaggtccctgctttgcatttgcacctgccccccttttgtttgtagtctaagtgacacgggtctccctctctttcctccaactgcatcgctcaatcctgcaatgtgtcacaatggtgtggagctgtcattctggatgatgtggcgtgacctcacactgatgccattcccctcccaccaagccaacctggcttcctcctccacccatggaataagccagaatgctgaaagtgggagggaaatagagcaccaaggttaa

SEQ ID NO: 255641 - DNA, 331 bp, Homo sapiens
agaaggactatcagccatgaatagatctaagctgaagtggaaaaaaaagtgatctgaatatgtaaagtcactcaagaaagtatccatattggtttcctgcaaaattcctttggaggcttcctggacgttgcattccgaaagcatcttacggaacatggtgtcgtcttcactacgtcatgaccgccctgccagggacttgtgtgtcctgcattggcaaattccaagtccctcatcatggtctagaaacaaatcacccccggttcctatgtcttcattttcctttcatgtgttccagtaaggcattaaagaacagataacactgtaacactga

SEQ ID NO: 255642 - DNA, 632 bp, Homo sapiens
atagccagtgtttaagtttctgcaatcaggcccctaaattcatactctgaactagtggttctcaaacttttgatcataaaacccatttagactcttgaaaattattgaggacctcaaagagttttggtttatgtgggttatagctatcaatatttaccatattggaaattaaaactaagaattaaatatcagtaagcacaatatgtgttcacatagataagtttatgaaaaattaatgtagttttcaaacaaaatgagatgaatggcaatttttttgcaaaacttttaatgtttggcttaattaaaaaaatctgattcccatatttgcttctgtgttaactcctagagctatatcattttgattgaaggtcagtttggcctcatacaggtatgtacttgggaagggtaagagggattgttttagtagctttttcaggtaatcgtggatatccctctttgcactactaatttggcatgtggtggttgcttaagattagttccaaggtggaacctgaaaccatatcagtgaacctgaccacgttctgtaacattaaaatctgttgatctgtcttgaagtttgaatagatcttttccctatatatgattttctaatattatgcattgattatttg

SEQ ID NO: 255643 - DNA, 708 bp, Homo sapiens
aaggtaaaaaaatctttatatgtcccactaggtcctatgcgatgtgctcctcgccaacctacagcttcatccctcattatcctcccctcttacatccatttccagccctatctctcaattcacatttcaagtcacagcaacacaaaactggctgtggtttctgcccagtaatcaggccacttccatctctgggtgtctgctaatgctgggatttctgttttcttgcccttttctgtaagtttctaggctcacttcttccccctttgcctccctaactcatttctcattactggacgctccaccatgggggctgcttcactaggaaggcttctgtaagctcctccctgcccattgtcccaggccagaccaaacacctgtgccttatgcccccagtgctgtctgtgaatctctcaccaacatgttctccttctttatatccctagtactgtacctggcacagagtaggtatttaaaatgatttgtgggtgggcgcagtggctcatgcttgtaatcccagcactttgggaggccgaggcaggcagatcacttgaggtaaagaggtcgaggccagcctggccaacatggtgaaaccccgtctctactaaatatccaaaaattagccaggcatggtggtgcaaacctataatcccaggtacttaggaagctaaggcaggagaattgcttgaacctgggaagtggaggttgcag

SEQ ID NO: 255644 - DNA, 473 bp, Homo sapiens
tttgtttttcatctctaagattatggtataaaaacaggaatttatgttttagaattgtttgggtagaatcacttaaggtagatgatttgcttattcattcatttgtttatttattaagcacattattgaaatgcccattatgtgccaggcataataatatagtaagtaaaatagatggcattcctaacctcagtgttactctaattgcatagacaggaatgctggggaaagaatttatctttcagccagctattctcctgcctgggacccagctttagctagtcttggctctacaaaggaagttgtaacctaattggaacataatttcttctccgtaaaaactgagggttacaccaaatactttcaccacttctacctctaaaattcttgcttttaatgtgaattttagattaatttagattagattaatcccttaaaactacattcattacattcataccattcttgcatgg

SEQ ID NO: 255645 - DNA, 523 bp, Homo sapiens
ttggaaagatttttagtactccattggcatagctatttcatacaaggattaggagaaactttgaaaggttatccacttgacttttctgattttagaaaggactaccattaaaccaccctatcagacaaaaaaaactggtttttagaaacctgagagaaggaattttataatttccctgagtaagctgttacagggaataacaaatctcctgccacatgtggcacagtgtaagtaatgctggagcacacatactgcattgtaaagaaggtaggaaaggtggggggacttttgttagctttaattttaaggctaaaagcatttcttctcagtttgaactacttttaaatgttataaatgtcatcataaaaatcattagaaaactcatttctccttatgttgtcgttgtaccattgggtattgtatagagaccaatttctaagagattttttcacctctgtttctgttatttgctatactggaggtaatataataataatgaaatatagctttttttttcaactca

SEQ ID NO: 255646 - DNA, 293 bp, Homo sapiens
aaccacctgatactggctctaaaggttttcccctgagaactgtgtacagggcaggagtgaggggttggtgatagaggtgatgatttcgtgtgttggtagcactgacgtattcaatgttgaatgtattctatgatattttatgattatcctgttacatgttttcagtataatttagcattacttttcagagacgtaccagttggcaataaaaagccttttctgtatttaacactgtgaccgaatctgctggaaatttttctgtccaaataaatttcctgaaggcatacatctta

SEQ ID NO: 255647 - DNA, 428 bp, Homo sapiens
tgatgatgtttagtctggggatatcagaaaaagattaatatggtctttacctgacacttgtccttcaggttcaagtgctacctcctttctgaagctttcctgacaccttcagatggagtgaatcattccaccttgtgcctctgaagtactgggcacatgacactactcatgcacaatacaatactgtaacacaactttgtttgcatgcatgtctgtgcaactagattctaagcttttgggtggttggagcaagttgtatttacttcttagtatggtagctgacccattgaataaatatatgaatagatatattaatgcacatatatgatgaactaagtgtgcagaaatcacttaagaaagctggagaaacttgagtcaactacatctcactctctagaaaattaaaggattaagattaaataattaaa

SEQ ID NO: 255648 - DNA, 8555 bp, Homo sapiens
  misc_feature (2781)..(2781): n is a, c, g, or t
  misc_feature (3139)..(3139): n is a, c, g, or t
  misc_feature (4212)..(4212): n is a, c, g, or t
  misc_feature (8197)..(8197): n is a, c, g, or t
  misc_feature (8256)..(8256): n is a, c, g, or t
cacacacacacacacacacacatacacctacacatgaccgattgcctcgcctctagcattgggaatcagtcaccgtgctgtccttgtggagtcttgtggcccaacaagaggaagctctcccctgacattgcccctccaaagtgcgccacttccagtgcgccccactgtcatgcccggcctgtggacagccagaccctgccatccctcccacccccgaccaagcatgggggtgctctgtaggtagctgtgtggcctgacagtctctaccagtcctgctgtccctcagctgagaatcaaacccatttctggatgacagggaatgtgtcttctgctggctgtgttctctgtggagctcaggggagggaaaaggccaagctatttctagggtgctgtcaggaccgatgaaaaggtcacaccctttccaagagacacttttcctggaaagcccctggagcttagctggctcttatcctgtgataagccagaggctctggggggtgagggagcagaaaccctcctcaccccagccaacggggacctgtatacctctgccagtctctcacttggccttgctgctgtcctctgagactgcctgttcctccctctctgtgactctacaccaccatcacctcctccaggaagtcctctggattgactcctagcttattacatctttattgtgcagaccctctccattcaaagcccctcttcaactgcccccccccactacctccaagacagagattctgggttcttgcaactgcagcccctcagagagtgtaagaggggcagaaaaaggagatcaggaggtgagggaagcagcgctgtcagagtttccaaagccccggccagcaaggcctcagaggcctctgttggagtgggggcctccctggctatgcgctccagctgcacaaggcagcctctgtgagcctctcccactcagccctacaggaagcagcagggcccagcctcaatggacccattcagaccccagcgctccggaaagtacctctgcttcctgccaccattccactctggccaaacaggctctactctcttctgatgggaggaggccgcaggcaggtggttcagtggttagggccaaccatctacttcagttcctgtctggcccagatctctgaccttgaccatgccctagtgggtgtatgtatacctttagtgcaagggtggtgtgacagttaatactgagtgtcaacttgattgggttgaaggctgcaaagtattgacctactggaagtgtctgtgagggcattgtaaaaggagataaacatttgagtcagtgggctggggaaggcagacccacctttaatactggtgggtaccatctttctaatcagctgctagcgaatataaagcaggcagaaaaacatgaaaaggtaagattggcctagcttcccagcctacatctttctcccatgctggacacttcctgccctctaacatcggactccaggttcttcagttttgagactcggattggctctccttgctcctcaaacttgcagacagcctattgtgggaccttgtgattgtgtaagttaatacttcataaactcccctttatatatctatctatatctatatctattatctatatctatatctatatctattatctatatctatatctatatctatatctatatctgtctatatctcctattagttctgtccctctagggaaccctgattaacacaggtgggtaggcacagggaaatgtgcccccttccccgtgggtgctgggtaggtaaatgtttcgcaaagggctttcttggggagagggaaccctgattttcagtatttgcctcttttcctggtataaatattcccactgtgggcagtatcacctgcctctcaaaattcctgaaaattcaacagttggctcctggcagctgctgtgagccgttccagccggtgactgtggtggctccatcctgcagggccatgtgcccccaccccttgtgctatggcctccctcactttagtgtgctgtgttttgctcttaggaatcaatgtctttgcagataaggcaccccagtagctggccaccacctgcagttccctggtctgtctcttgctggcaccaagctgtgctgtgcctgctgagactgctgggccacccccgtgcatatggtctgcggggcttacttgattcccttagcttcccagccaaggtgctggtgttgccagcagtgctggcaggaggaggggataactagaggggatttaactcaacccgaggggctcttacgggatctttcctggatatccctccaggtgggactggctgccctgagggtatacaaacctccaactcctccaatggctgaagctacttcctcgagcagatggcagctggctcaggctggctagggaccagtgcatgtgaggtcggtgctggatcaccccatcaaggccatcagcctgtgcttgttcttggggtttgagggaaacccaacagggatgaatcacagtttttaacctgtgtttgtctgccccccagccctggacatctgcaggcaaagttaaagttatatttggctcttatcaccgcaaaaggcataaaccagaaattatggcatcgggttggaagtcagggaggctaatttggggaaactgcctggaggaagcagcaactcaaaagaggaggagtcccactgtgggacagaacaggccctgcataagaaccactaatcccaggcaagcccagacatggccttctgcctggggaggccctctttggcctgctcagcagaccntcagccccttctaggccctgtcttcagcctcagactgagtggtggcctggggaggttgggagctgagctgttctcatccctggttccttggccacggtggaaacaatggggccggatctgactgctcagcggggactgtgaatagctctctagcaggaagcaacagcaggggtagtggaggaagtgtgggcccactttggtttgacactgcatatggtccccatctggcctgagagcctttactccttggcaaactcaggccaataagctcctgcccccaccctcaatggcagctggaagaatggcctgagggagaagcagggataggtgggctgcagtgacatcacccccagatccnagccgtggccccagccaacccatggaggtggggcatggcacggcaggtgctgcacaggagcccaagcacaagagcacttaggagaaggaatctgagcagggatcgatctggcctggtggtgattctccagaaactccattcctcagggctgtgaccaccaagccaggtgatcaggccagtgatgtttccctttgggccaggtcggggagccagacctgggagggagactcctctggggcccaggggaggtgagtcagagctggcagaggcctctggctccaggaacctccaaggaggagacctgagttgctgggaatttctgggtctgacctcctgccaagtcaaggtctgggctggacacaaggtgaggctgtgccttctggtgccaggaccaaggaaatgctgggatctgggcagtgctcagaggcagcaccgtatggcagaaccatgagggtgcaccagcacggacccctttctgcaacccacccatccctccctgcagcacctcgcctcctccaggcaagaatctgagccttgaccacagctccctctctcacacagcttccttctttggttagaaccacccggaggtgactgtggccatggctctgactgacatagacctgcagctgcagttctccatgtcccaacccgaagccctccttctcctggcagcaggcccagctgaccacctcctgctgcagctctactctggacacctgcaggtcaggcttgtcctgggccaggaggagctgaggctgcagaccccagcagaaattctactgagtgactccgtcccccacaccacagttctgactgtctcagaggactggcccacattgtcagtcaatgggtttctgaatgcctcctctgtagtcctgggagcccccctagaagtcccctatgggctctttgttgggagcactgggagacttggcctgccctacctgaggggaaccagccatcccctgaggggttgcctccatgcagccgctctcaatggccgcagactcctccagcctctgacccccaataagcatgagggctgtgctgaagagttttctgccaatgangatgtggccctgggcttctctgggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggtcagcatccacatcaacattcaccagctagaaatctccatggaccagtaccccacacgaactgaggagtcctcagctacctggagccacgtgacagtctccttcttggggagctggttgcagaggcctctcatcacctccaggaacaccgctcaggcctgacaccaggggctgccaatgcctccctgctgggctggctgcatggaagacctcagtgtcaatggctagaggcaggggctgtgggaagccttgctgacgcacaacatggtggctggctgcagactggaggaggtagacaatgcctatggccattatgaagctttctccaccctggctcccaaggcttggctgtctgtggagctagctgagccatgcgtgcctgagccagggctacctcctgtctttgccaatttcatccagctgctatcagcgcagtggtggtgaccgagggtggcacagcctggcttgagtggtggcatgtgcagcccatgctggcactgatggaggctgaactgcgtaaatcccaggtgctgttcagtgtgacctgaggggcacactacagcgagctcgagctggatgtcctgggtgcccaggcatgaaaaatgttcaccctcctggacgtggtgaactgcaaggcccgcttcatccacgatggccctgaggacacctctgaccagctggtgctggaggtgtcagtgatggcttggttgcccatgccctcatgcctgcggaggggccaaacagacctcctgcccatccaggtcaaccctgtcaatgacccaccccacatcatcttcccacatggcagccttatggtgatcctggaacacacacagaagcctctggggcctgaggttctccaggcctatgacctggactctgcctgtgagggcctcgccttccagctccttggcaccccctctggcctccccgtggatcaccgagaccagcctggggagccggtgactgagttctcctgctgggagttggaggccggcagcctagtctatgtccactgtggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccatgtcaccggaggcctgccgttcagggagctgcagaagcagggggctggtggggtggaggatgctgagtggtgggtcacacaggcgttccaccagcaggatgtggagcagggccacgtgaggtaccgcagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaactttcaactacagggcacgatgctgtcagacggtcagggcttcacccaggatgacgtacaggctgcagaggtgacctatggggccatggcacgtgcctcagtggcagtggaggacaccttctgtttccatgtcacagctccaccatatttctccccactctgtaccttctccatccatattggcggtgacccagacatgcctgtcctcaccaatgtcctcgtggtgcccgagggtggtgggtgtgtcctctctgctgaccagctcttcgtcaagagcctcaacagtgccaggtacctctatgaggtcatgtagcagccctgccatgggaggttcttagcgtgggacacaggacaagatcactatggtgacatccttcaccaatggagacctgttgcgtggccagctggtctagcagcatgatgactccgagatcacggaagatgatatgccatttgctgctgccgccaggaccagagcagtggtgacgtggcctgggaggaggtacggggccatccagcctgtgaatgaccacgcccctgtgcagagcatcagctgcgtcttccatgtggcctggggtaggtggcagctgctgactacagacaacatggccttcagcaatgctgattcgggctttgtggatgcccagctggtgctgacccacaaggacctcctctctggcagtatcatggccacggatgagcccatgcagcccatctgctgcttcatccaggaggggcctcaggaagaggcgagtcctgttcacgcactcaggctgactacagctggatcctgctgcaggtgtccgacaggcagcaccaggccatcatggtgctggaggtgcaggccttggagccttacctctgtgtggccattctctttggccacaatggcagcctcagctcccgcaacaccctggccttctcaatggatgtggggccttctcaatggatgtggggccagtgcacacagatgccaccctacaagtgaccattgccctagagggcccactagccccactgaagctggcctggcacaagaagatctacatcttccagggagaggcagctgagatcagaagagaccagctggagaccacggagttcatcatctcggagccactggccaatatgtactcgcgtgggaaccagaacacactgatggaggagtgggcagagtaggcacagtggcacgacgagatgctgcgcatgcaccacgtgctgaaggaggcgctcagcatcatcagtgacaccaccaggaccaccgtcagcatgcccatgcccctgcccgcggacgacacctgggtgcaggtgcagagcatctctgaggaacaaaggtgccagggcctgccccccacagccccaaagtaccccccgcccgggccgcacagagggatgcccctgcatcggggtggctcccacctggagtgaggggtggagcttgccaaggagcactggctgcggggcggggtggagctgggatgttctcaccactggggtctgggcttaagcttgggcgactgcctcggggcacggcagggaggagcttccgtgcatgggtgtggccggggcggggcctcaggggggcagagccacccatctctcccctccctatgccttgcaggtcgcccaagtccagccccaggatgcccagaccccaccatgtccctagcccggcctgggtggcggggcccagctcttgggcttcctcttgccaggtccgcccttggggaagcgtgccccgtaccctccaggctagaggcttcccctgatcccttcagcccctaccccgccaagtgcgctcatgccccacgcggggtctccaagtgagtaggggctgaatgcagccaaagaggctgctggacgggcgtggccgggaaggaaatgggactggagtccagagcatcagacctggccgcctccatccaaggcattgggaccatgggtgccggagccacgtgtggctgagggctggcggagcctgctccccagggagcactgattcctggaggtggtcgtttttgagggggctgtggggcttgtcttacctgcccccttctgtccagcacttgcatggcacttccctctattttcactcttggcggntgcccacacgttgcatttctcttcctttcttcttctcgctgtcctccatcctccattcngtccaactcctatcccagcccctggggagcctacctcaggtctgagagtctgggtgtgtggatttccttcagctacccggatgtccccacaggcaatctgattttttctccacatctggacccctccccctctatccctaaccctgtctaaactaatggcgcagtggtagctgcaagggcagggatgggagtggctgaagcctacttcactcccaaagatttctaaggaaaatggttctactgcatcctttggctgggccttgttgacccgtgaccctcttccaagaacattcactctg

SEQ ID NO: 255649 - DNA, 404 bp, Homo sapiens
agcatctccccagtttctgccttcatcttcatgcggcgctctccctgtgtgtgtgtgtctccaaatttctcctctttataaggacaccagtcctactggattaaggcccaccctaatgatttcattttaagttgactgtctcagccaaggccccatctccaaatcaggtcacattctgggatgctgggagtttgaatttcaacacatgaattttggaggacacaattcaactcgtctcaccggttcaggtgtccagaattggtttatttcccatcttaattgtagatttacaatgtaaatgagccatacattttgtcaattttgtttttgcaagaagtatttaatttgttggtcttacctattttactacttagaagaaattaaaattgcctaagtaagagttc

SEQ ID NO: 255650 - DNA, 378 bp, Homo sapiens
tgtctatactctccatccacatcaattcctgccaggtattattttaatagtctcccctctaatgccaggctccttcttcacctactctcttacccgcagttctaatatgagattcaccattccaacaggattagaccagatgaatagatgatctctaagggccctttcagctctaagactgttgagatttgcacgcacattaggtaaagatgcccccttcttctgaacagtgacgcccaccatcaatgtttaattaatactgaggatgccacaaatctaactcactctgcttttaatggcaggttgactgtgggcttagtttatcaagcctgtccaaatgactaactggatggatattatgcccctggcagagctgat

SEQ ID NO: 255651 - DNA, 281 bp, Homo sapiens
cccatttttaaatcactgaggcttagaaagataaagtgagttagtcagggtcccactgttagtggaactgagattcaaaccaggtttgacagcaaagcctgtcctatttttggcagctgggataatgtggttaaaaggaagtgatgtctacctgagtgttgcaggcagatcagataacacagggagagagagagagctgggactttcccggcacagaaaacagcatatgcgaagtccagagctgcacctggttcagaatttggccgcctgggccagtggtt

SEQ ID NO: 255652 - DNA, 310 bp, Homo sapiens
cccactcctaagtagctagaactacaggtgcatgccaccacgctcagctaattttttatttttgtagagatggggtcgttgtgttgcccaagctggtcttgaactcccagactcaagcagtcttcctgcctcggcctcatgcccgcgccaaccagttctttatttttaatattatgttgtatttgatgtgctatcctattcatttagtataagcacatttttctttatgtcttcagcataattatatgctttttcagaattttaacatcaggactgcttccagggtagctttattgccctttgtcttaag

SEQ ID NO: 255653 - DNA, 407 bp, Homo sapiens
gctccatagcttgtcatattttagattatttcattagggtcaattctcagaagtgggagtacaaggtgaaaggcttgtttgaatattaatagagcaatggtacctaaaaaaattagtatcacaagtgtatgactcctgcctgacagagagtgctctgaggatagggccacaccacacatccaccgcagtctccttttcaagctctagcacacctgttagggagtctgttttcagtatatccacactgaatttatttccttgagcaccctgcattattactagacacaaagccatcaagagccaaagggctacgaactgcccagagtaacaatgtgaggggcatggcggcaaggcaaacactaacattaaagtgagaatgttggcaaataaattttatctgtctgcca

SEQ ID NO: 255654 - DNA, 341 bp, Homo sapiens
gaagttacagacaactcaaaagaggctgccccatcacatgtggattattgtaaagcaagtaatttaatatgcctttaggcaaattggttttgaggaaccaagacagctccctgtgcccaggaggtccagacctcagaacccttcctctgaccttcctaaatatgaatcactctctgcttttcctttctgagactctgttttgctgtctgtaggatgggaaaaacaacactacccatgtcttagggtggttgagaggactgagtcagatagtaagggcaagtgcttagcccagtactcagcacatagtaggtgctcaataaacagctgccatctccttaaca

SEQ ID NO: 255655 - DNA, 274 bp, Homo sapiens
cttctcatctccactcctctctatgcacctgctgttcttttcctgttttcagatttcccctacttctttggtcccctggcaaaagcacagcctcctcatagctcctgagcttttctgacacaggttcaaccatagaaggcagtgggaatatcttttgtctccatttccatcttgctgctgtgtgatgctgactgtttagtggagtgataccaaacaaccatggacagggtttcagggtcacagttaataaaatgccttctaggcaccaccatca

SEQ ID NO: 255656 - DNA, 561 bp, Homo sapiens
tcatttctgtggcatctgttgtactgtcacctattttatttatgattttagtatttgagatttctctttttttcttaatatagctgtgagttttaaaatttttattgatctttaaaaaaacaaactcattgttttttttccttttttttctggtcttattctgcttatctctgctctaatctgttattttcttccttttgcttggtttgtcattagttttttttttccccccttcaggtgtaatgttaggttattgatttgagatctttcttctttttaatttaagaacctgcagctataagcttccctttagcaagggtttgagatatttcttctttttaatttaagcatctgcagctgtaagcttccctttagcatgggtttgagatctttcttctttttaatttaagcatctgcagctgtaagcttccctttagcactgcctttgttgcctcctcctgagtttgggtatgtcatggtttcgttttcatttgcttaaacattttttgtcctattgtaatataattttgttgtttttaataaaggtaattaatgaaacac

SEQ ID NO: 255657 - DNA, 448 bp, Homo sapiens
ggggaggcttctaaaatgaccgctctgggagtgtctgtcttatgcagttgtagataagggatgaaatacaccctggtctcctgcagcgctcccaggcttgctaggattaggaaattccagcctggagaattctagtcagactggtcctctgctcttgaaccctgtttcctgttaagatgtttatcaatgacaatgcatgcacagcgggacatggaacttcattagtgattctaattttgccctggccttgtgatcttgctctactcccatttgccttgtgatattttattgccttggaagcatgtgatctctgtgacccacactattcctacactccttcccctttgaaaatcgctaataaaaacttgctggttttgcagctcaggtgggcatcacggaacctgccgacatgtgatgtcacccccagagtcccagctgtaaaatttct

SEQ ID NO: 255658 - DNA, 408 bp, Homo sapiens
ggtttttagttacatgaccatgagtaagtcccttaacttctctgagcatcagcttccatatctatgaaatctaaacaacgtgagcagcaattttattttgaataatgaactaagaaaaccgggaggctgggcatggtggctcacgcctgtaatcccagccctttgggaggccaaggcgggtgaatcacctgatgtcgagaccagcctggccaacatggggaaaccatgtctctactaaaaatacaaaaaaatagccaggtgtggtggtgggcacctgtaatcccagctactcgagaggctgaggcaggagaattgcttgaaccccagaggtggaggttgcaatgagccgaggttgcaccatcacattgcagcctgggcaacaacagcaaaacaccatctcggaaaaaa

SEQ ID NO: 255659 - DNA, 575 bp, Homo sapiens
ttttaggctttgtgggccatgtgccctctgctgcagctactcagctctgcctttgtagggggaaagcagccactgacaatatgtaaacaaatgagggtggctgtgtttcaacagaattttatttatggaaactgaaatttatatttcatataattttcatgtcatcaaatattctcttattttttttttcagccattaaaaaaatgtaaaaaccattcttagctcatgggtcatacaaaaacaggtggcaggctacatttgacccatggccatagtttgccagtgtctgatatagcccagtggtttccaaatctggctatctttcacagtgacctggagacctttaaaaatgttgattcgaagtgcccctctctcgtccttgaggattctgattctgtaggagtgaggaatctgtattttttataaaagctgttcaggtgatagacatacactcagggttgtggaattagcagtactgatctcactcatttaactgttgaagaaacagccctagaagatttatgtgacttcctgataattaacagcaaataaatggcatgaccaaaattcgaacc

SEQ ID NO: 255660 - DNA, 509 bp, Homo sapiens
catgccatgctggtggtccagcagctcatcctcttcctgctctcactgatgtggaagctgagccccggcacagagccagctccctgggtgcaaaccctgcctcagccacttctggaattctgagccctgggcacagcactggacctctctgagcaagttcacttcttcatccataaaacagggttagagtggcctccacctcatggaaatgtggcttggattaagtacggtaatgcacttacagaaggtgcagcaggcgtagtgcattacagcaacactgaaaaacgcatcgtccgacatcaacacgtacttgagctctcaagaagagggatgaagcaggtcgtagagctcgtggcctcactgcctaatgccacctgaaatctgctccaagttcctgtccccaaggctgagttctcaccccagccacagggctgccccattgaaatcagatgtgagccacagacataatttaaaattttagcaactgcatgcttttaaaaattgaaaaa

SEQ ID NO: 255661 - DNA, 625 bp, Homo sapiens
gcagggccagccatgcctcccacatctgcccggggtttgttactaagctttggcagctcctctcccagaataggcaggccccaaaactcaatccagcaagggtgtggctttgtccccgcactcagctcttcctaccctccctactcttggttagcggaatctgcccttgtggcctaatttgcaatttctcgtgtgtccaggttctccccgccacataccccctctcccctcttaggagggtcccttcccacagtgccctgatccctgagtctgagaaagggaatgggtggtgaaggggagaggctggagggctgcagggagaagcaccttgtaagtccaggatcatagctctgtctcgtttcttctcttgcaagagaggagagttcagccttgagtttcctgtgactgatggggcagtcaggggaactggcaaagtgaccgtctgagaagagacaggcagactgaacatggaaaggagggtggagggggctgccggccgagtgtaaagtctggagctagagtccaggctggcgcagctctggccccaagaatcagaatctagtggccttggtttgggtgaacgtccaatgcaagagagggctgacgtctggccattggtgggccc

SEQ ID NO: 255662 - DNA, 318 bp, Homo sapiens
  misc_feature (165)..(165): n is a, c, g, or t
  misc_feature (167)..(167): n is a, c, g, or t
  misc_feature (312)..(313): n is a, c, g, or t
  misc_feature (316)..(316): n is a, c, g, or t
ccaactgtatatttaaagagactcatcagttagagagagactcaactgcatcctagggagctgacctaagaatcactgtagccatatgcagcacaggaacctgaaactctaggctcagctgcagccttttcagtgatgaagtcaatgcttaagtctagactagtnangaataaggtagctgtaagtaagaatagttcatcacccactgctgggtttgcatcctcctccaaataggccctccttatttgcttcctgtggctgctgtagcaaattatcacaaactgggaggcttaaaacaacagaaatttattnntcnca

SEQ ID NO: 255663 - DNA, 640 bp, Homo sapiens
  misc_feature (403)..(403): n is a, c, g, or t
  misc_feature (443)..(443): n is a, c, g, or t
  misc_feature (460)..(460): n is a, c, g, or t
  misc_feature (465)..(465): n is a, c, g, or t
  misc_feature (492)..(492): n is a, c, g, or t
  misc_feature (496)..(496): n is a, c, g, or t
  misc_feature (542)..(543): n is a, c, g, or t
  misc_feature (559)..(559): n is a, c, g, or t
  misc_feature (570)..(570): n is a, c, g, or t
  misc_feature (585)..(585): n is a, c, g, or t
  misc_feature (603)..(603): n is a, c, g, or t
  misc_feature (625)..(625): n is a, c, g, or t
  misc_feature (636)..(636): n is a, c, g, or t
tccatgatctgtatagactcatggaaaatagaaaagtccacctatatcagtatttgtttagttttcaatgtttcaaaataaaatttagatttgctaaatgtgtgacatagtataaaagtatggactttttatactttttatgacttattataaaagtaatccatggtggggtacagtggctcacacctgtaatcccagcactttgggaggccaaggtgggcagatcgcctcaggccaggagtttgaaaccagcctggccaacatggcgaaaccccatctccactaaaaatacaaaaattagctgggcgtgttagcaggtgcctgtaatcccagctacttgggaggctgaagcaggagaatcgcttgaactcagaaggtggaagtccagcctcagcaacaagantgaaactttgtctcaaaaaacaacaacaacaacaacaacnacaacaaaacttcctangccanatgtggtggctcatatgtataatcttncacnttgggaagccaaggcaggaagatgcttgaagcgaagaatcaagacnncccagcacataggganaccccactctncaaaattaaaaattncctaacatggtggccccnctgtatcccaatacccgtagcnaaggtgaagangtga

SEQ ID NO: 255664 - DNA, 143 bp, Homo sapiens
ttgcccttccctcagtgaccaagttgctgcacatttgatagcacaggcaaccacagcaaacgactgatacggacttacccagttaattacctaaagattatattactggaaaaagctaaatcatcaactcaaccatgtgtaaa

SEQ ID NO: 255665 - DNA, 461 bp, Homo sapiens
gggatccctggcaacaagaacctgagggatgcccctctgatgctgcctgaggcgctccccatctggtcccagtgtgggatggtgagtgagactgggggccatgggtgccgatgatgtcgctgggaaactcccaatttgtgtgtcgatttaagcttaacaagggtggttctcagctggtgaatcccatttggttgagaagcctcagactaaagaggttcataggcagggcttactggatttgacacagttccgcagcccaacacaaggtctgtgtaggaggaactctcctgaaccccactccacaaccagggaggagcccgctgggtggcgtgcacctgtaaccccagcaactccctaggccggggcaagaggatctcttgagcccaggagttccaaaccagcctgggaaacacactgaggactcatctctacaaaaaaattaataaaattagccaggcatg

SEQ ID NO: 255666 - DNA, 334 bp, Homo sapiens
gcttaattttcaagattggggttttgatttttatggagctcaattttggagggccttaggtttggggacacatggtgttgaagtaaacaggtgagaagaagaaaagtgagatttctagaactatattagctgctcagtgagttgggcaattggatatttttggttttatgatttcagattttatagaccagtggaatacaggccttgtgcatatgaagatcaggtgacaagtttgctgcctaccagcctccacagcaatatgccctttcacggtgaggtcctaattttaacaagctaaagaaagtatcaggttaaaaattgtcaaattttatcc

SEQ ID NO: 255667 - DNA, 675 bp, Homo sapiens
cctcagtcctgtactagtgccacgtatttttattcaggagaatgaagtcaaacattagcatcaaagccagtcttggaataaagaatataaggtacataaccgttgagaaatatgtacaagtgccttagaaatgatggattggatgtgtgtttactggttttgagcagtaagttgattgtgtatgtgacatatgtcaggtcttaggtcatatttagctttggctggaggaacttccctcagtcattgccattttctcttctcaggtgtccagagcttataaagtggtatatttgtcagagaattgacaagcattctgcttagtgtttctagtaaagaaacactttttgacagtttaatctgcctccattcttaattcttttgtgtttctagaatgcttacttcttttgttttctattctctgtgtctattttgatttctaaaataaattatatgatcagataggtaaataattgttttagtaataattcatacattagaacatcttcaactattaatgtgctattctagatattgttaaattatgtgaagggaaaatggtatagggaaagaagtttttctgggatggaatgaaaataggtgcccacaaaaatattaagagataatggcaaagtgctaatgtttaatgagagtcctaatatttctcatctttgctga

SEQ ID NO: 255668 - DNA, 677 bp, Homo sapiens
gttgactctgccatgtgacatgttgataccagaaacatggtgctatcagcaacttcttaattgttctccatcagcatctctgtggtttctgacaatgcctatagacatggaactcttgaagctctgttccaaataaaggtaggcccctcaggtggagctgcagagttttcatccttatggcatgcctttcttcctggcagaacttctgtgccagtgcacaagagcagggacagcagcccacttctcccaagatgatatgcctgctctctgagtgggcactgagaagagtcgagtctctggtcatcttggcttgccttttctggcacaaacgactgctgtacaagcaagctaaaagacagaggtgataagagggcgctagtattctcagcctgttcctgctcactctacaagtagatgctaggtagggaaagatagcctcatcctctcctcagagtctactaggaacaaagcttctgcaatacttaagtcctaacgctcccagggtgaaacctgaaccacagcccttcacctaaagtgagggaagatggagtcctgccttttttcccacacctgcttggagtacagcatccagaggagggcttctatattacaggactggagagaaataggagagaggtagcagtagcggcgtgaaaccccagacttgctgttcttac

SEQ ID NO: 255669 - DNA, 430 bp, Homo sapiens
gagccatgggggctcagaataaaggcatttcctgtgtgcacgtgacaatgggtccggacttccggcgccctctggtggcggccattttgattggtgttgggtttatttgtcggagaggctcctgagcgctaggtcggcactgcggtgactgaacccagaaggcggagaacagttgtcctctgctgcacagaggcgactctggagctctgtgacggcgccaagcgtgacccacccctgggccaggatagggaccgtcatgcccatatctcctggctggtcaccctctcctcccaaccctgctttaaaccacgtggttcgatggcggtggtggccacgctgaggctctctgctcaggtaattgtggtgccttccatgccctcaggtcacctcatcatcacccaaaagcctgtagtcttgcaaggaagagtct

SEQ ID NO: 255670 - DNA, 417 bp, Homo sapiens
ctcctagagttgagtcctaatgggggcggcatccttgtacggaaacacgaaaggttaatagcaataacaatagaaacctcgtgtttgtgtatggagagccttacgcttcccaaatactttcccacagatgacctcatttaatctttgttttgtcacagagatattttattcccatctaaaaaagtaggacacccgggatcacagtcaaaaaggtattaaactctgtgttggaatgatggtttaagctacttcttgtgacttctattccaattttccccatgtcatcacggctgattagagaataattatgataatacaactgagaataatataagatgtagagacttaagtcccatgtgccaggcactaatcacccagtttgcaggtgaaaaaactgtgcatagagtggttgggtaa

SEQ ID NO: 255671 - DNA, 275 bp, Homo sapiens
taggaactcaagatgaactcttgaagaaggaaggtgtgcttgcatcaccagttattttggaacttccaccagactcaaaattcctcaaatctgcttccttcacactatactccaaaaggagtcaaagctatgtggcatactgtaagaacagaaccaacagcctacaaaatacttccattctaatcctactattacttccggggacactgatttataaaataagaattataaaataagaatttttaaaaataggaataaatatagccatcttcgtc

SEQ ID NO: 255672 - DNA, 307 bp, Homo sapiens
gcaaacatttccagatgtatagttggtggggtagtttttagaaacaagtagttaaatccttgaatactgaaaaggatggtagaggccactggagaatacataatagacagtcagcttctgaggtagtgaaaatgatttcccaaacaatgagaacagtgtttgaacttttaaattttgccactggtgcctttacttcttataattgttgttaaaacctgccaactctatgtatgtttagttgaagtcaaggtttactggctcataggccattattgtctttattacaggtccaggtctacaggtattt

SEQ ID NO: 255673 - DNA, 424 bp, Homo sapiens
ctaacccaatcttagaggatcaaggaacacttcctgaaggaagaaaatctaagctaagacttgaactatgagtaagagaaagccaggtaaataggtgggaggaggagtagcccaagtaaaggccataccatcccgaaggtgtgagaatataacccattctgaaaattgcaggtagtttaatttgacttgaatggagaattgacaggtggtaagagaagaaccagagaggaaaataggatccaagtcatgaagacctgtatgtcatgttaatttgtttgtatagtttcttaagtgcagtgggatgcagttgaaggattttggacaaggagtgacatagtttgatttgcagtttagaagttagctgcaaatggagaatcatgtaaggaaggcaagagtatagtcctattaaagactgctgtaatcc

SEQ ID NO: 255674 - DNA, 379 bp, Homo sapiens
ctcccaagaggctggtgcatctgtttaaaggagcaggcactaggcagagcagcccccaccccaccctccatggcagagtgcagtgggggaagggatgggatttcaccatgttgtccaagctggttttgaactcctggggtcaagaaatccacctgcttcggcctcccacagtgctgggattacagattgtgcttttggtgttacatctaagaaatctttgcttttgattattttaaaaattgattttctcatcaagtaaaagaaaatgtactttcaagttcctttaagtatatccacgttgcctaggcaaccaagttatttatcaataggtgatcatttgtaatgatttgttaataaaggaattagaaaatcttgcctt

SEQ ID NO: 255675 - DNA, 368 bp, Homo sapiens
aacccaggaggcgtagtttgcagtgagccgagatcgcgccactgcactccagcctgggtgacagagcgagactccatctcagagaaaaaaaaaaaaaaaaagaagtaacctgatgtgggtaagggaaccacaagaggcttcacgtggggttttgttacatataaaaattgtaagttctgcgattatgttttaggctttagtaagtatctgtattttcaaaacaaataagttaaaaatccaccacatgattcatttaaacaatatttgcaggaattgagaaatccatatacaagtgcatgtattaacatgctaacactggttatcactgtgtgttctgattatggggcattgcaaaatgtataagttat

SEQ ID NO: 255676 - DNA, 374 bp, Homo sapiens
  misc_feature (223)..(223): n is a, c, g, or t
  misc_feature (274)..(274): n is a, c, g, or t
  misc_feature (313)..(313): n is a, c, g, or t
  misc_feature (323)..(323): n is a, c, g, or t
aggatggtctcgatctcctgacctcatgatctgcccgcctcggcctcccaaagtgctgggactacaggcatgagccaccgcgtctggcccaatatcttgagttttaataattaagcattctggatttttaaaagaagattatgattgtaggaaaatatctctgtcagttacccaggcctacgggaaacctggctggttgggacatgcggcatttaagcaaagnaccacactcggtttatatctgtgcatcctaaaaccggtaagatcgttaganaaaaaaatgaacagcacttaagaactgagctcaaaatgncctataaggntatttccctatagtggtcgattatatagtggggggtgaggtgggatatggg

SEQ ID NO: 255677 - DNA, 284 bp, Homo sapiens
acttggaattttttctgtatccacaaacacacatttggcaaaccactgaacactggttaggtgcctggagttttgctagacactgaagataaatacacagatgaggcaaaactggcttttttttttttttttttgctaggagagttcagatattgtgttgacagctgagcaggtcatatttgtaggaatccaaatttttattaaatggtataaacctctgcttatttgttctaaatttctccatgatgcacatggaatccagtgctgtccatggtccctggggt

SEQ ID NO: 255678 - DNA, 496 bp, Homo sapiens
aaaatttcaaatacctacatcacctgatcttaagaaatgacaacttccaatgcatggtcagaataaaagcggccaggaaagggtccctgcaggatgggcagccaccaaatcactcttcagatgcacatcagcaaccacactcaagtccacctctttccctaaaatcctgcatcaggctcctcccccaaatctcaaccccaatccagtgtcttctgaagttttcccagtgccaggctagcccggcacggcaccttctgtggttgtgggttgaagctgacagaccacaatgagtagggtggatgcctgagcctccaaagggaggaaaggtattcagaagagagaaaagcgagaaacaagagatttagctacttcagtatatcctaaaatggtggcccacatggctctgatccactgcaatatatttctagacttaagtgacctttatggaagaactctgagcaacattcagtcattaacaaatgaaaggcagccaaaa

SEQ ID NO: 255679 - DNA, 688 bp, Homo sapiens
aagcacacaagtcagtcttctgacattcctgaacaaatagatttcctttaactcatttatctccatggagtcaggttgactgttgggcagagaagttggagagttggaggggaagagtgacagaaacattttaattacaaagttaggttcgttatagaaatgcaagcctgtctcaacagttggtaatcagtatgatagatctctcagtatgagagatttgaagtaaataggccatatcatcagtagaaacagaaaaaaagctaattctacccaactgtatgtttgtacccattaaccattccctgtctacctccccctgccactacccttctcagcccctggtaaccattattctactctctatctccacgatttcaatttttttagcttccacatatgagtgagaatatgtgatatttggctctctgcacctggataattaaaaattttaaaaattaagaaaataatgccaactcttaaacacgtcgaagtgcatttaccataaaccaatagtaaacatcataataaatagagaaatataaatggcattttcattaaaatcagaaacaagacagggatttccccattgttactactattcaacactgttttagaagtactcgttagtgttgtgtgccatggaaaagaaattagttttataaataggaaaatgacaaaattattatta

SEQ ID NO: 255680 - DNA, 382 bp, Homo sapiens
ctccggttgccacaccactgaaagactgccccacagtgcgagggacgtccacatctgcctggctctccgagggatgaacagccttcagttcagcttcctgtcacaccccaaaatccaccagggctctgcagtcatagagccctggaacccagaggtggaaacttaaaggaatgagtgctctctcgctccaaaaccacagatatctggtccatagagaacccaccacacttgtatacattttcatacgtctgcgcacatacacaaatgcacaaacacatgttcagctgttgataatcatctgatcttttgctctttcgatgtaaatatggccagatatctctggctttaattctcattaaaattttgaaagttatactttcta

SEQ ID NO: 255681 - DNA, 430 bp, Homo sapiens
aatacagggtttctatacagagataaatatttaacatgtaggtctgaattaaataaaaatggctaaaatatataattcaaaattttaattttcatgtttatataggaagagtagaaaccatgaatgaatatattctcaaaagagttttggccaggcgcggtggctcacgcctgtaatcccataactttgagaggccgaggcgggcggatcacgaggtcaggagatcgagaccatcctggctaacacggtgaaaccccgtctctactaaaaatacaaaaaattagctgggtgtggtggcgggcgcctgtagtcccagctactcgggaggctgaggcaggagaatgatgtgaacccgggaggcagagcttgcagtgagctgagatcgagccactgcactccagcctgggtgacagagtgagactccgtctaa

SEQ ID NO: 255682 - DNA, 789 bp, Homo sapiens
aaataactgaaatccatgtgcataatgtcattctgctgagcaaggaaaataaaacaattatttcataatatgattataagatagagggtaatgatcagtttgtttataaagtcagctaatcagtctgggtgtggtggctcatgcctgtaatcccaacactttgggaggccaaggtgtgtggatcacctgaggtcaggagttcgagaccagcctggccaacatggtgaaaccctgtctttactaaaaataaaaaaaatgcctgtaatcccagctactcaggaggctgaggcagaagaatcgcttgaacccaggaggcagaggttgcagtgagctgagaatacgccattgcactccagcctgggcagcaagagcaaaacagtctcaaaaaaagtgtttctaatttaagtaagtattctctcagcacccccacagctccatattctgctaagcgtttttagtaatatgaaacaaattgttattcttgattcttgtgccagaattttttcttcaatgaaattatttgtagaacatcatcaactgctttacttggtgctatagtctgtttaagaaagatggctgggcacgatgtctcacacctgtaatcccaactctgggaagccaaggtgggctgatcacttaagcccaggagttcgagaccagtctgggcaacatggtgagacctcatctctacaaaaaatacaaaaaattagctgagcatggtggcgtacccctgtagtcctagctgcttgggaggctaaggtgggtggatcacttgagctcaggagttgg

SEQ ID NO: 255683 - DNA, 490 bp, Homo sapiens
cacaggtatgttactaggtgaaggaagcaagaaatgggccagtagctcagaacacccagatataacatatgaaagtcagagagaaggcggctgaggatgggatcccaaggaacaccagcatgcaagatatagcagaggaagaggcaccaataaaagggactgggaagaagcctagagaggcagcagaaaaactggcccaatcctttagaagccaggaagtttgtaagcacgcatgctccatagaattgaatgagaattgttagcactggaagagggaaagaaaaacaaactggatagaaggttactaagaccttcacaaaaagccagatgggttaaggggtgtcctacttctcagaggcagcactggcccaccaccccttccgggaatgctttctctccttatttcagggcagcactttcttctcggccatccctcagctcaatgattgctcttccttttcctcttcccttgctcttcttcctcatctca

SEQ ID NO: 255684 - DNA, 2099 bp, Homo sapiens
  misc_feature (1329)..(1329): n is a, c, g, or t
  misc_feature (1347)..(1347): n is a, c, g, or t
  misc_feature (1422)..(1422): n is a, c, g, or t
  misc_feature (1956)..(1956): n is a, c, g, or t
  misc_feature (1958)..(1958): n is a, c, g, or t
tgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggntacgccagcgtgcagaanccggcctccaacctgagtgcttgccagtatgcagtggaccggcccgtgtgagccgcacccacagcgccgggatcntaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgttttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttntntggtggatgcaatgatgtttctgaaactgctatgtacaacctaccctgtgtataacatttcgtacaatattattgttttacttttcagcaaatatgaaacaaatgtgttttattttcatgggagtaaaatatactgcatac

SEQ ID NO: 255685 - DNA, 2237 bp, Homo sapiens
  misc_feature (1467)..(1467): n is a, c, g, or t
  misc_feature (1485)..(1485): n is a, c, g, or t
  misc_feature (1560)..(1560): n is a, c, g, or t
  misc_feature (2094)..(2094): n is a, c, g, or t
  misc_feature (2096)..(2096): n is a, c, g, or t
tgggagtccgtgctcctgctcctcggttggctcctaagtgccccgccaggtcccctctcctttcgctctcccggctccggctcccgactcttcggcccgctggcatctgcttccctcccctgcctcgtttctcgtcgcccctgctcgctccccccggcgctcgcccgggcgctgtgctcgctcctggatcgccagccgcgcagccgggctcggccggccgcccgcgcgccactgtgcagtggagtttggtggaatctctgctgacgtcacgtcactccccacacggagtaggagcagagggaagagagagggatgagagggagggagaggagagagagtgcgagaccgagcgagaaagctggagaggagcagaaagaaactgccagtggcggctagatttcggaggccccagtgcacccgtggactccttcggaacttggcaccctcaggagccctgcagtcctctcaggcccggctttcgggcgcttgccgtgcagccggaggctcggctcgctggaaatcgccccgggaagcagtgggacgcggagacagcagctctctcccggtagccgataacggggaatggagaccaactgccgcaaactggtgtcggcgtgtgtgcaattaggcgtgcagccggcggccgttgaatgtctcttctccaaagactccgaaatcaaaaaggtcgagttcacggactctcctgagagccgaaaagaggcagccagcagcaagttcttcccgcggcagcatcctggcgccaatgagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggntacgccagcgtgcagaanccggcctccaacctgagtgcttgccagtatgcagtggaccggcccgtgtgagccgcacccacagcgccgggatcntaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgttttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttntntggtggatgcaatgatgtttctgaaactgctatgtacaacctaccctgtgtataacatttcgtacaatattattgttttacttttcagcaaatatgaaacaaatgtgttttattttcatgggagtaaaatatactgcatac

SEQ ID NO: 255686 - DNA, 364 bp, Homo sapiens
tataattattataaatttggtcaggagtccctatcagtctttgaacagctgctttttttttttgtttgaggtaaagtcttgctctgtcacccaggctggagtgcagtggcatagtcttggcccactgcaaccttggcctcctgggttcaggctattctcctgcctcagcctcccaagtagctgggattatgggcgcctgccaccatgcccagctaatttttgtatttttagaagagatggggtttcggcatgttggctaggctggtctcgaactcctgacctcaagtgatctgcccgcctcagcctcccaaaatgctaggattataggcgtgagccaccgcacctggccatgtttgaggaaaca

SEQ ID NO: 255687 - DNA, 603 bp, Homo sapiens
tcctcacctcgttagctgcaggtggtgccagcaatccttggcattctcagcttgtacacacatcaccactcaagccttttggccatcttctcctgcatgtcttcacatcctctttcctctatgcttgtctggctcagcatccaaatttccctttttcataggacacatatggattatggcccaccctaatgatctcattttaacttgattacctctgtaaaaacctaatttccaaatgagattatttgttaggtactgggggttaggacttcaccgtatcttttggggaggacacagttcaagtcataatgacattagtataatttttgatgactagaggacattttggtcacctaactttatagctatatattctttaactctatgtgtatttgtgtgtgttttagtttatataggctgttttcccaaataccctaggctgggtaacttgtaaacaacagaaattggccaggcatgttggttcacacctgtaatcccagtgattcacacctgtaaccccagtgatttgggtggccaaggtaggcaggtggcttgagcccaggagttcaagaccagtctgggcaacatggaaaaaccctgtct

SEQ ID NO: 255688 - DNA, 389 bp, Homo sapiens
  misc_feature (389)..(389): n is a, c, g, or t
gtccacctggatctgccagtgctccctgggtgcccccacggggcaggcgctgggtgaggttcttggtcacaaatcaacctcgtctaatgcttgcctcaaccccctgccctggagaccacatccctcatgttccatgtcaggactgtggcccctcggggaggttaagcagcttgctagaggtcagcgacttcccgagggcctccagctccaggagcactggcagatccaggtggacagaggctgtgaaaagaaaacttgtctctcctcccctgatcaccagcctgggccagggatacagctggtgctacttggcaccttttagctgaggaaactaaggctttattcacccaatcaatctcactgagaattcagtggactagtagtagtan

SEQ ID NO: 255689 - DNA, 219 bp, Homo sapiens
agaatagcagcaatattaaaggcagaaaaggatcttagtttgttttggcacgtgttctatttttattagcttatgagttgctctaggacgtaatgcagtaactaagcttgatttagtttggtcactttggagtgaaaaagcagttacttttctgcttggtcattaagggaaaatacgaatctcttttgatgttgtccctgaaatttaagttatatcacc

SEQ ID NO: 255690 - DNA, 297 bp, Homo sapiens
atttggggtggtggtggttaaaaagcaaagcaaaataaagaaacacaaaaccaggtaatgagtgagcaggctctccccaaagctagtctttaggctggttccatcctgaaatatgccagtgcctcactagtagatcccaatgggcaaaacagcaggaggtcaaatgggataaaaatgtgaatgtaatgattcctcacatttacatagcacttcacagtttataaaacacttatacagatgattccatttgaacttcataaaatccttacataggaggcaaagtagaaaaggcttcct

SEQ ID NO: 255691 - DNA, 386 bp, Homo sapiens
caaggccagcagtcatgtagagtgtgccctcccccttgtttgaagaatccagcggagtgagagctgaagggtacctatgaaactcatctcacccggcgcctcattttataaaatagacactcaagaatgagagaaaggaggtgatctgtctgaattcacccagaagttaaacagcaaagctgggctaggatttggagtattcacttgctccttctttgtggcttcttttctccaaactgccttttcacaatgtgcccatatgcctctgtgttgagggtggggcaggagcagagacagagacagagacagagagggagctcagaagtgcttcctactccccactgtgcccctctcaaggactctctttgctgatgaagcgtcgacgc

SEQ ID NO: 255692 - DNA, 1519 bp, Homo sapiens
  misc_feature (973)..(973): n is a, c, g, or t
cacacacagccctgctcggtttgattttctccacgtggttgatattgtcttcagttgctaaggttgcttttgctaaatttcatttatcatccccttggtacgttcagttgctggctaagttgattttgcaaatttcatttatcaaacctcggcctacgattacctaagtacgtttctgcaggttaactgtatctacgctcagtcatatccttcaaagttactaatgcaactgccaaagagggacagtgtcaatatcattgtcttcattagaaggacggctgccccacactgtgagaacactgctgttcctaacagtagtttacttttagagggatgtgagaattagtttgaccttaattccagatgtgcattagccctcaaaagaaaaatcccattctccttccttttggggagcacttttggtggcaccaaggctggtgtggggtagtggagagagcactgagcttagagtcacaaccagatgaactgctctggtcttactcagctgtgtgacttgggctgctctggtcttactctagctgtgtgacttgggcaagcagcttgcagtctctgagcctctgagactccctgatggacgaggagaacaatgaccccctccccaggctgtgctgagagagggaattgatcttggatatgaaaatgctgccctggcacagaggtaggagctgagcaacactgctggatgaataaacacatgtaatgcagggtgaacagaacatttcatctcgaacagctgaaggcacacgttacctatgcccatggaaagaactgcgtggaaaattcatttgttgcatttttgccaggttgatgtttgcaaagcagggcactctccccacatttccccaaaaccaatcagagggagactccacattgtttccatctcctcccctcaaacaattatcaaaccatgtagaacaaacggctgtctgccaactggtagaggcaaagcagncaataatctggaattccgatcaacaaaatggtatttgttctcatactatgataaagacatacttgagaccgcattatttatggggaaaagaagtttaattgactcacagttccacaggctgtacaggaggtcatggctagggaggcctcaggaaacttagaatcatggtggaaggtgaagaggaagcatgcaccatcttcacatggcagagcaggagagagagagcaaagttggaagtgctacacacttttaaacaaccagatctcttgagaactcactcactatcacaagatagcaagggagaaatccacccccatggtccaatcatcttccaccaagcccctcttccaaccttgggtattacaattgaatcatgagatttgggtggggaaagaaaagcaaaccatatcagagattgaatcaataatccaaagcctttcagcaaagaaaagcctgcaaccagatgttttactagtgaattccacaaacatttaaaaaatataaatgccaatacttttcaagctcctcaaaaaaattgaaaagggc

SEQ ID NO: 255693 - DNA, 964 bp, Homo sapiens
agagtaactttccaacataggacttgaatgagcggctggtgattatcaaaatctgtctatgttgtaaatctaggacatcacttatgtacataggaatagtaataaatattaataatgtgctatgataaacatcctgcactcttccaaatcttacaataaaactgcttcaatttcacttgtttagcttttatacttagttttttagttcatctatgcttattttaaggaacctgaactactctaatagaatccacataatttttatattagtcaaactgcttctttctaactctggttctaatagttataaaaagataatgataaatttatgaagtagatacagtcaaacctgaatttcttaaagtatatgcttagaatcggttataatttttagatattctttcttgacagtcttttcccaaactcatgatgtcctctctaggtaatattgccacactcataaattagaaataaaggcaaaaatgtgaaaactacagtaatttaagagaatgtaggttttctatatgccatttctattggctactgaaaatagtggaaataagtacataaatagctacctgtccagaagcgtctcatgcaaaaatccatctttctgcgtctttttaagaattttactgcttcttgacttattttaagtttgtggtcttggaagctctgaaatttctttctgcaaagaaaatgccttcattgaaaaaacctcaaactctgattatacatatttactattaaatttataaatactgttaatttctttttcacttattaaaaaagtctaattgtaggccaggcacagtggctcatgcctgcaatcccagcactttgggaggccaaggcaggcagatcactcgggaggctgaggcaggagaatcacatgaacctgggaggcagaggttgcgatgagccgagatcatggcactgcactccagtctgggggacagagcga

SEQ ID NO: 255694 - DNA, 481 bp, Homo sapiens
agagattttacgtaaaattcccagcttctagtctgggtgcctcttttctctgctgtttaggccactggatttaaaacttagcagatcactctcaggtttccctagccacaaccactgctgattcctgtgtgagctttgtgacctgtttgattaaatctcctgtttggtgacacctgaaagttttttagtgggacgttcagtgttttataaggaggatatgggtgaaccatcccttgtctctacacctcatactgcccagcctaataccttttccatagcagacatttggtaactgttgcactgaaagaaaaatctagaaaagttttaagtgttaactctttcataggaaactagacaccaagtgtcacattgccattgtcttccggggtttgccttcctgcttccaagcttaagctccaaaaaaaaatgatcccttcagttgaaattatgatttcctcacccaatttttaaaataaaaggt

SEQ ID NO: 255695 - DNA, 768 bp, Homo sapiens
ccaatagaaacaaaaacaaaacttcctaaaaaggctcgagttttaattattaatatcaaattaccatcacctttcttctaaacaaagaatgcctcattaggcttcagctttgcctgtatgactcatgaattaacacacacgaaccagtctaaattactctttgagggacagaatgaaaaatgggcacaattgtatctgtttttgtggtattggattctagttctatatttgtcaccttggagaacaactcttttttttttttttttttttgagacgggatctcactctgtcgcccaggttggagtgcagtggcacaaatcttggctcactgcaacctccacctcccgggttcaagcaattcctcctgcctcagcctcccgagtagctggaattacaggcacccaccaccacgcctggctaatttttgtatttttagtagaggtggtttcactgtgtttgccgggctagtcgccaactcctgacctaaagtgatccgcctgcctcagcctcccaaagtgctaggatttacaggcatgagccaccctgcatggccaggccatacttttcaaagtatgtctgtgggcataatttcctggtttaggaattgtgtcagaatatattgtactgtatttaaagttgatatgcctaactcctcccaccctcatcaccaaacacatacttcctgtgcccttaatttatacttccccctaaaactttttttttttataagagtccccattctttcatactcttgccaagatttttgcc

SEQ ID NO: 255696 - DNA, 568 bp, Homo sapiens
gcacgagagaaatgtagttaatgaatgtgaaatcactgtcatttggtatattactatatagcaaatacttgtcatacttctttagagtggggaatacacttgttatttacatgaaatattgccccccgtcaaatggcaatcttagtatataccattactgtcagtatggatagcttagtccagcttctggttgaatttgttatgaatgaaaataatattttatcatctataatcacacttgactttctgcccatggtttttaataagggacaggtgtcgtttatagatagaatgttcttaggctcattactttaagccagttgtgcttaagaacacacagatttttgacatagcctctaagatgccatcagttgttaatgagccgttatgttttacaaagaaagagaaaagctgccaattaaagagtttccatatcacttggaattttatttataaatattgaaaatgctccttcaaacttaactatacgtacatctttaatccaaataacttttgtgattacgtacaagtaaaatataagtaaaataaagtattcttaaaatttgct

SEQ ID NO: 255697 - DNA, 552 bp, Homo sapiens
tacatagcactttagagtttaatgtactagtgatctttttagactttccgatcaactgttaatagccagtgataactttgctttttaattttccaattgcttctttcctctaaactttttatttcaacacataaagttgaaagaatagtacaacacccgtaaaccctccacctgcttcatctctttctatatgtctacatattttgttgttaaactaattgaaagtaacttttagtcattatgacattttatctctaagtactttagcacacatctccgaaaacaagacattgttttaccaatcagtggtaccattattacaaccaaaaagacaaaatagtagttatgtactatccaatattaaacgtttattcacattttgtcaattgtacccaaaatagctttttaactattttccccaaaccagaatccaaggcaaaatttaacatgttgtgttttgttaagtcctcttagtctctctaatggcttttgaagtttaatttctttagtcatcttatctgacttagaaaacttcatatgacctaaaaaaaa

SEQ ID NO: 255698 - DNA, 728 bp, Homo sapiens
gacctatgtgaaatacccaacaccctgcccaacctatgtgagtgcccagcttccctgccagaccaacctaatgtaaaatgcccaaccccctgccaaacctacgtgaagtgcccagctccctgccagatgacctacatcaaaagtccagctccctgccagacccagacgtgctatgtccagggtgcttctccttgccagagctattatgttcaagctcctgcaagtggctcaacctcccagtactgtgtcactgacccatgctctgctccctgttccaccagctactgctgtctggctccccggaccttcggggtgagtcccctgagacgctggattcagcggccccagaactgcaacacaggatcatctggctgctgtgagaattcgggaagctctggatgctgtggttctgggggctgtggctgcagctgtggatgtggcagctctgggtgctgctgtttgggaattatccccatgaggtcccgaggtcctgcatgctgtgaccatgaggatgactgctgctgctaaacatacgacagctcaactccagaatgcactgccccgctaccccttctggaacatgcaccagcttctggccccctctctgttagtgccagtgatgtagaacctcatcactttgcctctgtgctttgcttctctaccaaggcagcctgccagagttagtacagtccccaaactttggcatgaataaaactcgatgcatttcg

SEQ ID NO: 255699 - DNA, 505 bp, Homo sapiens
cattcctaagaaagtgaataccattgttctcagggtcttaattgggttttatgagtgtgaccatcctttctgggacatagtactgctttgccagctacacccttcctaatgaggggaagtgggtggcacagaggggacccaggtatcccaaccgaggcaatagctgtctgcctccatttggtctgatagaaaatcagggatataagccaggtgtggtggctcatgcctgtaatcccagctcccagcactttgggaggctgagggaggggtggatcacctgaggtcaggagttcgagaccagcctgaccaacatggtgaaaccctgtctctactagaaatacaaaaaaattagctaggcatggtggcacacacctgtaatcccagctatttgggaggctgaggcaggagaatcgcttgaacctggaggtggaggttgcagtgagccaagatcgcgccactgcagtccagcctgggcgacagacagcaagactctgtctcaaaaaaa

SEQ ID NO: 255700 - DNA, 178 bp, Homo sapiens
acacaaaccctaaccatatcaagtccctacctcaaggagttctctggctttctgctcatcttcagtccacctgtccttctagcagagcctctgctgccttccaacaggtaatcatggtcccctccgctgaacgtcaaatccctgtgagatcctaagagggcatcagtcagcttaggct

SEQ ID NO: 255701 - DNA, 1665 bp, Homo sapiens
agcgggcgtggctccctgggcctggaacgcgctctgagcgcgccggtcccttccaggttgcgcgggctccggacgagacccagcccagccgggcagccccgcgcgctcccgggtcccgccggcctcgcgccgcccggttgccgtgggaaccacggagcctcggagcgcccgcagactagcccgtgtctgagggggtgagggatactgaggcccaggcatggagctgccagatccggtgcgccagcggctgggaaacttcagccgggccgtgttcagtgattccaatcggaccagtccagagtccaatgagggtccggaaaatgaaatggtctccagtttggcactgcagatgtcactttattttaatacctactatttcccactgtggtgggtgagcagcattatgatgcttcacatgaagtattcaatcttgcctgactactacaaattcattgtgatcactgttatcatcctaataaccttaattgaagccatccggttgtatctgggctacgtgggtaacctacaggagaaggttcctgagttggctggcttttggcttttgagccttctattgcagttacctttaattcttttcttgctctttaatgaaggcctaacaaatctgcccttggaaaaagcgatacatatcatcttcactctcttccttgctttccaagttgttgcagcatttcttaccttaaggaaaatggttaatcagttggcagttcgtttccacctccaagactttgaccggctctctgcaaacagaggagacatgagaaggatgaggtcatgtatagaagagatctgatccagtgttgttgagtgaaaatctgacagatcattctagagactgtaagagttaggaaaatatcagagctctgagaaaagggacaaagcaagtgttttgaattgtatatgctctcactctgaaattccaaggttgggggcaatgatgaaactttgtacagtatatgaaacagtatattaaccctaaaacctagatgttgtccacctgatgccaaatttcttaattttttttgatgttgttgtctttttcaggagtgtagaaatctatgtattggtggttgtcatttgccagctctctcgtagcatttctggttagaatctttaactagagatgtatacatttctttaaaacttgttggttatccatgtcttgtctgtacatatgaccatgtttcttgacatggaaataccagtcagtgttcctatgtatttgtctatatttgtaaaccaagagaccggctgggtgtggtggctcacgcctgtaatcccagcactttgggaggccgaggtgggcagatcatgaggtcagaagatcgagaccatcctggctaacacggtgaaacccagcctctactaaaaatacaaaaaaaaaaaaaattagctaggcgtggttgcaggcacctgtagtcccagctacttgggaggctgaggcaggagaatggtgtgaacccaggaggcagagcttgcagtgagccgagatcaagccactgtactccatcctgggtgacagagcaagactccatctcaaaaaaataaataaataaaaaataaaacaagagaccaaattttcatgtctgctagggttaaattctaaccctaatattagctgttatactgagacaaagggaaaca

SEQ ID NO: 255702 - DNA, 381 bp, Homo sapiens
acattcaagttccctaatgctcttagaacctgaagatgaccatgtgtagttttcttaagacctctgaacccccatggtgatgaagacttgaagacatttgcagctatctgctgcagtctggtagattcatacttatctaaagaagtcaaaaaatttattcgtgcaagtgcttgcaggaagccagtgcttattagtagtgaccctgcttctatcaacgttattgagacaacacatattctattctaagggagaaagagggaggaagagagggagggagggaggaagaagagggagggagcgaggaaggaagataggagatgggtaggggggtaaagagaaaaggagggagaagggaaggaaggaaagaagagaggaaagaaa

SEQ ID NO: 255703 - DNA, 349 bp, Homo sapiens
cttattgccagcttatattatactttcgtctcttttctgtcccagtcctactattttctttttataccatgttgctttttttattttccaagccacctacctgtcatttaccctggaatatcattttaatgctggacttgggaaacaggactaacaacctccttaaaatcgatccatactattccaagcgtttattacacgtgtggttcaaaggatgtggtgtatctgaatttatgccacaacaagctgtattacaactggtttataggcttttttaccgcatcctcactccatggtttaatacatggaggtagcatagtacaatggaaaaaagtatgggttttgaagg

SEQ ID NO: 255704 - DNA, 451 bp, Homo sapiens
ccaaatcagagttgaaaacatgaagtttaagtaagtcatctcatagacagtaatctggacacttaccaaaatactacagagaagtcagaccatgttccacagggaaaacaagaatcttatatatcccagccaggcatggtggctcacacctgtaatcccagcactttgggaggccaaggcgggcagatcacttgaggccaggagttctagaccagcctggccaacacagtgaaaccccatctctaccaaaaattacagaaattatcttagtcatatggtttgaatgaacctctgtgtacagacttcacgaacaccatcaagattagccatggcaagagaaaaatggggcccccagtggtcactacacatatctgagggcagatggcagcagcacaggagggagggaagaaagagaggaaggaagacaggaaggaaaggagagagatacgga

SEQ ID NO: 255705 - DNA, 2089 bp, Homo sapiens
  misc_feature (873)..(873): n is a, c, g, or t
  misc_feature (1787)..(1787): n is a, c, g, or t
  misc_feature (1909)..(1909): n is a, c, g, or t
tgctcaagtccctgataaaaaaataaaagcagtggtgccctcgggttcaaaaacctgaacggtggtcttcagttgttcccccaagctcctctatcagaggcccagacactccaagaggctgggaagaggcaagtggctttccctgactggcatcagactcctggatggctgtgtttctgcatactccaccatcaacaatcagaagggcactgctttcttcaagaaggggaccttgcaaagaactgtctcagatgggctatctttgagttcatcttgttctgaatgtgagtctgagtctttgtttccagatgacacagtgctgtctgagtcctctgaatcacctgcctcagagctgcagcaaagtttctgctgcccagaaactgaatgggctgcttgtaatgcagattcttcctcctggacaagaagtgctgctgcttctagttcttccagttctaaccccaactgggcctttgtaagggagacttcctttaaggcttctgcaagagctgccaacgttttggatttgactttctgagtccacacacagtagtatgagatgtagagatcattcagtatgtatgctgggtcgttttcctgaaaaattttgtgaatatccaggagacactttaaaactgcacttttacttaattgcagtatctttatagtctccccgtaggccttcatcgccagtttgaaatggcgatagagcaggtaacacaatacccttcttccaaaagacaccatgatatcatgaacattagtccaagtctcaaaccagcatagtattggactcaagtttcgtgatattccatgcagattcaacgttcttgtctccttcagtgacacgggtttcttagcaatatgccagaaggntatcaatcgaactgtagtacacttgacgacaggctctgttgtctagcagataagatttattgacaaattcttgtagctgatatttctcttcttcagaaaaagacactaatgcagcatgattttcttgcttctgactcttttccaaaaaggccgtcattttttaatatttgtcagtccaccaaggattatacttcaaaatctgttcaactgcctcatcttcaaaaaagtcagctagataatgatcaggatcaaacttggccagctcggcggccaggtgcttttgttttcgttctgctgcagggatgaaatctggatccttaataacatcactcaattcatcctgtaactgctgaaacactcctgatcgtaagtttccaaacccatagtggcatgaggattcaaagcactttctgttacctcttcatagggtgtctgctcaatttcccaatcaaactcttcatcgtcaactacttcctcaggaatttcagaatcacctattgcttccacaagtggttttgctgtcccggattttcctggtgccagaagagcaacacatgttcagcccctcaaaatgctggccaggggtttctctgggcaggcgagtggtaaaaattcctttatctgcatcataggacccttgctcgcttccgtatccgtattctacaattcttccaggaggggttaatctgagaaagtacggcttggcatagtagtctaggccgacccctcgaagtagacgttgaactcggaggccggggcatagggcacgcggatggcgatggtcaggaaatccggctcctggctgaggctgaacgccggggtcagcatcgcggcaccagacgcaggggccagcgcggctcgccctcgctgccgcggcggtcccaccaagcaactctctccaattttaccttttnaaaataaaagatgtctgggccaggcgcagtggctcacgcttgtaatcccagcactttgggaagccgaggcgggtggatcctgacctgaggtcaggagttcaagatcagccccgccgacatgncgaaactccgtctctactaaaaatacaaacatcagccggacgtggtggtgggcgcctgtaatccccactactcgggaggctgaggcaggagaatcacttgaacccgggaggcagaggttgcaatgagccgagatcatgccactgtactccagcctgggtgacagagtgagactctgtctc

SEQ ID NO: 255706 - DNA, 411 bp, Homo sapiens
cgccctttcccaagagggaatggacatttgagggatcattatatcatagagaaacgattttagacataggaggactttagggaaattagtacaatttcttcatttcataaaggcataagaaacagatgttacctgaaccatacagcagcagctgtgggagaagagtgcgtgtaaccggtgttccttcctttacaccaaaagtcaacaaatcaacattgccagtatttgtaacaggttgttaaaatgaggggatttggtcaatttagtcaaacatttcctcactaaaatattgccatcaaaagtttaagggaacctaaattggctccatagtcctattaataatcaatcaataatcaaaaaccccaatttgtaataccaggctccaatgagatgacccttgccttaaaaaaa

SEQ ID NO: 255707 - DNA, 466 bp, Homo sapiens
ctttactttctcatgctattaggccaagctgtgacccttagtttcatctccagattatcagacataaaaggcccacaggaatccagaagctagacagagcataggtattccaatctctcaagaaaatgggcagtaagagatttactaatagtatgtttgctcacctggcatttagaaagtttaaaattctccctcttaattgttctattttgtttgttaatattgtgttcaggtattttctatatcatagtagaatcagcactattatcaattcttaattatctaacaatatttattttgttcattacctgaggtcgaattttaattcgggttgacttttccctgaaatttagcacaacaaacatctcagctcatttaccccctacagctcaaatagtttaagctcatggaaggcaaactaattttaaaataagcaagggacttgaaaggcaagcctttgctgcca

SEQ ID NO: 255708 - DNA, 399 bp, Homo sapiens
ttagcttgtcttttgggttattatcattttcactttcattgtcactttttgagaggtaaatatttgcagaggaaatcaagaaacatcataaacatctctggatcactttaaaaagggaatcaaaggtctgataaaatttggtttttcttactggagaaagacacctcttgcgctttaggaatcttttgatttttttccctatgcataaaggtacttaaagcaccattgaggagtgagtttacccattccctgtgctcatggtcaatgctgcatcacaactgaaacaatgctgatggaacagccctcacccagggaatggaagacaatgtggctgatggggagtgtgcccatgggtcccaagatgactgcaagagacagatgtgtgtccacagacgtttc

SEQ ID NO: 255709 - DNA, 377 bp, Homo sapiens
  misc_feature (173)..(173): n is a, c, g, or t
aatggtgtgaacccggggggaagagcttgcagtgagccgagatcatgccactgcactccagcctgggcgacagagcgaggctctgtttgttggcttaaatatgtgtttctttatgaaaccactcatgacatggcagagagaggaaacagagaaaggagaaacgctatgagacncttcggatacaggattctgcataacgttttattattatcctctctatgatcttttcgcttatcatttcagataagaccagaaattcccattcctgaagagttagatgacgatggatgttgaggatgtggatctttcagttcctggctcttgctatctcctgttgccactcactccacctttggttctaccaggtgactcctttc

SEQ ID NO: 255710 - DNA, 428 bp, Homo sapiens
aagctttgctcagtgctagtcctgacgtcaggtcctggtcgtgtcgtgctagtcagtagtcctgatcgttttccgtgtcggcaggttgcgtcgacgcgtgttctgctctcagtctgccgttctgctgctctaggtctcagctacggtcagtgtctatcatgcaggtctgctgctagtccatcctggatcagggctctttgccagcagctgactttatgtgatccggcatgtacagccagctaggacgatccagtgactggtccgtaccgagaccgaatgcagacgaccgcagaccagactaggaccaggcagcccgagacaggcctattattatattaaaattatgtgattattttacaaaattagacttacagaaaagaactatttcctacccaaaaagctgttatggttatatgcagcatgttttg

SEQ ID NO: 255711 - DNA, 412 bp, Homo sapiens
aagcttttaccgccaacccacaccaacagtccagccaaaaaaaattagttcgtgacttgcatgagcgatgctagcactagactgactgaagcggcaactgcaggtccgaagtcgtctgagtacgtccgcagacagtcttggacggctatgacggtcgcatgcagcgtgtacgtgtgtggtgtggtagagctgccgcgctttgtgtgtgttgttgtgtgtgtgtgtgttatatcgagcggtggtaaagtctgacaccataacacttcaaaatattgtatttattcattcaaaattcattgaaaaatcacatgctattatattaaaattatgtgattattttacaaaattagacttacagaaaagaactatttcctacccaaaaagctgttatggttatatgcagcatgttttg

SEQ ID NO: 255712 - DNA, 419 bp, Homo sapiens
gatgtatgtctaccacctcactgacaccccaatttctccttattatatagtagttggacatgcaggtgtttgagagaatgaattgggtagaactcctgtacaatctgtggtcaggagcagaattaatatggaaggctcagccagtcagaccttgagtttggagcagccgtgactaccagggtgatttttgccaagtcagttcacctcctccagcctcagtttccccatatttaaaatgtaggcaatattatgcttccctgtgagagttgctgacaggaccacatttatttattcaacaaatacttgcttaacacttagtatctgcctggcccctgttttatgaactgagggatccacaggaagcacagcagaaaaactaagacagaaattctcacagagcttccagtctactggggagt

SEQ ID NO: 255713 - DNA, 461 bp, Homo sapiens
caaatccagcaatataagaaaagaaatatacaccgtgatcaagtggaatcccaggaatgtaagggtggttcaatatccaacacatacttaatgtaatcatattaatcgaaattttaattgcatgatcatctcaatagatgcaaaaaaagcatttgacaaaatccaacacttttgcataataaagacatttcaccaagtgtgaatagaagagaacttcctcaacctgaagaatgacatctacaaaaaattcactgttaatatcatccttaatgttgtgaaagaccgcatgctttccccctaagatcaggaacaaggcaaagatatctgttttgcagtttctattcaacattgtgctagaggttctagccaaagcagttaggctgaggcaggtggatcatgaggtcaggagattgagaccatcctggctaacatggtgaaaccccgtctctactaaagatacc

SEQ ID NO: 255714 - DNA, 255 bp, Homo sapiens
caggtactcagaaggagccacactcatctacacatcttgtaacaggcctaccttatgtgaacccaacggcagaaccctgccctggtatctgccccacaaaacaaagttctgaaagcaaagtctgctcaaaataagaaaggatttacaagaagactacattatgtctaattcaaatacttctattttaacatattactgaaaatcctaggtataacaatgtggcaataaaatgaaaaaagccatctgaaattaaaa

SEQ ID NO: 255715 - DNA, 347 bp, Homo sapiens
taccctgtcattgagaaacatggtgggcctgataggtcatttagctatgtcatgcaagaccccatgaaaatctcataaatgatttaatagaggtatgaggcatcctaatggtaaaagaaacatatgtttcatataaatccatgaaacgttcaattttccagttataaacatgatttactcatgttggatccctagagcttctctacgtattgcttagtcaacaattaacttttgcaaagcctcaatgaggcacgcacatctcaatagctgattgctagagcaatagtagaatgctgatttttttcattaggcctgcacagctttcaagttctaattcgcccagatgt

SEQ ID NO: 255716 - DNA, 456 bp, Homo sapiens
cacccaggctggagtggagtgcagggatgtgatctcagctcactgcaacctccactgcccaggttcaagcgattcccctgcctcagcctcctgagtagctgggattacaagcacaccccaccacacctggttgattttttttaatttttagtagagatggagtttcgccatgttgaccaggctggtctcaaactcctggcctcaagtgatccacctgctttggcctcccaaaatgctgagattacaggcagtagccaccatacccagctggtacacaatcttttcaacatgttcctgaactcagtttggtagcatttgttgaagattgttgcattagggttcataagggatattactgtgcagtttcattttcatgtagtatctttgtatggctgtgatatcaaagtaatactaacctcacagaacaaatttggaagtgttcccttcattttaatt

SEQ ID NO: 255717 - DNA, 425 bp, Homo sapiens
agggttgttgttcctagacagttaaggttaactagggataacatcaagagagctggcccaaggtcaccatttcttcccagcttttaaccaacgttttgagaatacagtattccccatcaaaatcgtggctcaccacggctgtgagtttcacccagcggcctgggtggtcatggtgaaagctagaaatacatctctggaagacattttcaggtatgctacagaggctggcatacccgggctaagagctgctggcctggctaatgaactaagatcactcgttgaaacaacaggtataaatctccaagcagaaaagactcgcttaacatggatggcaaatgttgtctaccaagaagacccaagaaaataatcaaataccctttgccaagaatgtctggttataaaataaagatataaatgacaataac

SEQ ID NO: 255718 - DNA, 418 bp, Homo sapiens
actgcagcaggacagctgtttgtgtgagtccagcttgccataacacagatgacttttcttgttttgaaactactgctcagctggcggggacactctgaacagtcgtttcagtcatttgtgactgagagttattatttcctcatgagaatgaggaacacaaattatatgtttgtgtttcaacaaacatttcctcatgatctcccaaccctttcacatccctctgccctctctaccttcacatatgtcatgtcaaagaaggtagtttggaaatagacactccagggtaaacagctggcttacttttaaacattggaaactgtggtttcacctgtcttggcaaggggcctcagtcagctttggggctatttccttgactgactcagggtgtgagttctgatacaattgaccttgatccaaa

SEQ ID NO: 255719 - DNA, 205 bp, Homo sapiens
gcgtggcaagcctttttattctcatacctgttttacaatagaggctgaagcacagagagggtaaattgctttgcccttagtcacacagctggtaagcgacaaagtcaggtttgactcacacagcctggctccagaacttccggtcttaagcacagctcttcatatgatctctgaaactccagtaactcccttctgtcgtcttctc

SEQ ID NO: 255720 - DNA, 109 bp, Homo sapiens
gggcatacttgcagaagatttttttttcagatgcaagaacattgtgggttgaataagctgactaaatccattcactatttctatagaacatttttaaagtctaacttat

SEQ ID NO: 255721 - DNA, 919 bp, Homo sapiens
tcggcctttctgtttcccagaggaactgtacaccaggagctggtgggttcaaatggcaaatttaataaaagcagacgatgacattaagcgccattagaaaaatgaaattctctaaagtgttgtatttgttactatatctgggggaaaatactcagatgtagaaaagtggaatcctgtaaaacgttaagaaatacatcccctcaaagacttctgctttaagtgacagcattttgagggtttttgtttctcatttttccccgggggtggggggtgtgatcacagctggtgtcacagtggcggtccacgtgcacacaccgggagccgcctctataccgttatctgattagtgtaacaaggcctggttcatctggtcactggctgacagttttaaagcagctagccccagagtggcaaatgccaaggtcagagcacccagctgcttcctgctccattgctgctggtgtaaatatcctcaactctgggtacacaagaggtgtgaacagaaattacttaaggctggctgtggtggctcacttctgtagtcccaagactttgggaggctgacgtggaaggaagcttgaagccaagaatttgagaccagcctgggcaacatggcaagaacctgtttctacaaaagcattttaaagaactatctggcgcagtggcacatgcctctagtcttaactactgggaaggctgagccaggaggatcacatgtgcccagaagtttgaggctacgtcgaaccatgattgcactactgcactctgacctgggtgacagagcaagggcctctttaaaaaaaaaactttctaaagctaaggaaaagattgccattgtctgtttgctcacagaaacaaatgtgacctgtgaaggttggagaaaagctggttttcacatgctttaaaatgtttgctgtac

SEQ ID NO: 255722 - DNA, 261 bp, Homo sapiens
ggctcattcctgcatcacttcatctcccactcaataaagtgaatgccatcatgattatggaataatcaggaaaccactgagatttattagcaaaaggtaaaccactgaagaacatgagcacattaaatgtcatgaggaatacatacttgccatgtccagcacacgtgagagagacacagtacgtatggttcagaacctggctccttgtacatagtgtgggccatggactggctgtatcagcatcacctgggagctggttag

SEQ ID NO: 255723 - DNA, 675 bp, Homo sapiens
ccaatttccagaagaaatggctgggatactgacaagctgaaacttactttaaacttacttctgatcttacaaaaacaaaaattggagtttatggcatgataaggaagagagtggtggctggtctgtcagcctgactaatgggctcttaaggttgcttagggatctgggttgggaactgatgttaaaattgcagaatacagactaagctgtaaatagattgtcctctttagggatttgtgctcagctttaaattatcttaacttatgattggattaagatggtgtgcaggattgctagtgcccctagtacttgcaagaatcaaacataaatccccattagagaaataaaacttcattctagcctcaaagtacctctataagctttcacatagtgtctcagtcacacaatacaatttaaccagtcaggtgaggagacaacgagtgttttggaaaaccaagagaaacaacagaaaactagaaagagatttacaggtgttacagacaatgcactatgaataagatgctcaagggaaatcaaagaaaagattgggaatgtttggcaaagaatttagagaacaacaacaaaaaaaagccagtaggaactctagaactaaaaaacattaactgaaattaaaaatcaacgtgtgaccttaacagcagtttagatacaactaaa

SEQ ID NO: 255724 - DNA, 767 bp, Homo sapiens
catttatttatccatatccacagagaacagacttccgtatctatgccagtagtaaacccaccagcaagatcaatattaaataaaagaaaggatacttatatcaatctcccaacaagacttaagaaaaacactattttccatactcaattactcttgaagcctttttaactcctactctggaactggtatcaaagtacaattctatcaatgacctaggtaggaatctattataatgaggtagcatttaacttacacaaattgaactatactttcaacaaatttcctcttcaataaaagcaggaatagagaattatactcatcattctattcaatgtacatatgcttcagaatgcatataaaatgagataaatgaatctgctcctccctcagtcagcctgagcaaagccatgcatctcttcatagtataagcatctcactggaccaagtgacactctggcgtctaaagatacagtatgtgactttttgtacatcatgggtcgagtgcaagccactggaacactacttagtcttgtgctgaagcaaaggaaaaactacctattccagtgctgaaagaaaactaggttctgctggacctactgaaaaatccaagctatgggtgataaagtggtattaagggtaatttttaactacatgatttctgccctatactgtagaccctaacccccatatatatgataaaattctacaatttatatctgtcaatcagctaacatcatttaccatatcttcaaacggtctttaacttc

SEQ ID NO: 255725 - DNA, 478 bp, Homo sapiens
cctcctgggttcaagccattcttctgcctcacagtctcctgagtagctgggattagaggtgtgtgccaccatgccaggttaattttgtatctttagtagagacggggtttcccgtgttggccaggctggtctcaaactcctgacctcaggtgatctgtgcacctccacctcccaaaatactgggattacaggcatgaaccaccacgcccagcccattctgaaggcttttaagtgctcctggtaagcacttagtgatgctattagtgtattagtgtagccaagtttgatcacttgattaagctagtgcccactatagcttaccatttttttctgttcataaaaataatacgtgttcctagtagaatgaaaagacagcgcaaagaagattatatattaccctaattccatggctaattatttttctgaacttttcagtcatgaaaattttcaagcatacaagaaaaattcaaaaatagta

SEQ ID NO: 255726 - DNA, 114 bp, Homo sapiens
tcaaccagcccctctctgttttaaaaagaaaattaagctacccactttctgtttacttacatagaattccactatttaggcttttgaaaatagcccttctgacttgtaaataac

SEQ ID NO: 255727 - DNA, 395 bp, Homo sapiens
gaatcatttgctcgttctttgattcagaggaatgttttgatgagaagggatatcccaaatctaacaaaatatcagataattctggcaagagatcagtttaggaaaaacccatctccgaatattgtgggaatacaacaaggcataatcgagggagagtttgctatttgtattagtttatatcatggttatgaattattgcagcaaatgggaatgagatcattatatttcttcctttgtggaattatggatggaactaaagggatgacacggtcaaaaaatgaacttggccgaaatgaagacttcatgaaactctataatcatctagagtgtatgtttgcacgtacacgtagtacttcagcaaatggtatttctgctatccaacaaggtctggtttt

SEQ ID NO: 255728 - DNA, 354 bp, Homo sapiens
atttccttaacttattcgttgagccattgatcgttcaggaacatgttatttaatttccatgtatttttacagtttcagaagttcctcctgttactgatttctagtcttgctctgttgcagccagaaaagatattgatatgatttgactttgtttaattaatttgttgagacttgttttctggcctaacatgtggtctattctggagaatgttttaggtactgatgagaaaaatgtgcattctgcagcagttggatgaaatgttttatggatgtctgttagggctagttggcttagagtataatttatctccaatgtttctttgttgattttccacctggatgatctgtccgttg

SEQ ID NO: 255729 - DNA, 289 bp, Homo sapiens
ttagagatgacgtctcgctatgttggaccaggctggtcttgaactcctggacttaagcaatccgctcgcctcagcctcccaaagtgctgggattacaggtatgagccactgcatccggcccctactttcataatcagaaagaaaacaaatctgatgtcttaaacacactaaatacaacgagaacaacaataaaacaagtttgttcacgccttctgtagaactgaaccttggggtgccctgatcgtggctcaactggctgaatttcaggctctaactctccagatcattc

SEQ ID NO: 255730 - DNA, 633 bp, Homo sapiens
cgaatcttgagtgtaggatcatatgttagcatctaccctagagaacaactcacaaatgcaaaaacaggcatgggccgggcgcggtggttcacgcctgaaatcccagcaacttttggaggccgaggtgggtgggtcacaaagtcaggagtttgaggccagcctggccaacaaaatacaaaaattaggcaggtgtgttgtgtgcctgtaatcccagctactcaggaggctgaagcaggagaattgctttaacctgggaggcagagggtgcagtgacccgagatcgtgccactgcattccagcctgggtgacaggacaagactccgtctcgggaaaacaaaaacaaacaaacaaaacaaaaacaggcgtgtattggcagaaatgtgaaagtaacctaaatggtcatcaagagaatggctaagtaaattgttctgtttatactgtagagtactgtgtggcagttaaaataatgtaggatatatgtactgacaaatttctgagtaaattgttgaatttaaaaaaaaaaggaggtcatagataatatgggtagtatgatactggttggattaaaaaaaccaaactaggctggccatggtggctcacgcctgtaatcctagcaagcactttgggaggccg

SEQ ID NO: 255731 - DNA, 395 bp, Homo sapiens
cagtcctctagccaaaactctgggactttatttaccctactttgccacatgcttcctgcatctatgcctgtagaagagctgaaagaagacagggagagaaagagctcagtggagtttatattgtactcttagggccacagctcctcctactggagaggaagttttccctccctcaaagttttaaattcttgcagttatcattatctctgctactaccttgaaggctaggatgcaagagaatgaaggagaaaagggcaatttttctcttctttgagacttttcctgctccttgagcctaaactataaggattctcctagagccttcactgccatgccccagggcccactttcaggttttaagctcccttgaatccaggccaggggtaccttttaaa

SEQ ID NO: 255732 - DNA, 334 bp, Homo sapiens
gatttgaaagcagcacatgagataataggttcttagagttttgtgtgtgtgcgtgtgtgtgtgtgtatgtgtacagatatatatgtatctgtatatttctggtgagcagcctgaaagctacagtcacttgccacttgagcagttctcaggcaatcacccaccccgaaggctggtgggtggatgaggttcaaagacagagctttgaagaacatcggtttctcctgctttctgtattggttcttcaacctacaataaaaatctttgttcttaaacatgtagaggcccttcggcatatccccaattctaccaagatatgaaattgtggtctatgctc

SEQ ID NO: 255733 - DNA, 708 bp, Homo sapiens
cacccctagacacatgttcactgcattatctaatccacacaggattgtaaccactcaaaggcagaagagaccttagtggcatttaatataatcgcttaattttacagaagaaacagatgctcagagaccataactggtgatcagaggtcagccatctggttagagggcctggaaagcagaccttcactcccctctccgttactccccactggtggccatgcctacttcacagcaggtggtcagaggtgcagtgggaaattacctccctggaagtgcttttaataaaaaagaaggaaattctgcaatacgcaacaacttgaatgaacctggaggacattatgctaagtgaaagaagccagacacagaggggcaagtgctgcatgattccacttctatgagatatctaaagtggccaaactcatagatgcagaaagtaggatggtggtggccaggggctgggggcagggggaaatggggcgtttgctagttgatggacatcaagttctagttaagcagataaatccattctcgagacctgctgcatgacattgtgcctatggtcaatgacaccatgtaaaacacagatttgctaagggggtaaatctcatgttaaatgttcttactacagtaagataagattttaaaaaattgtaaagggccatttggaggtaagacattgtatatttttatactgagaagtgggccatc

SEQ ID NO: 255734 - DNA, 253 bp, Homo sapiens
actataggcctggcatggtggttcattcctgtaatcccagcactttgggagaccaaggcaggaggattgcttgaacccagggcctcaagaccaacctgggccaacaaagcaagacctagcctctacaaaacatgaaaacattagcccgacatggttactactcagctactcaggaagctaaggcaaagatcccttgagccccagagttcaagtttgtagtgagctatgattgcgccactgcactctagcttgg

SEQ ID NO: 255735 - DNA, 516 bp, Homo sapiens
gtcagtgctaagtgaatatgactggagtggggaaatggtactgttgaggtcatcaggaagcagtttattggaagggatgtgtgaaggttatttggaggagacttctgttacaggaaaactagaggtgtttttatcttccaactcctgtagtgataatggctctgtttttcatgaaaataaacacgtatttctgccttatgatttagtccatttgtgttctaaaagtaaataattggcttttaattcacaatgaagaattttttaatttaacaattatggaattatcaaagagttgttattaacttgtcattcccctaggctctgtaagctttgttcctgtatgatatccacagaaatgaccttggatgatttcagtttaccaagcatttttttttcttttttcttatccttatagcttacagacagtgataatgttagtattttttatatggaacagtgacaattttgtgctgatagtgtaatcaacattaaataaaagaaaataatgtatgtgtt

SEQ ID NO: 255736 - DNA, 590 bp, Homo sapiens
gcttattccccaaacactggtctagactgacccagatgtccctgattactgttctagtctttcagacctagttttacatacaccaagacacaaccattccctaaccaagaacagctagtcgtctacagtccttttggggagatgattagatgtggggtgagctcagggtaggggatggtggtaagtactgcattctgaacaagacagcgataaggctgagtcactatcggcctttgttaggatatacacagcccaagagaactgtctgaggacaaaaggtcatccccagccagccaacagacattactcccttggaagcattattttggcaattttctgtgtgttttgacttaaaccatccaaatgaggaacagtaggtaaggctgaaaacaaagaacagttctatttcgtgactatgacctggcacctcagtttctttctcaaaaaggtataaggattgggcagaaagctctctaagggcctttctagctgaagaacacgcatgactcaagcatgaataaactcaggaccagaaaccccaataactgaacacacaactttcctatgcactgtgttgtcctgtacattga

SEQ ID NO: 255737 - DNA, 326 bp, Homo sapiens
tcatggaacttttacacaaatatgccatatatggcaaagtcccctaatggaatagaacaggccattgcaagagagaacatgggggcctctgaagagataacatttaagctgacatcttaagaatgagcgagctgagactgttgagagatgctggtgaaaataaccaggaaaccatgagcctccagcctagctgtcaaccacccacccaccaatacccaagaagtaatgaagagaaaggccctgtctcaacctaggtccagaagcactatcaaggttcccaagacaaccttgaaagggaagggagacctccaagggagttccaggga

SEQ ID NO: 255738 - DNA, 741 bp, Homo sapiens
ctgtgggtgtggatttcacctaatggaatgaactgcaagaagattcacaagagatttaaaaagtttttaagataatatatcaatagaaacaatgccggcttgtatgaaaagggacagaaggagtacaaaatgaaaggcctttgggcctgccaaatttctcctagcaggaaataggctggaaggactacttacctgcatctcctataaaaggaagagtggctcagtggaaataagatccagaagggaaagccaagggctatgacgtctgggcagaagcaaactgagacttaatcaaagaacttgctacatattcccagttggatctcagaattgctagaaaccaagactactatgtgccactcatttctctcttctattgaaaaggaattgtaaatgtatataggagtgtgtgtttcacatgtgggaggtatgcatatcattacagccagagggcacactgtggtaataatcgtgtaagatacccccaactaatccccacctcctagtactcatgtccttgtgtattcccttcccacattctattatggaaggtctgtgtgtctgatagaataaaacagaagagacagggtgagactttggaatctataggacataaaagacattgaaaattctctctctctctctctctctctctcgttataaacaaacctatacaattgatatttgaatcacattctgtagcccatgtcaaccctccagatgattgcagccccagctgac

SEQ ID NO: 255739 - DNA, 2169 bp, Homo sapiens
atggctgtgcgcggcgccaacaccttgacgtccttctccatccaggcgatcctcaacaagaaagaggagcgcggcgggctggccgcgccagaggggcgcccggcgcccgggggcacagcggcatcggtggccgcggctcccgctgtctgctgttggcggctctttggggagagggacgcgggcgcgttggggggcgccgaggactctctgctggcgtctcctgccggtaccagaacagctgcggggaggactgcggagagcccggaaggctgggactcggactccgcgctcagcgaggagaacgagagcaggcggcgctgcgcggacgcgcggggggccagcggggccggccttgcggggggatccttgagcctcggccagccggtctgtgagctggccgcttccaaagacctagaggaggaagccgcgggccggagcgacagcgagatgtccgccagcgtctcaggcgaccgcagcccaaggaccgaggacgacggtgttggccccagaggtgcacacgtgtccgcgctgtgcagcggggccggcggcgggggcggcagcgggccggcaggcgtcgcggaggaggaggaggagccggcggcgcccaagccacgcaagaagcgctcgcgggccgctttctcccacgcgcaggtcttcgagctggagcgccgctttaaccaccagcgctacctgtccgggcccgagcgcgcagacctggccgcgtcgctgaagctcaccgagacgcaggtgaaaatctggttccagaaccgtcgctacaagacaaagcgccggcagatggcagccgacctgctggcctcggcgcccgccgccaagaaggtggccgtaaaggtgctggtgcgcgacgaccagagacaatacctgcccggcgaagtgctgcggccaccctcgcttctgccactgcagccctcctactattacccgtactactgcctcccaggctgggcgctctccacctgcgcagctgccgcaggcacccagtgaacccgcttgggctgaggcagcgagtgattcccgcgctccggctccggaccggcgctgacagctgtaggctgtagcctgcacggggcgccccgccaaggaggcacctggaggtgaaacccagctccagctcccgttagccaggacttgtcccctggcagctgggctgagtctgccctgagggggcgcctttttctaatttgaacagaggcaccctatggcctaggggccctgatcgcccacctgcctggaagcccctgggctctatttattatcatgacaatgttggaattaaattttgattcgaatatgtctgcctgggggtggggttttccctgagcggcaactcctggagaccacatagcctgaatcctcagaatttcaggcctgctgggagctttctgcactaggccacactagttcatggtatccatgctaccaatctatgtgtatctacatatcttttatttttggaaattgcatttgtaaccaaggggtgcgaaaccctggcagtcccaggcagcaccaggccaggggttgatttgaaacgtgaaggattgggttttcaggccctctgctccacccctcctgtgtgtcagagctagggtgggggtgcccgattcgggtgctgaatgtaaggaggggagcctccaagtgtggtgcaagccgggggtctccacatcttccttctctgaagtccaggtacctgcacaagcaggaagcgcctgggagccccggaaggaggagagcgcacacccaggcagccctctgcggaaactttccttggtttctttttatttgtgtaaaggaggttaagacgtgtcgcacttttcagttgtttgtattcaaatgacgattatttttctactcaatgtgaatatccctggccagcctttccacggcgcccaccgcagtgccgctgcctggccctcagtgtctaccttccgccctctgcgactccagtgctctggcccgggactcccctatccgcccctcacttacccttaaacaggtgatcccacctgtcttgtcaacctcgccgcttttcgcctccttaatggcactgtgcactcaactagagtattaactgtaaaaagatttgtgaagtttggaagctctattcgctgtattttttctttaatttataaacttttagtttaacatgcacct

SEQ ID NO: 255740 - DNA, 901 bp, Homo sapiens
ggcccaggaagggactccaggactaaggcgggaccgcgggcggggacgcagggccgggggtcgcagggaggctgccagcgcccgggcccggatacccgccccaaatcccgcctggtcccggcgccacccgggccgactcgcctctgtgccggcctccaggctggccccgagcccctgtgctcgttcttttcgtttgaacaagatccctcgtgagcccgcggcctctaaaccgtttgctcttgtgggccctccaggctgccgcgtgggtctcaaggtgaaggcctggagggcagaggggtggcggtgaccccgttgctccagctctcggggcctgtgactgccccagccacgtgcggcgcgggcgacgccgcggttcgcgcggttccaagagtgcggccgcccggagcccagcgcctctcaaccttgcccgggctcggaacgtcgcggggcgtgttctccgacacagagaattcgtgtgagccgactggcctcgccctgacctgcccctcttaggacaacacggaaaaccgctggtgcagggtttgcgagtagctggttgcgtccgccgggacccgacagaccggcaggtacgaggggcaggtggggaggcaccggagcctcagcgcagccccgcccggcaccacctgcccgctttcaacgaaacacgtcgcccaggcccagagaactccgggactgtctggggaacgcgccaggcccatgtcggctggggcgctcggagctgggagagggcggagagcctccatccaggccggagcatcccagagcccgaggtgcggagcagcatggagcgcccgaggcgggcggcgccagggccagagtctacccaggggatttctgccgcctttataggctggaaaaataaagatcaaaaacaaaccga

SEQ ID NO: 255741 - DNA, 813 bp, Homo sapiens
ggcccaggaagggactccaggactaaggcgggaccgcgggcggggacgcagggccgggggtcgcagggaggctgccagcgcccgggcccggatacccgccccaaatcccgcctggtcccggcgccacccgggccgactcgcctctgtgccggcctccaggctggccccgagcccctgtgctcgttcttttcgtttgaacaagatccctcgtgagcccgcggcctctaaaccgtttgctcttgtgggccctccaggctgccgcgtgggtctcaaggtgaaggcctggagggcagaggggtggcggtgaccccgttgctccagctctcggggcctgtgactgccccagccacgtgcggcgcgggcgacgccgcggttcgcgcggttccaagagtgcggccgcccggagcccagcgcctctcaaccttgcccgggctcggaacgtcgcggggcgtgttctccgacacagagaattcgtgtgagccgactggcctcgccctgacctgcccctcttaggacaacacggaaaaccgctggtgcagggtttgcgagtagctggttgcgtccgccgggacccgacagaccggcaggcccagagaactccgggactgtctggggaacgcgccaggcccatgtcggctggggcgctcggagctgggagagggcggagagcctccatccaggccggagcatcccagagcccgaggtgcggagcagcatggagcgcccgaggcgggcggcgccagggccagagtctacccaggggatttctgccgcctttataggctggaaaaataaagatcaaaaacaaaccga

SEQ ID NO: 255742 - DNA, 720 bp, Homo sapiens
gagtggaggaggagggtcatttcaacagcagcaaaactcagccatgccattttccctgacagcactttaattatgatgaaagaacaagattttttttttccggtttttacagaggaggctcgtggtggggggaaaggagggggctctgaaagagatgtgagctgccaaggtacagagtgcaaagcggctgtcactgccaaatgacagatgcagttggagagggggagagaagcccttccctgagcctgtgcaccagtggcctattctgtgggggcccaggactagtcagccaggggcaaatggtgaataggatggcccaaaggagccacctgctacatgctagcttccccctttccttccgtgagattttaaccccagggctggttctcctagttgtgctctgctccaccagctttgaaagccttggaggggtttcaagtggtcacataccttattgttgaaaaggatgtttttctttaaagtcaggtgctaagtcaggtgtgaggttgaaatggacacttaagggcttcagagcaggataaagggacagagcccaggaagcccaggactgatgctctgatgggcagaagccagccgtgttttaggaatggggaaagagttggagcaccagatgttaagaggctacagtcagctcaagcaagaacgagagaacggcgctgtcactgacttcccacctcccggccttgccggtaatccctg

SEQ ID NO: 255743 - DNA, 374 bp, Homo sapiens
gaccacccactactctctcaggtgtcattctaccacttccatgttgatatgaacttctaaagtctctgatcgctcttgcctagagaacttctggaaatcaatgaagtcattgatttttaaaatgtctggaacattgatttctatcaggcctcacgcaaagatcttggctgacctttgtcttctaggatgtcgcagtctagcagggcatgctgccttcaaaactgacacacaagacctagatcctgtggctgcaagtctaatgcctggactgtgttctatggtactgcagaggtcagcagagaaaataaaagatttgagaaatcagcactaaagcagcaaaccctatgcacccaaccccatccacctcgcctgtt

SEQ ID NO: 255744 - DNA, 471 bp, Homo sapiens
gcaattgaacccttgaaatccgcaataagacaaaaaggttattgaaagttgtaatccaaatttaaagcaaacaactgctccatgattttgagtaattggcatggtttgagaaaaggtcaaccatttaatcctgacattatctttcaaggaactggagaaagagaaaattttagttttcatttcgtaactttctgtgctacatgatttttttaactatgtattatagaggcaatataataatgataacagagttattgaaaggcattttgtgagcatagtcagcacaggtagcccagagtaagaatattcaaggaagccttctgagaggagatagatgtgtaatacattaccaaacaaattcagaagtaattctgcaataagtgggaaggatggcaagaagacagagacaggatagggtggaaggaattccagcaagaagagaatgagcaaagaaagagaacaatgaacaat

SEQ ID NO: 255745 - DNA, 1412 bp, Homo sapiens
  misc_feature (400)..(400): n is a, c, g, or t
  misc_feature (473)..(474): n is a, c, g, or t
  misc_feature (1105)..(1105): n is a, c, g, or t
ccttccttgaattgggtgttattggccagaagggctagtcaatactagacctgcttgcatttaatgactgtgttaatgacccaatagtgagaactacagggttatggaataatgctgtaatttattaaaataggcaaaaaagtatcaagaagccccagaaattaatctgacttatttatgaaaagattggtttcaggggtttatctgtggccatgaagaaactatgagaaactataaaattgagcactcggtattcccccaatcaaaaaaaagtgaacaccatgaaggtaggatatctctgtttttttccctaatgtatacctattacagttcctgaaacatagtaaatgctcaataaatatttttgaatccttgagtgaacaaaaagtgctaggcatcnttggtgtgggccttggaaagaaaacaaaatattacctcactccgagtagagtatattgtttctacaaatgggnncagaaaaggaaacagagaatatcaaaaacacacttaacctggccgggcgcggtggctcacacctgtaatcccagcacttaaggaggcagaggtgggcggatcacgaggtcaggagatcgagaccatcctggctaacacggtgaaaccccatctctactaaaaatacaaaaaaattagccgggcgtggtggcgggcctgtagttccagctactcgggaggctgaggcagaagaatggcatgaacccgggaggcagagcttgcagtgagcggagatcgcaccactgcactccagcctgggtgacagagcgagactccatctcaaaaaaaaaaaaaaaaaaaaaaacacttaacctagcttaaatagtccccagtagttctctctcaagttctacttgctggttaggttactatgtttcaggaaagacaccagagctacccaatgacaggctgctaaaaactcaagaacatggtttgatacaaagaccattgaaaattgggattcactgatgcctgtgggaccatggcaaggaattaacttttatttaataaaaatatttttaggaaaataaagtattatataactggaaaagtgaagctatttatagggtgatcatattctgagtttgcttgngatagtccaatttataccgtggaaagtacgaccttccttgaattgggtgtttattggccagaagggctagtcaatactagacctgcttgcatttaatgactgtgttaatgacccaatagtgagaactacagggttatgggaataatgctgaatttattaaaataggcaaaaaagtatcaagaagccccagaaattaatctgacttatttatgaaaagattggtttcaggggtttatctgtggccatgaagaaactatgagaaactataaaattgagcactcggtattcccccaatcaaaaaaaaaaa

SEQ ID NO: 255746 - DNA, 318 bp, Homo sapiens
ataatatttgtaaatgcataaaataaaatataaactatagttatcaaaatacagtggtccccccttaactgcagtttcaatttctgtgatttcagttacccaaggtcaacctggtctgaaaataagtacaataagatactttgtgtatgagacagaaggaccatattcacataacttttattacaatataattgtcctattttgttgttaatctcttcctgtgcaaatttataaattaaactttatcataggtatatctatggataggaataaactgtataatcacatttggtgctgtgtgggggacactactatatt

SEQ ID NO: 255747 - DNA, 400 bp, Homo sapiens
atacactagtacgaagtcaatgccggttccggacatgtgctgtatgcgagcgtgttggcagattcctgctactgattttgtgtatccgtatatctagtgctgtagctacaccttaatgtggctttgctactctctgcttctcacatcctatggggatctttctacagggagagtgcattctagagcatctctggcagctggtcaaggctctgggattgaatacctccatgaaatagagctctctgcctctgaatcagcctggtggacagctctggctgttcgatagagcttccttgagttaaagagagatttagcttccttagaacctttaactattgactgccttctgtcttttgaggaaacatcaatttcattcaagggccatttactgaacgctggc

SEQ ID NO: 255748 - DNA, 332 bp, Homo sapiens
acagtcccttgccatcagatttgttggtgagccctggacatcagaggcaccagagggctaaagctgtgtgctggctctaaagatgccggttgcagggctgtcagacaggccagagcccaaagggcccatcctggctgcttagatgttgtcattgttccctctggagcccagggtcccagagaggagtcttcagtctcctggagcacagccctccccctgcgtcaggacacggcctccctgttaaccttttcacaggtgtggttgctaagagatctcgctcttctagcccagcctggctcctgcccactccccttgctgctgctctgtgtgtg

SEQ ID NO: 255749 - DNA, 441 bp, Homo sapiens
gataacatgcatttcccctgacacctcccagcagtgctcagcagccccactgaccaggtccctgctgaccagatcccgcacatcaggtcctccctgaccacactctcactgattaggcccccatcaccaggccccactaactagattcccgctgccaggcccacagtgtccaggaccccactgacaaggacctcactgacaaggcctcactgaccagggcctcactgacaaggcctccctgaccacattccaccaatcatgaccccattgcctggccccacagatgaagccccactgaccaggtctccagggaacaggctgccagtgaccaggtccctactaaccaggcctgcggtgaccagatgccccgaccaggaacctagtgactaggcaccactgaacaggcatgtaccgctcagacccccgttgaccaggtcaccc

SEQ ID NO: 255750 - DNA, 321 bp, Homo sapiens
cagtgcattcgccaccgatttaataatcgaggatggcttaagatttgtcttttgcagttctttccaccttagtgtatctctaggggtgcacagtctgatagcttctggaacattccctgtctgtgagcttatgcccccagttggagacattgggttcatttgttttcttttattttcatttcttagagatcacttttaaaaatataactgttctgtaattatttaaaatattgtcgtagttccaaagtcaaatttaaaagacaaggtgtactatattgaaaaaagtctagattttaattcctgtctcctccatcctgttct

SEQ ID NO: 255751 - DNA, 487 bp, Homo sapiens
acttgcacccatacagctagcacagagcctaggcacagtgggtactgtttatattgtactgagataatagaaactgtgtgggtatatggttcaccttaaaatccatgccttatttttttttgagctcatgatgcctgtattaccatttgctgaactcaaaatactccaatggtttcctgccaaaatgtaatcatgttatgattgtccaccaagaccatttctaaggtagaaaccttacatcagaagatgttatatgtttctttttctaaacaagttcaggaaaagtatgtcctgatacaggaaatttattcagacttaacaccagcagtgtctctggttatgttacataattacatggaaatcatagtaataatatttgcagtgcctaaatttgaagtgctcaatggtgtcatctagtggtgtaagcactatagaaggtgcagctttattactcagtgcttttgggacagaatttgtgtatttaaaa

SEQ ID NO: 255752 - DNA, 318 bp, Homo sapiens
acaggcgtgtcctctgcacccggcccacatttattttttaaatttaagtgttttttgtttctttttttttggagacagagtctctctctttcacctaggttgaagtgcagtggcacaattttggctcactgtaatctccactttgtgggttcaagtgattctcaattctagtacctcagcctcccaagtagctaagactaaaggcatgcgccaccacacttggctaaatttttgtattttatttatttatttatttttaatttttgtttttgagatggagtcttggtctgtcattcaagctggagtgcagtggcacga

SEQ ID NO: 255753 - DNA, 442 bp, Homo sapiens
acgaggccgaccaccactacgtttgcggacaacagaagtaaattccagtctcagccctattatttagctgtgtgaccttagataagtcatttaaagagggaactaaaatgctgccttcctcctacggtgattgttagaattaaataattcatctcaagagcttgacagagtttggaagacagtaagtgttcaataaataattcctactaccaccctcgtaagtgcctgactaccaccaaatagaactatgtaagtaggggttgacatactttttatgtaagggccacacagaaggtatttgtgggccatggtctctgttatttattttttgttttgttttgttttacaatcctttaaaattgtaaataccattattaatagctcaaaggcccatacaaaagaggcatggctagtctaccctgcagcctagtctgccaacttc

SEQ ID NO: 255754 - DNA, 510 bp, Homo sapiens
aaatattccacagggtttgggggaaagggggcagagttgtagttgaaagatgcattggcactttgctggctgctgacattctgctaatttcactagataacagggacccagatgttgttatatgattaagtcagtttcaactagaaatattgtgaaaatcttgtggccagaggaagcctctcatattcagagtaaaaaaaatctaatttagtaaaatgtgtgatgtcttatgggctgtcttatatccttaagttcttttcaataggagagcaaaagagaaatctgttggcagtacagtgcttgccacattcctgttgctaagcaaagggaagctagggagaagaggaaaagcgaaggtctgtgaatcaggggcagtaaaattctaatcaactcttggtgttatgcttggctgactttctagagaaggaaaggcagcagtctgcattggtatatccaaaggctcaggaatgtagtcccagtattcacaaaggaaaacgcttccactgtgaa

SEQ ID NO: 255755 - DNA, 449 bp, Homo sapiens
catgaagccttctcaaattccaacagttacagttaaggtcttcagtctcagtgttctcttagcacaatgagaacactttttactaggcagagactgcatctcattcatcttgctacatgcctggtgtctaacacaacaccttgctcaaagaagagaagtattgaattgacacactgaatttacaacatcttcagtattaacagagagagcaaaagagaaatctgttggcagtacagtgcttgccacattcctgttgctaagcaaagggaagctagggagaagaggaaaagcgaaggtctgtgaatcaggggcagtaaaattctaatcaactcttggtgttatgcttggctgactttctagagaaggaaaggcagcagtctgcattggtatatccaaaggctcaggaatgtagtcccagtattcacaaaggaaaacgcttccactgtgaa

SEQ ID NO: 255756 - DNA, 372 bp, Homo sapiens
ggacagttgtgttatactctgttattggcatgttcctgtatattcctccctgcatctcctataatttgtgctttataaaaatatgcatgtgttatcttgtgcataaatattcataactgttttgccttcattgggaattgtgactttcagcatttacaaagacaaaaacaaagtttggggactagggtgaaagaatatgaaaacgttttagattttgagacagaaagagagcattaaaagagaagaaaaaggaacaaggaaaaggagagcaagaaaaaactattgcatcattaataagtggaagtaaaaagatttaatttaaatctaagtcaattatggccaggcacggtggctcatgcctgtaatcccagc

SEQ ID NO: 255757 - DNA, 471 bp, Homo sapiens
agtggctcggcttctggtgccccaccctgcctgatgggagcttgggtcctgactcagcttgccgagctaaagccaggcttccaaaaaattccaggatggggcagaaaccagaggacagccagctagccacagttagtataggctggggcatgaggattctgctatagcccttacattagttgattcactcattcattcatttattcagaagtcttttatgaactacctgctatgaacgtttccctttggtaggcaccaggagaaaacaagatgaacccaaaaggactcctcccagctcccaaggggaaaaaaaacaaaaacaaacaaacgaacaaaaaacagcttaagaaacgagacttgtacagaactatagagcaaagtgggaaagtgaacatcagaagacagttgcacataaaatacaaaatactgttggttttcagataatacttgcaaaatccctcatggtcatcc

SEQ ID NO: 255758 - DNA, 424 bp, Homo sapiens
aaagctgtatttggtaggtaattagaatttttgtttgatttttaatatatgttatcccactttaattttttccaaacaggaattatttttttaatctaccatttattattactattactttatttaaaaatactattattaggctgggcgcaatggctcatgcctgtaatcccaacactttgcaaggccaaggcgggcagatcacctgaggtcaggagtttgagaccagcctggccaacagtgagaaaccccatctctactaaaaatacaaaaattagctgggtgtggtggtgggcgcctgtaatcccagctactcagggcactgaggcaggagaattgcttgaacccaggaggcggaggttgcggtgagctgagatcatgccattgcactccagcctgggtgacagagcgaaaatctgtctca

SEQ ID NO: 255759 - DNA, 105 bp, Homo sapiens
tgtggttgagccacatttgagctcctgggggcaggccctgggcctggcactcagcactggaagtggtgtataggccagtttaattggagaagctcctgaatgtct

SEQ ID NO: 255760 - DNA, 566 bp, Homo sapiens
tatattcccctgtgtgtgtcccagctacccatctacagaattaaaacagcagcagtgacataagaggtgtgagcatccttgagtctcaagttcagcaagcttggtaagtcaggtgtgtccaaagggtcactctccttctgaatgaggagcagaggctcctaaaggaacatggccacagggaaggcgaggcatgggaaggtaggatggaccttccaacagctcccagaaggtgccagcgctgtccgggagggaagcaaagtcagagaacatcctcacactgctcctaggggtccaagagatagacagaagctgggcatggtggctcccacttgtaatcctagcactttgggaggccaaggcgggaggattgcttgagtccaggagtttgaggccagcctgggcaacaacaacaaaaaaacagctggccatggtggcacgtgcctgtagtcccagctactggggaggatgaggtaggaggatctcttgagcccaggaaatcgaggctgcagtgagctatgatcatgccactacactccagcctgggcaacagagacgctgtctcaaaa

SEQ ID NO: 255761 - DNA, 359 bp, Homo sapiens
accaacttgcttatgtagctcccatcatctttattaatgttgccaatcagtacctcatcaaatatttattaagttctcattctaagaccttctcaatgtaaaatagtaaatctgcccaaaaagctagattgaggccaagccatgggaccaaactaaaactttaactgtccagcttacttgcaatttatatttatttctgcaattatattttttcaaccagaccagtcatttatttaattttgtcaacataatttctcttgaaccttataggctgatttttccagcattttacctagcaaataatggtaagtttaagaacactaaatgactcataatgtattcacgtttcatttgcctta

SEQ ID NO: 255762 - DNA, 405 bp, Homo sapiens
taagggagacgaggtggctgggaaaccaaaataaggtttggctaatttttgaagtaccccgaatgtcatgcgaaagaggctgagttttgtgcagtcaatagaaaagcattaaataattttgtttggcctgggtatgatggctcatacctgtaatcccaggactttgggagatcgagagaggaggatcacttgagcccaggagttcaagaccagcctgggcaacaaagtgagaccctgtctctacacacacacacacacacacacacagaatcaaaaaattagccaggtgtggtggtgtgcatctatgttcccagctacatgggaggctgaagcaggaggatcgcctgagcccaggaggtcaaggttgtagtaagccatgactatgccacaaaacaagaccctgtc

SEQ ID NO: 255763 - DNA, 690 bp, Homo sapiens
accatacagttgctttctttgaaagaaggatttgtcaagcaaactaatcatatatgcaaatcaaaaggcaactatttaaagctactcaaaagaataaactgattaagcattctcaagtacatacaccctatattaaagcatctttacccaacatatttgtaggctcattacaaattgtctattaaccagtcgttccctcatgggactgtagaaagcctttctttgttgacctgtttcctgtcactgtcaatacttgaatgcaatgacattgtatctcttttaaaagatttcataattcaaacttttcactaattcagaccaagcttccacaaattagtctgaattaaagaagtttggctgtactaggttgacccatatgaaattggtgctatgcaaccattttttacctaaaaaatgacaattttatatggttcaatctaatacatttcttttctggtgcccctttccaaggaactaaaagcattctttattcccatgctttcctcctatggtattttaaaaataaaagcagaagagtgggattgactgccacagcccccaaccacctgcccctcagttcacaagtacagaaactgggagatttaacagaaagaagaaaatcattcaaaacacaacttctgctttctttgctgtacagagcttttacattcgatgtggtcctacctgctt

SEQ ID NO: 255764 - DNA, 860 bp, Homo sapiens
ttcaaatacatttgatgttaatgctgtcattacttgcactttgattcactaataacatttctaggtagttaccagttttgtcatttttctggaaaatattttggagttgtaaattgtttctctttttcttctagagttacaaattgaatttttaaatccaagcacctttgttgtggtgtggagagaagtatcacaattttatgtttattttaccttctcaaccttctcttggggtactttgcaaatacctgagtctaaacagaagtaccaaatacatgctctatgaactctatccttagtaaatctattaaacctgaataacttaaaagatcatgtgtgttttgtaatagcaaaatttgattttaattttttatttggaattggtgtatttatcatggggacttccagtttttcttcactttgcaaatggatattggctatagttttatgttttaatgggaatgaatttcaagtcaattaataatcagaaaatttttagttttacttttttcttttacaatatggacttttgttgttatttggatagtagttcaataaatcttaagctcagataattaaacactattttgaatcttaacaagatactgagcatttttttgtatgggatgatatcagcctatgtacaatgaatttaataaacttaagtattatcagatattttgcacattttagatcaataaaatctgaattaactgttcaagatttttttatctgtatttggaaatataattttgtaaaatcaatgtcttacctttttattacaatagatcatgttttgtattcaataaagcaagaagcccttttatctgttgtttttcagggaagggagtaacatttaa

SEQ ID NO: 255765 - DNA, 405 bp, Homo sapiens
gaacctgggatggccctcagaggtgtcacatattggagaaaagaggctgagctctgaactcccgtgttggccagacatggcatgggagctttccctgggaggagggcatccctgggtaaggcagttcctttggccaggggaaatgcccagtgagagactcagccacaaactgtcaggggcaatgttcccggcagctgggagaatgagcactgcagtctttttttttttttttttttttttcctggagccagtctcgctctgttgcccaggccggagtgcagtggcacaatctcggttcactgcaacctctgcctcctgggttcaagcgatgcttgtgcctcagcctcccgagttgctcggactacaggcatgagccgccatgcccggctaatttttgtattttta

SEQ ID NO: 255766 - DNA, 400 bp, Homo sapiens
aatcctttaaaattaatcagaatttttcattgtggttttgtagaaaggtgtggtaaaatgttacattttgtggacctaattaaaagatttatgagtgatatgtacttttgtaacttttcaaaattagtttggggaaattttcaaaagaaaaagttgaagggaaaacttagaatgaattaaaaataagaaataggcaaaagcaaatattttaatttaagtaaattttaaagactttttaaacatatttttggggaaaaatagaattgtattaaagaagggccttttaaaatttttctaggccaggcgcggtggctcatgcctgtaatgctagcactttgggaggccaagtttcaggagttcgagactagcctgggcgacatggtgaaaccccttatctaca

SEQ ID NO: 255767 - DNA, 142 bp, Homo sapiens
ctgtagcagaactgagtctctgtcccagccttgcacttccttatggagtataatctaggagagttttgagttggcctcaggcaggacttgggaatttgctcatctttacaatgggtgataatgcctacctcctgggattttg

SEQ ID NO: 255768 - DNA, 228 bp, Homo sapiens
gcctccctctgtcaaagaagggccagactcctttgaacactcctcccagcctctgctgccaggggtggggtatggagaaggaaaggaagaggaaatagctccagcctgccttgcttaggagctggcctctgggcaaagccccccaccaacccccagcaaagtatggggatggagatcttggcgccccactgcagcccaactgcactcaaagccagggaggtgacaaac

SEQ ID NO: 255769 - DNA, 439 bp, Homo sapiens
ctgaatgcactccttgcataaggttgggagtcccagagaattccctccttatgaaaaagactaaaaacttcacagccagtctgaggaaatggcaaggcagccagtcaactgccagggcttgggaaggaaatagaagccagctgagagctttgctgggcacagacaggtactcaacaaggattaatatttatcaatggaatgaaaattaatatttatcaatggaatggttaggccttggcctaaaccatggatgtgtgtaaaggtggggtttacattccttgttccatgggaagaactccttaagttaaaatgcaaacactcctagatttagtggaaacccctgcaagaagtggaaatcatgcaagaagagagttccacaaatcagggcacaagaggctgctatgaagagaacccacgggatgttctcacagtgaagatg

SEQ ID NO: 255770 - DNA, 460 bp, Homo sapiens
ccaccagcaaaggcatgtctgttgcttctagaggctggaaaagacaaagaaactaatttttccctagagtctacagaaggaacacagctctaccaatccaatttggacttcagaccttcagaggtgccaggtaatacatttgctttattttaagccactaaatttgtggttacttattatggtagcaataggaaactaatacaggtacctcaactgttagccgtggttactccctagaggtttggaaatgaagatcagagttgaagaggacttttattctccattcttcatgttatttgaactgttatcatggatttatgttggttttattatggatctatattgcttcttaaataaaaataattaagagcagaagtagctaatattaagtgaaaagatagtgtagaaaattgtataaagggtaattgttcaaccatgaaaaaatagaaaaaaaataaga

SEQ ID NO: 255771 - DNA, 5192 bp, Homo sapiens
cgacccggccccacgcccgcccgccacccgcgcgcgcccgtccgcccgtggcctcgcgtccgccgctgcgccgtgagcgccgctggtcggagggaagagctcgccggggcgccgggccaggacggggcggcaggcgccttcgcggaccgagcctgacggagccggaggctgggagccgcggcggcctggggaagtgtttggattgtgagctatttcagaactgttctcaggactcattattttaacatttgggagaaacacagccagaagaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcgtcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaggtgtttatttttaactcttggaagaggttttgtggttcccaatgtgtctgtcccaccctgatccttttcaatatatatttctttaaaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaatgca

SEQ ID NO: 255772 - DNA, 4608 bp, Homo sapiens
cgacccggccccacgcccgcccgccacccgcgcgcgcccgtccgcccgtggcctcgcgtccgccgctgcgccgtgagcgccgctggtcggagggaagagctcgccggggcgccgggccaggacggggcggcaggcgccttcgcggaccgagcctgacggagccggaggctgggagccgcggcggcctggggaagtgtttggattgtgagctatttcagaactgttctcaggactcattattttaacatttgggagaaacacagccagaagaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcgtcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgcta

SEQ ID NO: 255773 - DNA, 7550 bp, Homo sapiens
cgacccggccccacgcccgcccgccacccgcgcgcgcccgtccgcccgtggcctcgcgtccgccgctgcgccgtgagcgccgctggtcggagggaagagctcgccggggcgccgggccaggacggggcggcaggcgccttcgcggaccgagcctgacggagccggaggctgggagccgcggcggcctggggaagtgtttggattgtgagctatttcagaactgttctcaggactcattattttaacatttgggagaaacacagccagaagaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcgtcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaggtgtttatttttaactcttggaagaggttttgtggttcccaatgtgtctgtcccaccctgatccttttcaatatatatttctttaaaccttgtgctacttagtaaaaattgattacaattgagggaagtttgatagatcctttaaaaaaaaggcagatttccattttttgtattttaactactttactaaattaatactcctccttttacagaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttcatatattaccgttatatctttggaaatccgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaagggcactaaactcagattgactaaataaaaagtacaaagggcacatatacgtgacagaattgtacacaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgaaccaggttagcaaatgacctatcaaaaattattctataatcactactagttaggatattgatttaaaattgttctacttgaagtggtttctaagatttttatattaaaaataggtgtgatttcctaatatgatctaaaaccctaaatggttatttttcctcagaatgatttgtaaatagctactggaaatattatacagtaataggagtgggtattatgcaacatcatggagaagtgaaggcataggcttattctgacataaaattccactggccagttgaatatattctattccatgtccatactctgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagtgaaatttaggtcagggaaaagaccaagggccagcattgctacttttgtgtgtgtgtgtgtgggttttgttttgtttttttggttggctggttgttttcgttgttgttaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtgcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaatgca

SEQ ID NO: 255774 - DNA, 4487 bp, Homo sapiens
cgacccggccccacgcccgcccgccacccgcgcgcgcccgtccgcccgtggcctcgcgtccgccgctgcgccgtgagcgccgctggtcggagggaagagctcgccggggcgccgggccaggacggggcggcaggcgccttcgcggaccgagcctgacggagccggaggctgggagccgcggcggcctggggaagtgtttggattgtgagctatttcagaactgttctcaggactcattattttaacatttgggagaaacacagccagaagaacactgatatttgcatttaatggggaacaaaagatgaagaaggaaaaggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcaggggtctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtgcctaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacaccgaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaaccccaacaaagggaagagtgaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttaccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaacaaacaaaaaaaaaaaacaaacaaaaaaaaaaaaaaaaaaacacaacccgagagacctctataacaagcggcagggcagagcaaaaagaagacaaaaaacagaagcacacatgacgaaaaaaagaggttgacatacccaccaactatcgttagacacaaaggagggaaaacacaggggcgggccccccaataggagcggcagaaaaaagatcaacaaacaggcgagaaacacccagcaagaacgaaagcgggaagacagacaacaacgacagaacaaaaaacaaaacgacagcaaccaaaaacaagagagaaaacgacga

SEQ ID NO: 255775 - DNA, 512 bp, Homo sapiens
aacacaatatgagatggtttatttttatcatttaatcctcgcaaccatccctctgcagtgtgctatggtcttcatttggcagtgacgctgttctagcagaaaggttagataacttgtttaaagtcacaattagaaagtggtaggggccaggcacagtgattcacacctgtaatcctagtactttgggagtctgaagcaaaaggattgcttgaggccaggagtttgagaccagcccaagatatcacaatagtagacccaagactggaattaagattttctatttctctatgctttttttctacaaagaaatcagaaccatcaaagctaatttggataaagaaaataaattcacatactgagtaattatatgtaccaaacacaatatgagatggtttatttttatcatttaatcctcacaaccatccctctgcagtgtgctatggtcttcatttggcagtgacgctgttctagcagaaaggttagataacttgtttaaagtcacaattagaaag

SEQ ID NO: 255776 - DNA, 380 bp, Homo sapiens
aagctaaatctactgatatgtttaaaatattgcttaagcatgtcttatataaatgataaacattgtagtacataatatttattttcagaaaatacggaggctaaggcaggatgatcgcttgaggccaggagtttaaggccagcctagacaacatagtgagaccctgtttctaccaaaaaaaaaaaaagagagaattagctgggcatggtggtgcatgcctgtagtccccagccacttgaggggctgaggctggaggatcgcttggtcccaggagtttgaggttatggtgagctatgatcatgccaatgcactgtagcctggtagacagagcaagactctgtttcttaaacaaaaaacaaatacagaaactcttgagttac

SEQ ID NO: 255777 - DNA, 256 bp, Homo sapiens
accaggaggctgtgaatctccccactctgtaggaacagctgccgcttcctgggtccccattccccaacggaacgtgttccatgacatctgtgcagcatccgctgtgtgccaggcacagttctaggccccggagacaaagcgggaacagcacagacaggaacctccactcttacagtgaggagagaaagaggagtgaggcttggggaggttgggcaggacagctgcagggagagggagggcagaggacgggcgagtc

SEQ ID NO: 255778 - DNA, 379 bp, Homo sapiens
attcacctgcagatccctctaagagatggtgtcagcaataaggaggaggaagatgagaagataatagaggcccaaagtgggtcatgagtccccaaacccagccttcccaggtgtgagatttggtaggcagcaggctctgagcagttggagaagcagccagagaggctaccgcagagagggcaggacttgtcacccagccaggtgcaggtgcaggccccaggccagggaaaaggaggcaaagaagccagagaaagaagcaaaggagaacaagaaactcaggagaaagccctgaacgaggaaccaggagtgagttctggctccaacctgggcagccttgagcaggtcactgtcccttgctaagcctgtttctccatctcta

SEQ ID NO: 255779 - DNA, 651 bp, Homo sapiens
agaaaacaaatttgagcagaaaacggaaatgactttttttttcgttttctgtgaatcagctgttgcgaattttaaaaatcatttaaaattatttaaacaattgatttttacacgtggggagtatttgttaattaatgtcatatgatccatgatttcctatgcaccagaatatagtattattcagatattttattttggtttctgtattttcataatttatgtcagttctgaaatgcttaaaaacatactttttcaataataatatcaaaaaactctcaatgaataacacacatatataaggtggcaattttttaaaattatctatttgcacttactacaccaaataagacaaatcacaatattatataattatatacatgggtttattattatcacagtagtaagattaaagtatacagcacagtaaaatgattatcatgacttctataatccttaggcataacaagcctttttatcatttttaagcataataaggcctttaaactctatttatttatacacatttgcaggtgtgtgtaaataaataatttcctacagaaaaacaatgtaatccttgaggtaaagatttcagatgcaattgttgcactctagatgtttccctttacacctatttcaaaattgtattggtca

SEQ ID NO: 255780 - DNA, 451 bp, Homo sapiens
cagatagaaaatgcagttgaaagatatttcataaaggaagaaaagaagtatgaatacaggtgagagatattactgagattttttttcagtgcaatcctgggcttttctgactagcaatatttttatgtgcagaagtagtagaaaagataaatattttgtacagtagaaaaacacattatttctgtgccatggaagagagaactcacaaagatgacagcttctggctatgttggatactaaccagtactgtaagtacccaacgatctgactttaacactggctgtaaagctcctttaatgttccttgcaaggatttgaacctatttactggaaccctcatcgcttattgagttgaaaaacattgttgatatgtgtttatcttatatttgcagtagagtcataattttactttttagaaaattatatattaaacaaaaaaagacacatgaaat

SEQ ID NO: 255781 - DNA, 157 bp, Homo sapiens
ccagtcctcattttcagcctgtgaagccgcagccactgtggtgacccgggcagttagaaattgtgctttctcttcgtttctaaggaaatcagcttcctgaagctaaacagtgattagaacagtcctgtttcatggttgcctttgagagccatatgac

SEQ ID NO: 255782 - DNA, 423 bp, Homo sapiens
cattcatgtctgtgatccattctgagttaatttttgtgaagggtgtcaggtctgtgtctagcttcattttctgttgtagatgtccagttgtcccagcaccatttgttgaaaagattatctttgcatcattgttttgcctttggccttttgccaagggtcagttgactatatttatgtggatctatttctgggctctttattctctatattctttataatcaagtataataagttttgaagttgggtagtgtccatcctatggatctttggctcctcaagttttaagagtgttatcttagaccaggtgctgtggctcatacctatagtaatcccattgctttgggaggctgagctgaaaggattgcttgtggccaggagttcaagaccaggctgggcaacatagtgagactctgtctctaaaaa

SEQ ID NO: 255783 - DNA, 488 bp, Homo sapiens
aagattggtgtatctcaagtgagtccttttggtgggtgaatttgttggaggatttgtggtcacccgtgattaggtcagaactctgaatgtttgccaaaaagtctccctctgactactttggctgagtgggatttggttcccagggaaaattccaaagcctctctgtaaattccaagttacaactgagcaaaatgggtaactcattgaaggtcccatctgattcatcactggctttagcagtagaaaaatacgagatgcctagaatattgtcagtaggtctcttttttaaaaataaaaggcttcttttattctctcacatttggcataagcatacttataaaaatcctgctttgcaacggtcaaaagaaggctcatttgaagtagacaaattgatgtatttacaggaattctcagaaaaaccccactcaaagggattattggtatctctggatctcaggaaataaaagaaggaatgaagtgggcagcca

SEQ ID NO: 255784 - DNA, 93 bp, Homo sapiens
tcttagggtctgtgtgactagttataaaactattttctcttttaatcttccatttcctctgctataaaacagagataatactactactgacct

SEQ ID NO: 255785 - DNA, 208 bp, Homo sapiens
acaagaccaaagggctgaggagccaggctatagcttaaagaggctgggggagaaaagcttggctgagacaacccatagggagctagaggtttttaatatatcctattctgaataagagacgaattcattcagatcagtggtttcaaaccgtgctctgggcaactcaattgctaagggttccacaaacaggataaagtttcttatatac

SEQ ID NO: 255786 - DNA, 207 bp, Homo sapiens
tggccagggccagccacaatctggagctccagtgtcctggcttccttcttgggcccaccagctagactttccagcttaacccacagtgtctcatcctggtccatcccactagtcaccactctctgttcctctcacttaccccttgctcttcaaagcccatacagtaggtatacaagtggacaaaaaaagttgctcatttatgcaatc

SEQ ID NO: 255787 - DNA, 506 bp, Homo sapiens
actccctccacccctccacctgcctccagccagaattgcacagccagctacttccagaatcgctggtccaaagaaatcacgacaggcgctaagtttggggcaatccatttaatgctactaagttgtgggatggtttgtttgagcagccccagataacaaacattccttgaggtcacacgctaaccaagctgtgattcgaacactgcctctcaaattcacgagcaaaagagggggaattctgtttgaaatgccaaaaagaactctttcttgcttttattatttttaatttatgtataataattgtatgtttatataataattgtaataatttacgggatacaggtgatatttcaatatatgtatgcaatgtgtaatgatcacatcagggtgattagcggattcatttcctcagttatcatttctttgtgttgggaacattcaaaatctgctcttctacctatttgaatatagaaaataaattgttttgttttgtttttgaaaaagag

SEQ ID NO: 255788 - DNA, 749 bp, Homo sapiens
ggctcacacctgtaatcccattactttgggaggccgaggcaggaggatcacttgaggtcagcagttcacaaccagcctggccaacatggtgaaaccccatctctactaaaaatacaaaaaattgaggtgggtatggtggcacatgcctgtaatctcagttacttgggaggctgaggcatgagaatcacttgaacccaggaggcagaggttgcaatgagctgagattgctccactgcactccagcctgggtgatggagtcagactctgtctcaaaaaatataataacaataataataataataaaagaggaaccaactgtgaatctatataggacagtataaggaaaagagaaaggtacaaggaaaaacaagtgttagagaatattcgcccaaaaaaaatgttgccatggagcaaataaaattagtgctatttcagatttaaaacctttaaaatgagaaagcagagattttacgaattcagggaagatagagtaagatattataagaagatcaaatgggagctatcagagttcaggtaggaaattgaaaagaaaaaataaagctattggaaattatggtgacattattaatagaaacaccacaaagaacactaaatacttctgtaaggacattaaggatggagataagtgagcaaaaggaagtagaaaggaacaaataatttttaaaatattaggcagaaaaattattgatgcagaggaaaaataaaatatgtggagttgccagaaaaaa

SEQ ID NO: 255789 - DNA, 592 bp, Homo sapiens
ccgctaagtgggactcgggccagcctgccatgaaggaggtagctgctgcagctttcaggaaggaacaccaggtgtcaaccccaccgggtggccaaccccacctggctaggacccagtccctggtggctgctctcccaagaggcgggcagggctggggctaggggctgtccaggagtgttctggactgtcccttcgccacaattcccacaggctgctcaggaccgaggctgagacgggcgaccaggacgggattgtatggctgcaggaggctacacagtcccaggaggctgcttctaagaggcccacgtggcctgcatggggatgcgcctggctgtccagcatgtggtcatttgaattgtacatgtttcactgggatgcctacagaaaagtagacagaagatgtggaaaaagtttttgaaatgttgcaaacttagctacttttaaaataaaaaaaatagctttataattataaaagcaatatgtaaatcttaaaataatttgctacattctagtaagcatcttatgatctctatgtgccctataacattatgttgtatagtttaaatatatacaataaaatctattttaaaaa

SEQ ID NO: 255790 - DNA, 464 bp, Homo sapiens
acttccatggacccttagccatgccaaggggcagtaccggctttctgctggtgctgatgagctgtggtgtgaactcacgaaggctgctcaggaccgaggctgagacgggcgaccaggacgggattgtatggctgcaggaggctacacagtcccaggaggctgcttctaagaggcccacgtggcctgcatggggatgcgcctggctgtccagcatgtggtcatttgaattgtacatgtttcactgggatgcctacagaaaagtagacagaagatgtggaaaaagtttttgaaatgttgcaaacttagctacttttaaaataaaaaaaatagctttataattataaaagcaatatgtaaatcttaaaataatttgctacattctagtaagcatcttatgatctctatgtgccctataacattatgttgtatagtttaaatatatacaataaaatctattttaaaaa

SEQ ID NO: 255791 - DNA, 453 bp, Homo sapiens
ccgctaagtgggactcgggccagcctgccatgaaggaggtagctgctgcagctttcaggaaggaacaccaggctgctcaggaccgaggctgagacgggcgaccaggacgggattgtatggctgcaggaggctacacagtcccaggaggctgcttctaagaggcccacgtggcctgcatggggatgcgcctggctgtccagcatgtggtcatttgaattgtacatgtttcactgggatgcctacagaaaagtagacagaagatgtggaaaaagtttttgaaatgttgcaaacttagctacttttaaaataaaaaaaatagctttataattataaaagcaatatgtaaatcttaaaataatttgctacattctagtaagcatcttatgatctctatgtgccctataacattatgttgtatagtttaaatatatacaataaaatctattttaaaaa

SEQ ID NO: 255792 - DNA, 634 bp, Homo sapiens
catcattccaaaacaaatgtctagttgatctaatagacaaaataagccataaatattaacatatacaacatttaatgcaaaaagattagaataccccaaattttcctaattccaagaacattttattattgataatataatgcctacatgcatttatcattttgtattttaacgcaactttgaaagggaaatctattacttaaactatcttgagagtggtgtaattcttaattttgaaggaaaaaagccataaaaaccagttttgttgaaatatctgtgtttaattaataaataattaaccataactgaaatatttccacatccccattgcctgaaacagcacctagcatgtggcaggtactcaataaacatttgttgaatgaataatcaataataatggaagaagaaaatgttaagtgatgccataggcatttatacctagtggtatagacaagcatcattcttggaggcagtcagtgtacctctgagctgaagataaaataaggaatagccttaattctgcttatgggaagcagaaatccacaagggaagggagtcttgaagacacagccttcctgtaagcaattggctatacaaggctcttggcccattcatggctggaagctctccttaa

SEQ ID NO: 255793 - DNA, 498 bp, Homo sapiens
cttcaacatgaaatgaatttaggagcgactttagttgtctgaaacagagaggggagcattgtcaggtaggatattccttagactgggaagtgtggaaatagagaatgacttgcgaaagtcctgagacaagatccatccatgtccactgttcagtataacctatgtaattattagatggctattatactcaggaagagccaaaaatctctctacaaatttctactgttcctagttctgccctctggagcaattcatagttcgtctcttgctttttgtacatgaagcttttcaaacaactgcaggcatttattacactagccctcctcctattctcccaaattttttcttcctgacttgcagatgtttgctaactcctgaaaatatggcattcagaacttacatttggcacataaaacaccattatagttcttgagggcacaatcatgcgttgtttggctttgtaccccagcacccagcaaaacacatgaccaacacatt

SEQ ID NO: 255794 - DNA, 453 bp, Homo sapiens
tcaagatgagtgcccttttgtgctttgcaccccataggtggttattaaatacatgttgattggttggttggctgtttgtctggttagaagtggagagtcagagctaggtggaaatagcacttgcaaccattgcagctgctgttggaatgacacaggcaagagatcacttttgggccaggcgcggtggctcatgcctgcaattccagcactttgggaggccgaggtgggcagatcacaatgtcgggagttcgagaccagcctgcccaatatggtgaaaccccgtctctactaaaaatacaaaaattagccaggtgtggtggcaggcgcctctagtcccagctactcaggaggctgaggcaggagaattgcttgaacccgggaggcagaggttgcagtgagccgagatcgcgccactgcactccagcctgggcgacagcgggagacttcgtctca

SEQ ID NO: 255795 - DNA, 732 bp, Homo sapiens
tggagagaactcgtctcgactttttttttttggattcttttctctgacttgagaaaaataattttaagaatgcatactaatttagttttgaaataattaactgttttaagaaatagaataatctgagtaaagaatcaaagtccttaacatttttcaattgaattattaataaagattatattaatgtacagtattttacccatgcaggtaaaagttgcattagctttctttgctgcatttaggctattgcaaatttagtagcaagataaatgtaagataacatttgttatgttacagtatctgtggatcagaagtctggacccagcttagatgggttttctccttcacgatctctccataatgaactcacagtgccagctgggatgagttttcatgtggaggtcagagtagggaaggacctatttccaagctaacttaggttattagtagaattcagttccttgctcgtgtaggacctaggccctctgatcctgaagactgcctgaagtttcttgctacatgaacctctcaataggtagttcatactatggttgttgcctcttcaaggccaacaggagaagaagactatttagtgagaaggccttacataatataagacaaccatggtagtaacatccatcacttttgccacataatgttgcttataaggattcagaaattctgcctactctaaaaaggaagaaattttataaaggcatgagtataaagagg

SEQ ID NO: 255796 - DNA, 347 bp, Homo sapiens
ctccattcctctctagttttaaatgaaattatggaagaaagaggaggaagaaagaaatagaggaaaaagagggaggagacttgcaattaaatttttataatttaaaaaatgtgtaattgcatctgatggcatactcattaagacgagattcaaagtagagaaggggaaaatagtgacagcaaagctgagacaagcgaggcctgtatcatccaagttccccagcttaatggtccaccctgtcagagcagtcagatgagctgaagaaatgccggtgctgccgacaccataaaaaccatgcgccctctttattcgattatctccctgtggctagagccactgagaattac

SEQ ID NO: 255797 - DNA, 898 bp, Homo sapiens
ctaaaatatagacaaatctatattgcatgaccaagaagaaacagagggtgctattgtagttgctctatttattcacaacatgtgaaatattatgtaataccgtatataaaactatctctagtaagtggtaggtactaggataacaaaataaataaaacccagacagatcctatatttataaacttatagtctagagagaaaaatacagttaaataagtaatgctagtacagtattgataggtgcatttaaagaggcatgtacaatgagccctgttggaattcagagaatgaatgaaccacgtggaggctttagggaaggcctctcagaggaagcagcatctgagctggatcttggaaaagttcagttccatcagaaaaaggaaaacttgctcaaccattcagacaacggacacaaaagcattttggagtgacattcagtatgccttgttctatgaatggtgtaaagagtattattattgacttgtggatttttatatagtaagtgcataccaatcagttacggcgattgttttcttttagacactcaaattgtcccatctttggccaatgagatccacttcaagttggttccagggtccttttgacataactcacttagatttttagagcttacatgctgtgttttgtggcacaatgagatgcctcaagctcaccttgtaaattctccacactatacctaggagcaaccattatttcaagaatccctggtatccgcagtgggaaacagcatttagagaccaacatttgggcagtggggttggttattatccctggagcattatggtctaggttctgcagacaaaggtaggatatatacatatgtatacacattatatgtatattctatacatataaataaagttacatagtttccatt

SEQ ID NO: 255798 - DNA, 194 bp, Homo sapiens
cctggagtagctgcgggtgggatgcgatgtaccacatttgtgttcatgaggggcctggatgccgtacgggcggacgcagagtctcagaggagactgcactggaagctgacagcacggtccttagagtcaaatttcgtctgtccatttgctcagtagccctgggtcttgactcacaggtggaatgggagtgcaaa

SEQ ID NO: 255799 - DNA, 279 bp, Homo sapiens
cccatggatacaccagccacccccatcccctgcaacactgtccactcaaagatcccttttccatttgcatcttttgagagagtgatacttgccctttgcctggtgatatggtttggctgtgtcccacccaaatctcaccttgaattgtaataatccccacgtgtcaagggtgggggcaggtggagataattgaatcatgggggtggtctccctcatactgttctcctggcagtgaataagtctcacgagatctgatggttttataaagggtagttcccc

SEQ ID NO: 255800 - DNA, 476 bp, Homo sapiens
tatttctctactaacatataatctaattcacttttataaatattatattggttaccataagttttacaataagaattgtatataattagattctataagaattgtatataattggattctaatgcagatactgtgatggccttgatatgaagaacagagacagtgtaactgtgtgctttgaattcctccttctcactgctctttcttgtttattcccagtttgcacttacatatactataaaacataatatataaattttttattcctttcatagttatataatatagcaattacaaagataaaaactgcacttcatcttgattttcccattttgtacagtcttaatttcttcgtatagatttatgttttgaatgtatatcacacggctactagcagagaaagtttgttaaaatgtgcactgaagcatgaatgtgctgacaataaattgtctcaagatctttttgtaatgacagaa

SEQ ID NO: 255801 - DNA, 223 bp, Homo sapiens
ttaagataggaaaaggaaaaaaatctatcattaaatggaggaagtactacatataaaataggaaagcatgcctgcaaggaaacaaactagattcagtgattcccaaactctgatctcagggccctttcacactctaaaaattgatgacctcaaagagtttttgtttatgggagggtagagctagtgatatttaccattttaggagtgaaaatgagaacaactt

SEQ ID NO: 255802 - DNA, 472 bp, Homo sapiens
tagtagagatggggtttcaccgtattggctaggctgctctcgaactcctgacctcatgatccgcccaccttggcctcccaaagtgctgggattacaggcgtcagccaccgcgcctggccaagactggacactctctaaccaataaaaggctctaggtccaaatatccccagaaacttacatctctgaggggctgtcatggtcagaacattggaattgagctagcactttatatgcagcatctcattaatcctgatgctgcccttggaagtagtgataattactgtcccacttttcagatgaggaactgaggcttataagggttaaatcacttacccaggagtcctcagctggtaaacagcagagccaggacttgaaccagcggcttcggctgctgagcccaaagcaccaggagcatcctgctgtgctgagccctgcatgggcctcaccctcgcctctcagctgggccctgcc

SEQ ID NO: 255803 - DNA, 427 bp, Homo sapiens
gtccagcaagttctttagtattgttccaatgaagtttcaagattctttcctttttgaatatttcaccagaacattaacttctagtgaaaaactcaagcattttgttttttctattcttacgcttgcaaatattgtttatatttgaggcacagcatcttgatcaggcaccgtacatctttttcagatccatttctatctttttaatccagttcctttatccaatagcctgagaggtttcctgtcagtcagtgccttaacacccaggtgactcaggttccatctcagaccaataaaaaccacaacatgtgggagctccagtgtgaggtttgggaccattccatataaattatttttccaccagttttgtgaaatcagagtggcttggacaaatggatataagccaatcaaaataaacacgatataaact

SEQ ID NO: 255804 - DNA, 410 bp, Homo sapiens
caggagatgaaatggcagattagaaatatctggtgaatatgtacctggaatatgagagagagagaaagagatacagttcggaattttaaaataaaaaatttaattattatttcaagaatattactaatttgactgttataattgggactattcttatcgtatgaagttgaggaatactgagaagttctgcttctgtcaaactcatgattagcatcacacacctctttgtggttgttgtagcctcctttttcattttgccattgtttcagattgacgttgcaatatccagttcgctaaatatgttcaatagaggtagcaaaggtgcctaacctgaatttaatcatgaggaaacaccagacaacctgacgtttagggacattctacaaaacaactggcctgtactcctcaga

SEQ ID NO: 255805 - DNA, 834 bp, Homo sapiens
tagtgccacctgcctccccagtggcccaggaacctcctgactgtcctctccctctggttaccgttccctccttcacaagcaccgcttccacctccccggaccccgtgcccgagtcccccgccgtgctgtgctacttccccatctcctgccccactccggctgagacccctgtgctgtgccttcagggccccagaaggcccagtaggatttacctcatgtggtaagtcactcttgcaaggcacacagcacagcgcagtcggggagaggggacttcgggcttccggaaggcaggtggacaggagaggggccagaggccacaccaagaacaataccaggcggcgtggtgttcgggggagcaggaagatgggacagcgtggccactgcactggggctgcaccttctagcgccaaaggagcgagcgaccaataaaatcccatcctctctggaaaaaaaaaaaaacaaaaaaacaaaaaaaaaaaaaaaaagaacacaaaaaaagcgacaaaacgacgaaaaaaagacgaggagaggaacgagagaaaagaaaaagagcagagaacgacaatgagtaagggagcacaaggacgacagagaagggagaagacaagagaagaagagagccggaggcagaagcgagagaaagaagaagggaagagaaagatgaaagcaagagagggagagaggaaagaagagcgagcggggaggagagaagaaaagaaaaacagagacgagagataggaaggggagagaacaggagaagacgggagcgcgaggcgagacaggcgaccgcgagcaaggaaggaagagaaaaggcagaaagacggagagcagcgc

SEQ ID NO: 255806 - DNA, 1111 bp, Homo sapiens
caccaagtagtattagttcattgatatttgacattgtgccaatgtcttgaatagcggtgtgtaactgatcactaatttttttagactaagtaattgaattggaaatttattacgtctgtcttcctacctttgggtatctctctttacctccttctcaccaaatcttgagccaggatgttctgaaacactatgtataattaaagtctcttgatccaatatcagaaattcatccacaccattcccatcattgctgccaaatgagctttttgaaatggaaagccaactattcgccttcagaatgtcacagaacaaagtctaggttcttgggtgtggcatataagccctcaggcataaaagagcctgcattatttccttccagcctgcaattctaacttcacttcttttttttacaggtacactgacaggctgtcaaagaatgacatacagttctccaaaagtgactatcttgtttgtttatttctttccatttgactttactccatcctttctgctctaactgctgtggtttcttcatttcacttattcatcatcctgaaaggtttaattttgtgcatcccctcctctgcgaaactttcattcagaccctcaaatagggtgaatttactttgtattctttattgtgacaattattgcattatcttataaatgatatatttttatatcccatgcagtaagaaatacactggtcttctgtaaatttcaaaaatttgttatttgaatcacttataatagtgcctagaacatagtctggtcttaattaatattgttgaatgaataaataaatgaatgctattcaaagcaatcgggatagagttctaatttacatttatttgttattttaaatgataatcactactacattaagtacgtattttgtgtgaagcattatacacatattatttcatttatttaaaaaaaccccaagatattgttgttcctattttacagatgaggaactaagactgaaataaacaacatttccatgtctaaaagacaatctaaaagattgttaagttgtaggttttgaacaacatctgctatactctttagttgcaattctaaaccatatgctcacatgtgaactatgcat

SEQ ID NO: 255807 - DNA, 932 bp, Homo sapiens
  misc_feature (911)..(911): n is a, c, g, or t
  misc_feature (919)..(919): n is a, c, g, or t
  misc_feature (921)..(925): n is a, c, g, or t
  misc_feature (929)..(932): n is a, c, g, or t
gaaagcctgccagcacctattccacctcccagcccagcatggcacccctgctgcccatccggaccttgcccttgatcctgattctgctggctctgctgtccccaggggctgcagacttcaacatctcaagcctctctggtctgctgtccccggcgctaacggagagcctgctggttgccttgcccccctgtcacctcacaggaggcaatgccacactgatggtccggagagccaatgacagcaaagtggtgacgtccagctttgtggtgcctccgtgccgtgggcgcagggaactggtgagtgtggtggacagtggtgctggcttcacagtcactcggctcagtgcataccaggtgacaaacctcgtgccaggaaccaaattctacatttcctacctagtgaagaaggggacagccactgagtccagcagagagatcccaatgtccacactccctcgaaggaacatggaatccattgggctgggtatggcccgcacagggggcatggtggtcatcacggtgctgctctctgtcgccatgttcctgctggtgctgggcttcatcattgccctggcactgggctcccgcaagtaaggaggtctgcccggagcagcagcttctccaggaagcccagggcaccatccagctccccagcccacctgctcccaggccccaggcctgtggctcccttggtgccctcgcctcctcctcctgccctcctctcccctagagccctctcctccctctgtccctctccttgcccccagtgcctcaccttccaacactccattattcctctcaccccactcctgtcagagttgactttcctcccattttaccactttaaacacccccataacaattcccccatccttcagtgaactaagtccctataataaaggctgaggctgntctgccanannnnnttcnnnn

SEQ ID NO: 255808 - DNA, 976 bp, Homo sapiens
  misc_feature (955)..(955): n is a, c, g, or t
  misc_feature (963)..(963): n is a, c, g, or t
  misc_feature (965)..(969): n is a, c, g, or t
  misc_feature (973)..(976): n is a, c, g, or t
tcaaactggatctccctcctcgcgcctctgctggcctggcatgactttcgccttgcccccagcccacccctcacctcacgcggattggggggtcctcacgccaggccggagctggacgccatgaccagcattttccagcctcaggtctcaaggatagaggtgccaccacttcccaatggaccaacatttgacttcaacatctcaagcctctctggtctgctgtccccggcgctaacggagagcctgctggttgccttgcccccctgtcacctcacaggaggcaatgccacactgatggtccggagagccaatgacagcaaagtggtgacgtccagctttgtggtgcctccgtgccgtgggcgcagggaactggtgagtgtggtggacagtggtgctggcttcacagtcactcggctcagtgcataccagcatttcctacctagtgaagaaggggacagccactgagtccagcagagagatcccaatgtccacactccctcgaaggaacatggaatccattgggctgggtatggcccgcacagggggcatggtggtcatcacggtgctgctctctgtcgccatgttcctgctggtgctgggcttcatcattgccctggcactgggctcccgcaagtaaggaggtctgcccggagcagcagcttctccaggaagcccagggcaccatccagctccccagcccacctgctcccaggccccaggcctgtggctcccttggtgccctcgcctcctcctcctgccctcctctcccctagagccctctcctccctctgtccctctccttgcccccagtgcctcaccttccaacactccattattcctctcaccccactcctgtcagagttgactttcctcccattttaccactttaaacacccccataacaattcccccatccttcagtgaactaagtccctataataaaggctgaggctgntctgccanannnnnttcnnnn

SEQ ID NO: 255809 - DNA, 490 bp, Homo sapiens
ataaagtgttggaacaattggaactctcagacagaaaacaggttgatagtctcctatagagttaaacatgtacctaccatatgacccacccattacactcctagatgtacacccaagggaagtagagggatatatatgaaagttcatacataaatgtccatagtagcatcatttctaatagacaaaagttagaatcaactcaaatgcacatcaacagatgaatggataaacaaattagatagttagaaggaataagatctaatgctcagtagcacaatagggtgactacatttaacaataatttattgtatatttcaaattactagaagagtgaaattggaatgttcctaacgtaaagaaataataaatgcctgatgtgacggatatcccagttaccctgatttgatattacacattgtatgcttgtatcaaaacttcacaagtaccccacaaatatgtacaactattaggtatccataaaaaataaaaa

SEQ ID NO: 255810 - DNA, 507 bp, Homo sapiens
ccattaagattcatggtaacatttacatgtcaagggcagtttggagaatatttattggttggtttgctgtgaaatttgcgtgtggtttatacatttgtcttcaaaccggccagactttccagggtcttcccaaggtcagacacagaagtgcaattgctcatcacaggataaatgtgcattacagatgttgaggagatgaaaacattccttttcccgacataagctgtttgtggttctctttgtccctttctctaggcaagtttatttttcctgactgccattactaactaaactctgtctgcctcacttacaagctcctgggagggaaccgagtcttgggaggtaaaattgatgatggactgttttccagaccagggcttgaagacacaacgcttgttggcagttaaccaacttcctggtgagccccatataggaaatccacattcagcttcttagggagagatcctgactttcttataatgaataaatgtatgacactaaacactt

SEQ ID NO: 255811 - DNA, 654 bp, Homo sapiens
tgagccaagatcacatcactgcaatccagcctgggcaacaagagcgaaactccgtctcaaatatatatatatatatatatatggggagccaatgagtagtggagaaaggaagaggtgggagataaagtgggaaaggttagtgaagaccaggtcaagaagagccttgttagaccttgaagagtttgcactgccttagttttcaactttgttttgtaccagctatgattgggaacatgtcatgaatgcaggtgcccaatatcatcccagacctgcagaataatactctctgggattggggctggatctctacaacaagttccctaggaaattaccaaaaaccaagggaaactattttagaatctggggagacactggccgggcatggtggctcacgcctataatcccagtactttgggaggccgaggcgggaggatcacgaggtcaggagattgagaccatcctggctaacacagtgaaaccctgtctctactaaaaatgcaaaaaattagccaggcttgatggcgggtgcctatagtcccagctactcgggagactgaggcaggagaatggcatgaacccgggaggcggagcttgcagtgagccgagatcatgccactgcactgcagcctgggcaacagagcgacactctgtctc

SEQ ID NO: 255812 - DNA, 312 bp, Homo sapiens
tcccacgccccatccccaacccctgacagccattcatctcttcactaattctataattttgccattttaagaaagggatataaatggactcctagaatagtgagcctttggggactggctctttcactctgcatgagtctctggaggctcatccaggttgtggcgtgtgtctctggttggttccttcttattgccgagtagtattccacagtgtggctgtgccctgccacattttgtctaattgttcacccagcaaagcgtctgtggagtatttcctggttttggctgttatgaataaagggctgttacaaa

SEQ ID NO: 255813 - DNA, 525 bp, Homo sapiens
cactagagcatagagaagcaaagatacttgccaaagtcatgtagcaaaaacttgtcaaagctaggattcaaactcagatcctagtccttccccaccaggcaaggctgaattactctacagagagagagtgagtgcgtgcgagagacagagagggagagagaaaattctttcctagctctgccttatttctctggctctgatgataggaaagcagtggccacattgtcataagctccagtcactctccaagatggcagaacattccaacactggttaatggctctgggatcatcccatattgagggacatccatccctttgtgttctgacattgatgttactgtcagttgacagtgagctttatcatcaatcccttcaagtacaaaaggccactgttcagaaactgttattaaaagcagcctctctttttaaaagccgtctctcttttattccttccataataggagccagtgtaccagaagaggctgaccttaagttgcgcctgtttagttaaacaaacaacaaa

SEQ ID NO: 255814 - DNA, 343 bp, Homo sapiens
caccatcagtctgaacatttcggccctattctgtttatgttgaagtaatgtgagatgtagagaaatctctaggatggaaaagtacatttatttcatatcgcagaacaccagagagatgttgttcaagatttgctttgtagatttgcaactttttagacaaatcttatattttatgttcaaataattatgatttaagttaaaaagtgtaaagagagagtggaaatggtttatgtttagtggcagagggatgaaatccaggttccatgtctactagatttttttttccactataccatagcagtttgaaaataagtcgtctttgcaaatagttattctaattaaa

SEQ ID NO: 255815 - DNA, 389 bp, Homo sapiens
gactcctgtattcagttcgtcccatatgacagcttcccctaacccaagaaatgaaagcttgggacaaagcagcaccagcctgatggcacggaatagcaggtgcggcctcgaagaaaaacaaacttcacatgattcatgttcaaggtgaattttgtgcaacttgtggaggggaaaaaataaaacccagcaagatgtggcagtgattgagcaaataagctccaaatgagtcacaggctccacaggactcagtcctccacaaggctttctgagagacctggtgaagcaggtgtcagagcggcctcctcccgcctgccttctgcagctccacaagtagaggcgtgggcgctgctcacagaggcttggacgccttctccgagtgcgtctccttc

SEQ ID NO: 255816 - DNA, 541 bp, Homo sapiens
aaaagccatatatgaaaaacccactgctaacattataatcttttggataaagcttaaaacttttcctctaagattatgaacaaggaaaagatgctcactccctctgctgctattcagtattctactggaagtcccagtgtgttagtttgtttttgcattgttataaagaaatacctgagattgggtaatttataaagagaagtttaatttgcccatgtttctgcaggctgtacaagcatggcttcagcatcttctagtgagggcctcagggagctcataatcatggcagaaggcaaagggagagctggcagtgccacatggcaagaaagggagcaagagagagagagaagggagaggccccagactcttttaaacagccagatctcatgtgaactacttgagaaagaactcacttatcacaaggggatggtgctaaatcattcatgaaggatatgcccccatgacccaattacttctcaccaagccacacctccaacattgggaatcacatttcaacatgagatttggaggggacaaacat

SEQ ID NO: 255817 - DNA, 864 bp, Homo sapiens
aaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtataggtaagaaccttcaaacttactggagtgctaataattactatctaataagttgtattcccatagtttccagattgattaaacagaaacagctggcagacaaaagtcttttctctacagaatatggaaagttcatgttccacagctgaatcctgtttaagtaaatgtttgaaatgtattgaggtttagcttagtattcttactatgcctctgaatattcattctttttccaggaactgaatgaatcaggaactctttcttgactatagagatgcttaacagtttccagtgtttggaaagcatagctcgttttcatattaatggcccataggtatgctttccatgttaatgcttctattcagattaaaaaagaaaagccttagaagatgaagtttgtttttggtattcttttgatgtaatcatcttcatgcaatagcatcgtattaaatgtaattgagaaggtttattaataaagattatttaaaga

SEQ ID NO: 255818 - DNA, 482 bp, Homo sapiens
aaaaacagacaagagttcattaaatctcccagaagttgattcagatgttgctaagcccaaccaggcatgtatttccacggtgacagcagaagatctcttaaggagcagcatttcttttccttcagggaaaaaaataggggtcctctctcttgaaagtcttcatgcatccacaaggtcatctgctagacaagcacttggtataactattgttcggcagcctggtcgaagaggaactggtgacttacagctagagccttttctgtactttattgtgtcccagccttccttgcttctgagttgtcaccacagaaagcagcgagtggaagtatccatttttgatgctgtgcttaaaggggtggcctctgattacaaatgtatagatcctgggaagactctgcctgaagcccttgattattgcactgtttggctacagacagtgcctggagaaatagacagcaaaagtggtattccaccttccttta

SEQ ID NO: 255819 - DNA, 243 bp, Homo sapiens
tgggggagagatacagggaggaggaaggaatgttccaagaaggagaaacagcacagtaaaggcctggaggcgtaagagtgcacagggtatgggaggctaagaatgctgaacagatgtgagggcccataagaggcacagacaaaggaatgcgaagagaaatcattttcagctgaagaatgaggaaagcttcttggagaaagtagcttttgctgggctggaagcttgagcaagactttgaccttc

SEQ ID NO: 255820 - DNA, 475 bp, Homo sapiens
gaattctgttttataatagccatcaggcttggcccaatattttacctgttaccattgttgttcatatttccttatagttcatttcatcatcctgtattttatttatctttgtaagccatttaaccacttaggccttttttgaaacaaggcttaagtaagtttaaaatcagtaaatacaaaggacaccatcaagaaagtgaaccaacattccaaaaacaagagaaaatttttataaattacctatctgataatggactgggactcgtatctagaatatataaagaattcttatagtttaatcatataatacaattaaaaaatgaataaaggatctgaataggcatttctccagagatgatatacaaatggccagtaagcacatatgaatagatgcccaataccattagccatcaaggaaatgcaaatcaaaaccacaatgagataccacttcacaccaactaaaatggctataacc

SEQ ID NO: 255821 - DNA, 612 bp, Homo sapiens
ttggtgttggatagagctagtttcaggaacagtgaggcaggctaaagcctctttcctcaccaaatggcatgctgggagaaaatgaaacaatggtggagatattgtagaactgggaaaactggcacttttcagaagttaaaatatataattaaaattagcagattctcaaaatcagttttgaactcttactgcttatcagcatgtggtaattcagttggcctcttcaaactccagctggagttcaagcttcccaggtcacacacgctgccttcggtgaggtccatgatttatgtctgtgtaacctctagggcctactgcagagccattgggtctctggaaaggaaatataaatataccccctgcccctgtgacatacacataccaccccaaaaccttttatctgtgagcttcaaacatttgtgttgacacctgttaggccagctgtaatatctttacaataatgtcttcactaataaaagacaaaattgaacacaaactcagatgttttacctttgttttgctatattattatttatgtctattcttttatttattaaatatgttttgaacatcatatacatgctgttctcccttcttggaaaaagagtaggg

SEQ ID NO: 255822 - DNA, 930 bp, Homo sapiens
gttttctccaagcacccctgtggtctaccctgccgggtaagcattccctctggcacatgtccagccaggacagcactagccttcccccttcctggaagcctcctgtttgctgccggggtttcccctccctgctgcacacccttgtgagaactcggcagtctcttctgaaggacattgatgctgtgccacaatgtcatatgctggctgcttcatgcctggttctgcttgaacctcatctccacgcaaaccccagcctgggccacaggatggagcccagcgctcgccttcctggtgcttccggagctcatcacttactccgtgatgtttgttggtgtctgtgtgtcccacccttgaggatgccagctcctagcaggcaggggcttccgaattctgttcctgactgtgaccccggcactcagagcagtgcccggcacacagcgggtgctcaggaaacttgctgagtaagagagtgggtacatgaatgaatgaagaggactttctgggcagtccatctggccctttgtccttgtctttggccctcactggcgagctaggccctgcactgcctgaaagctcatccgagggctcgcctcctccctgaagccctctcacactccccaccttccaggccacctttctctgaattctccagtcacttgctttcctcatgctgactgcacactggcccgcatgaccttgaactgtgggagtctgtggtcctgtcttcctgaccagacatcagctccttgaggggcaggacactgctgcaccttttgtgtcccgagcacagggccctgtaaacagcagatgttcagtgtgtgctgatgacgctgatgcggtgaagtcagcgaacaaagtccagccagagtcgttcacagctccagatgacatctccccagcagacctcccacagcttcatgggtaagactt

SEQ ID NO: 255823 - DNA, 713 bp, Homo sapiens
caaaggtagaagagatgtagaccatgcttgaataagcaagcttctctaagtgacacatgcaagtaaaacatattggttttagtctgccagggctttgcaagaacaagcaattaagcattcctagactctttgcacctgtggcaatgccagttccaaattcattaagcaggcatctgtgtccagaaaaagaaggtctgttgattttgtatttgctagcataaaaaccaaagcttatttacacattgctacaggaaattaaaaaagaaaagattgtcattccaagcagttttagttgctggtgttttgttgttgttgttgctttgtttttatttgtatttagtccctagggaactttgtagctttaaatgatctatagtgaaacttattatttctgtatttttactttgatataaaattgacattaaatatattgtaatatatttaaggtaactaaataataaaatggtattattaattggttactttatgtgttattttagatattgctagaatatttttaggactgttactaaaatgacaactttgttattttccaagtcaaagaaaaaaattaagaaatttgtctttagatattttaatccagatatattatagctgatactattatatgaccaatgtattttgatatcatgtttgtacattttttcatagtagcctcaatttattctgccaaccacaaggtaagccaacca

SEQ ID NO: 255824 - DNA, 435 bp, Homo sapiens
taaaaataaatcctcatgtcctgggacacccaagccttagaattaatgagtgtttattcatttattcaaaaagtatacaactgctatgtaccaggcactctctaggcattgggaatacgtgggtatacaaaagtaacaaaaatccccgccctctcagaatttagattctaatagagaagaaagagcatatatagaatcattaaaaattaaagttatgcatagtatgttagggataagaatagaaataaagcagcaaaaggagatatgaacagtcagagatgatcgctggtaatttcgttaagggagcaagcctcaatgacaatcatctgcaaagcagggagtgctgtggtcggagcacaggctgtggcatcagctctgggtacagtcctggccctgctgctgcccagctgcatccccttggacctgttgctcact

SEQ ID NO: 255825 - DNA, 207 bp, Homo sapiens
gagtcacttgtagtcctagattacattaacctaatttagattgaggtgatttcaaattgacttgtgtccctgtgaaggctgagatatttctggaacatttttattccttgggtacaacaactttttacccatccaaaatcctgtggtgtttattaggtttcctactagctgacaggctttaaactctgactttttcctccctcagct

SEQ ID NO: 255826 - DNA, 599 bp, Homo sapiens
ttttggatgacagaggtgatgtaagtgtaggagaaatgtatgcctagaggacctaaagtcacctagtttttctaatgacgtaaaattacccttggtttttttctgctgagaagaatgggtgtgtgaaatacacgttaatactttggaatttaagtgaagaaagaactccatttaatacactaagcatttgtaccatctagtattatatttttaatctgcatcagacattatgtcatccgaatatcagcccatgagtatagaggtatgctcttcttagtagctatacctgctgccacctgactgtgcacaaggagcaccatgctttggatccttccctatgggaatcgctgggatgtgttgtagatacctgtctatatatttttcagttgaaattagaaggataatcttacagatatttaaatgtgttaaaccttaaatgtaacaaatattttagattaacatatatagactattaacattgtgtttgattcgctcttattactctaatcttaattctagaactttcaaaggttgaaagtcattaccaagaaaaaaatcatgacatcacaaataatttggggcaggcagttagatatata

SEQ ID NO: 255827 - DNA, 354 bp, Homo sapiens
gtcttgctctgttgcccaggctggagtgcagtggtgcgatctcagctcacgacaacctctgcctcccaggttcaagcaattctcctgcttcagcctcccgagtagctgagatcacaggcgtccaccacaacgccaggctaatttttgtatttttagtagagacggggtatcaccatgttggtcaggctggtctcaaaatcctgacctcgtgatctaccgacctcggcctcccagagtgctgggattacaggcctgagccaccacgcctggccttctgtataatttttaacaaatattacctagcatgccattgacaagctacattccactgatgggtagtgtgctgctacaaca

SEQ ID NO: 255828 - DNA, 225 bp, Homo sapiens
aagcaccagcatctgtcagaggcagcaggggcaggaccaagggggagctctaagccagagcctttactggggtttccaagggaaaagcaaggcagagcagagcctacagcacaggactggctagctggagtaattcctgtgggctttcagctgtgggagtgttccccagctgcttggctcctgttccggggatgattaagacagaggaatactgtctcctgcggt

SEQ ID NO: 255829 - DNA, 299 bp, Homo sapiens
cagttccctccacctgtctgctcttccttcccctcagtgtctgcaaggctcactccctccaagttcatgttcttgctcaacagtcgtggggaaacctcctccaaggacccacctcaaagagcatccaccctcaccctctggtccctcaccctgacccctttctcagcatttcctgccacctggcactatatttacaaaatctcttgactgtctgcctccttttgttcaccactgtacccccacagggcccaaaacagggcctggcacacaattcagtcaataaatatgtttgaatgaat

SEQ ID NO: 255830 - DNA, 291 bp, Homo sapiens
ctgcactatttctgttcactattatgtcatgagggcttactacaatgtctatcacatgttacatgctgtatgtttgaacaaattatttctcattttaattcatgtagaatatcgatctttttccaaaatatatcatcaactttaaaaatggtcatgcatagctgttactagtcatgaggaaaagatgcccatcagttgtgaaggcagagtccatttccattgacaaaggcaggttgagagtataagtaataggcttccagtgaagtaacaaagctgagcaaagggaaagaa

SEQ ID NO: 255831 - DNA, 388 bp, Homo sapiens
  misc_feature (51)..(51): n is a, c, g, or t
  misc_feature (110)..(110): n is a, c, g, or t
cgtaagtacagcagagtggttcccaagctttatgactagagaagctactcngggagaagcctgagatggaccttccaggtgcatccctgagaccgtgatttgggaggtcngcagtgggcctgaggaccatcgtcaatcattaacaaacattctaggtgactctaactcaaaggatctaggatttgaccaacaataaggggctgtttttagtccatatcaccagatgccaacagtgaggtcagtgatgaaggagctttgagtcttgactattctttaactgccaggagcccttatgtaaagggcttagcatggtgccaaggtcaagggaagcactttatgtgtcttcatcattgttaccatgtgggtgagggggaggaggatgccacgg

SEQ ID NO: 255832 - DNA, 255 bp, Homo sapiens
  misc_feature (250)..(250): n is a, c, g, or t
aactaagttgtatatctattttgagcatatcattcttccacctattttttgaaaacttttaaacctcaggaaatttgaaagaattgtatgatatatccaatgtaactaagttgtatatttattttgagcatatcattcccctacctattttttgaaaagttttaaacctcaggaaatttgaaagaattgtatgatatatccagaaactgcactctagcctggacaacaagagcaaaactctgtttcaaangaatt

SEQ ID NO: 255833 - DNA, 590 bp, Homo sapiens
cttatggcaagtataatatgtcagtcactgattgtctttataaatcccacaacaggcctaagaggtagatgttatcaatatcctcatcttatagatgagaagactgagggtcataaagattaagttattaagttactatgcagttaatagtttgtagaatcaggatttgaacctttgcagtccgatctcagagtccatgcacataaacactacatcataaagcttcttctttctggttcactagcaatttgatttgcctagaatagatgatttgtattggggacaggtaagaaataggcttggcaaatggtcaggatggtgccaactgtggtgcaactttaggatcaagaagaagaatttcaatttgatgctataggcaatagggagtcatggaaggttttagaccagtgaagacataaccacaatggtattttcttaactttattatttaaatcttccatgttcttactaattttgtgttttcttgatctatcagttactgaaagatgtgttgaaactttctactttgattataaattcccattctgtatttgatgctctaatattaaaagcataacattttgaaaaaa

SEQ ID NO: 255834 - DNA, 480 bp, Homo sapiens
tcaggctcagagagtttaagtgctcaagatcacacagatgattggtatcagagctggattctgatccaggtgagtcttatcccagagccgaggctgttcacctctgctcagtactgctctattgtgccacagtgcaaggcaggatgtaaaagtgctaggaaggcacgcttgatgtgggcaagcttagagaaccttcctgaatcaggcagcatttgaaaggtgagccaggtattgagagggagaggactgcggtagtgtcttggtcaaggcccagaaataaacagaaaccaaggtaggttggtttaaggtgaggattatttaggaaagtattaaaagagaaaggctggccggatgaggtggactcacaccttactgtaatcccagcattttggaaggctgaggcagaaggatcacttgaggctaggagtttaagaccagtctgggcaacatagtgggaccgccgtctataaaaaaaaaaag

SEQ ID NO: 255835 - DNA, 435 bp, Homo sapiens
gctttagggctatcggtttattctttagagtgttatgaagggtcaaatttagagcactgtctaaacagtcaatttgtggaagggccccagttctcttacagtgaattttagcttcctttttcttacaagggggtgaggtagagaagctgttacctttaattagctcatttgcccctaaaactcagcccaagttgtgaagttgtaattattgcatcaatcacattatatatatatatttggagacaggatcttgctctgttgcccagactggagtccactgatactaccatagtttactgcagtcaggccgagcgaagtggctcacgcctgtaatcccagcagtttgggaggccgaggtgggtggatcacctgaagtcaggagttcaagaccagcctgaccaacatggtgaaaccccatctctactaaaaaaaaaa

SEQ ID NO: 255836 - DNA, 236 bp, Homo sapiens
  misc_feature (166)..(166): n is a, c, g, or t
  misc_feature (218)..(218): n is a, c, g, or t
gggatccacctcttcctgaaggctggggcactttggggcatgaatatcaactcagaactgagttagttaaatgaactgtagctcttgctgataattcactcccacatgagaatgggagttcacccacacgatttagttttcccattgataagagaaaatgaggccntgccagagaaatgcatgttccataccaatgcagtcggctttgtgtttgtgcntatctttccaggtgaagg

SEQ ID NO: 255837 - DNA, 690 bp, Homo sapiens
acatcaacatccctgccctctgagaaacctttaagatcggtaatccaaccacctaaaagttgctagaaatacttatttctcttagcctgtgaactctaatagagcacaatttttctttagttgcacatctgtgagcctgattccatatagagcctaacatggaatcatgttttaaaatatgttatttttaacacctgtagtcaaatctcatttatctcttacaattggtttactttctattttatttgtggtgggtttttatacccaaattgaattggtttagccactagttttgcttttatcacttggcttgtacccaaggaacataggtcgtttttcatattattctgagaaaaatgtaatcaaataaatctcttttaaaaattaatagaccattcaaagccaactagtagtggtttgcaagttatttttgatcatccgtgtttctacctttggttaatatcaaaagttgtttgtggcacaatataattcttgagcagaacagtggtcttctggttataatacttataatatcagccatctgtcctatatgaatttacacaccagagtctcagattctttactaaacacctacccatatttgaaatcagtgttaaccccaggttcatttgtttagaggaataaatatacttaataaaactgaagttggtattattgggttgaactaag

SEQ ID NO: 255838 - DNA, 338 bp, Homo sapiens
gacagagagagactctgtctaaaacaaaacaaaacaaaacaaaatgtaaaaaaacaacaaccgcccccctccccccacagaattggtggtatgaagctaaagcagtacttccaaataaattttagcattaaatgtttttattagagaaaaaaaggtctaaaaaaaaatcagtgatctaatcttccaccttaaaacaaaaactagaaaaagagcaattgaacacaaaataagtagatgtagaaacaattaagaatgtaaggaaatgagagtgaaaataaatgaaatagaacacagaaaaataatagagaaagtaaataaaaccaaaagctgttctttga

SEQ ID NO: 255839 - DNA, 507 bp, Homo sapiens
catttctattaaaaaattgttttaaaaaagaaatatatatttggtctctgcccccagttttttggcacacagctcctaaaacttttggaatttctggagtggtaacagtgtcttttgtatgctaatgagacaattggtggctgggggtccccatacagcttcaggatggtggctggattagaggtctgggacttttggcaccacccccaaactccagagaggggagaggggctgaaggttgagccagtcaccaatggccagtgatttaatcaatcatacccatttaacgaagtctccatacaaactcaaagggacagggtttggatgaacttttgcggtcggggttcttggagggtggtgttccaggagagggcatgaaaactccctacccggtcccacatatgttgccctatgcagcttttccatctggctgttcatctatatcctttgcaataccctttataataagtgggtaaacataaaataaagtgtttctctgagttctct

SEQ ID NO: 255840 - DNA, 460 bp, Homo sapiens
ctctgcaatccctggcctcagcttcacagacagactcaccagcttgtggagaggagctctgtctttctgacagactctcatcagccaagcttccgagactggcataaagcagaatacagcttcctaaatttatggtagaactctggtcagctcagcaggtcaaccagagagctcaggacaataataagggtagcaccaaagatgcactaagattttgtccagggccaggagcagtggctcactcctgtcatcccagaactttgggaggctgaggcaggcagatcacttgaggtcaggagtttgagaccagcctggccaacatggcgaaaccccatctctaccaaaaatacaaaaattagctgggtatggtggcgggtgcctgcaatctcagctatttgggtggctgaggcaggagaatcgctagaactcaggaggtggaggttgcagtgagctgagatta

SEQ ID NO: 255841 - DNA, 423 bp, Homo sapiens
agtcaagaatctggtgacaaagaagcttcatcctttcaatcttacaatttcaatctcctatctcaagaaagctcatttctatgtattaccagtgcatcctccacatgctcttctgcagttgttccttctgcgggaaatgatctctccttttgtcgaggcttggtgaaatcctttgaaattctgttgattctgtaagagccaacacaaataccaactgccctgaatactttctggctaaactgccacaatgaacgaggattcctcacccatgtccctccctttcccttcctttctttttataatggtatgcttattgttttttaatgtaacatttttcttacaaaaggaatacacattcagtgttaaaatggaaatgtagaaaagtcttcagaagaaaataaaaatcacctgcaaatccaattc

SEQ ID NO: 255842 - DNA, 330 bp, Homo sapiens
actcctgtcacatttgggcgatcagagcaacagctggggagactttttcaacaaagatgagtgtcagataatcctgatgagattccacatccaacatcttttgtaattatgtcacattcagctgtaatggaataattcaagctgaaagaacaagctttgatcctttcttaaacctttccctgtggactggctatctaaaagatttaaagatatttctgttacaagatctagtgtttcctcagagaagtcatgcttctgaagcatcgtgatctacaagaacaatatcaagtttgccaaacacatttctgaaagcatcgtgttttgggggga

SEQ ID NO: 255843 - DNA, 451 bp, Homo sapiens
ctcgcgccgccctcggctctgcggactcggatcccgccaaatttgaacgcgagattgtcaggccctgaggggcttgaggggcgggggaacgacgccgctctccaaagttggaccccgtggcgagcggcggcgacagccgggtgctcgctgcctcccgaggtgctcccttttcccgccgaagccctccacagcggcaggccgaggcgcagcgacgtgtccctgtaccccgagttcagcgcgggcgggaaaacgacctgcacccggggaggcagcggcttcgcgggcagagcccacgggagcgcgccctgctaggagccaggccggataatcgcctttctttgtcctcctccctcttcgagtccaatcaatgccctttctccttaatgaacgaggtgtccttggagtttgaggttttgttggatgattttaaataaaattattaagttataaa

SEQ ID NO: 255844 - DNA, 695 bp, Homo sapiens
aaatatccccctggatttagcagcctttgatgattcttgcctgaacaaaactttattatggtagatgtaaaatgaagattttcatttctagcacttcttccacatttaccagctacattcagccttcttgtggataagactctcccctttctcccaaatgtttattgtttttattagtatggactcacgatttcctgttcttctcaatggcctataatttattactatctttaattatattagtgctcaaattttcccagtttggccagtgggatcccctccaagttggctattatttccttgtgacatacccactttttctttctttctctttctttttctttccttttaaaactcacttctttacttcctgctccagccctggaatcagccatttctctgaaaaactgtggttctttcaagtggacaaaggtattagagaccaaaatttgggcacaagatatgcactttaacaaggacccactttaagtgcagtttagtgaatttgaatgaatgcatgaacttctgtaactactaccacaatcaagatatagagtttctgtcaccctaaatctctttctgctgccatggacacacacacatagacacacactctatacctccctttatacactcacacacacacacacacatatgggacacacacagcaatgttaaattatctttttaaggag

SEQ ID NO: 255845 - DNA, 805 bp, Homo sapiens
aaatatccccctggatttagcagcctttgatgattcttgcctgaacaaaactttattatggtagatgtaaaatgaagattttcatttctagcacttcttccacatttaccagctacattcagccttcttgtggataagactctcccctttctcccaaatgtttattgtttttattagtatggactcacgatttcctgttcttctcaatggcctataatttattactatctttaattatattagtgctcaaattttcccagtttggccagtgggatcccctccaagttggctattatttccttgtgacatacccactttttctttctttctctttctttttctttccttttaaaactcacttctttacttcctgctccagccctggaatcagccatttctctgaaaaactgtggttctttcaagtggacaaaggtattagagaccaaaatttgggcacaagatatgcactttaacaaggacccactttaagtgcagtttagtgaatttgaatgaatgcatgaacttctgtaactactaccacaatcaagatatagagtttctgtcacctctcaaagcctccttttcttgcttgctcatatgcaattacctctgtccaaaatgaccctttccctttcctctacacacttggcaaagccatgattgaacatttattccttcttagattttgttccattttcctcagcaaaggttctttgtttcctcttcttcatgctcacaaaagagagagtaaaagtgcttgctcaacagttcttcaactgctctaataaagattgattctcttacc

SEQ ID NO: 255846 - DNA, 485 bp, Homo sapiens
cactccacctgacttcaaaatatactataaagctatagtaaccaaaacagcatggtactgccataaaaatagacacatagaccaatggaatgcaataaagaatcaaaatttacagccaactgaatttcaaaaaaggtgccaagaacattcactggggattggacagtctctttaagaaatagtactggcagatagacattggcaagatggccaaataggaacagctccagtctgcagctcccagcgagaccaatgcagaaggtgggtgatttctgcatttccaactgaggtaaactgttcatctcattgggactggttaggcagtggttgcagaccatggagagtgagcagaagcagggtggagcatcacctcacccgtgaagtgcaagcagccggggtctccctcccacagccaagggaagccatgagggactgtgctattcggcccagatactatgcttttcccacggtttctgcaatctgca

SEQ ID NO: 255847 - DNA, 597 bp, Homo sapiens
gtaaagtatttatgaaattgagacggactctttgaccactcttggtttttgaggcacattcctgggatacagttatttaatgtaacctaaatgtgaaggtcctcatttgcaaagtgggtgcagattgacctcattccctggaacaggcttgcctccttgaggcaattcagagatgaggaggatgtttagaaggtatttctacaaaatcctggtgtgaaatcaagtaagttgaatctgagaacaacctttgtttaaatttaagcaaaagaagcaaaccactgatattctttggaagacttgctaaataaccacactttggaaatgttgatctgatgacttttaaaaagagtagcataaccaatccctagttgaccaagtgcatgtttatcccattagattcaagtgggttctaaaggcttgaaaacaaatatttcctgagaacagtccttggggagagttattttgtcaatggaaagatttccaaatgtaaccccaaatctgtagaactgtaaataaatcataccataatgccatcaagacattttctggtaaaagttaagtaaatgctgtttactgagggtcaaatacccaagcact

SEQ ID NO: 255848 - DNA, 133 bp, Homo sapiens
tttctgctttctcatttttacatctgggactggagaaattgctagaatttcaatgttttatttgaaatcaggcaacagaacatcccagaaaagactgaaggttggatgtactggataatgcctttaggtgagg

SEQ ID NO: 255849 - DNA, 465 bp, Homo sapiens
agactcagtcactccttcttctcaacctcctgagtagctgggaccagcggtacacactaccatgcccagctaattttttatatttagtagagacaaggtctcactctgttgcccaggctgatcttgaactcctgggctcaagtgttcctcccatctcggcctcccacagtgttgggattacaggcatgagccactgcacccagccctggaggccagtttgaaacctcagagtattccacattgccgttgagctctcaaagcttttgctgtgttgatcctggttgttttcacacatgggcacttcgagggcatggccaggacttctacacatatttaacccatttcccatttaggaaaaaaaaagtgcagcttgctgctagcgttcatttaattttgcataaacacacttttgagactgaagtaaatctgactgattttcaatgcgaaaataaaatatgaaaactg

SEQ ID NO: 255850 - DNA, 410 bp, Homo sapiens
tcaaaataactccttgaactctttgccccacaattggcaccattactattagattcccattttatgtgaatgcacttgagtgagtctttctttccagttcctttacccttgggtactggagaacagtcaatggcatgcaatgaggtcctcttccattcttctagatatataaattctgcccaggcatccatccaggctgccagaaagtccctggaccaccacctcagcctaggacaaccttccacctctcatttctttcctactgtctttatcttagatctagacccaaaccacccaaacaatccctcacataagtgcttagcagtgtcatcaaaaacaacatccaggctgggtgctcacgtctgtaatcccagcactttgggaggccgaggcgggcagatcacctgagg

SEQ ID NO: 255851 - DNA, 406 bp, Homo sapiens
catttcttactgaaacagctgtacttggttatgttattagaggagacacactatggacttattttgacagtgaaatatatttagactaaaattttaaattactcatctagctaaggtgtgttgctattccataatacttctcaagtgttttgtgtttcaactttcgggtttctttaagaaaacaaaaacaaaaacaaagaaaactccatcaagttagaatagaatgtgagaaatttggtgtataagataaatctgtctttatgtttctccaggcaaataatgttttatactagagcaggcttcctgcctttggtatgctcagataaattaatttgactgtttatgatgttatttaattttcaataattattcaagcatatataaccacagacatctatgtagtagg

SEQ ID NO: 255852 - DNA, 429 bp, Homo sapiens
gtcatgtttactaatgtcctagcgaaaaaaaaaaaaaaaaaaggtagataggtgggtctcaggcatcatctctttaataaagctcacttgcaatattaaaaaaaaaacccactgggccagtcataatggcccatgactgtaatcccagctttgaaaagttaaactgacagattgcctgaactcaggagttctagagaagcctaggcaacatggagaaaccctgtctctacaaaaaaatacaaaaattagctgagcatggtggcatgtgcctgtagtctcagcaacttggaggtctaagttgggaggatcgcttgggcccatgaggttgaggctgcagtgagccatgctcacaccactgtactccatcctggatggcaaagcgagaccccgtctcaattaaaaaaaagaaagacctaaaaaccagcaagt

SEQ ID NO: 255853 - DNA, 428 bp, Homo sapiens
accataccaaagtgggtacccagaatagatcttctaacttatttatcttttgcaaatccaggaatgcagtgttttgtgaattttacatattcttttcaattaaatggacaagataaaagagtcaaggctttgggtaatgtctcagtttaattcaatagatagctagtgatcaataaatgtttgttaagtgagggaatgcaagtatgaaagtagaagaaatcctcaaagtatttagcacatggagagaaaagggttgattattctaactacaaatataacctcattacattgttgactacacagaagagaactcagcagtaacatatttcaggaatcaggaaatctgggttcagagtctgccaccataaagcatatgacctcagtaactttttttgtttgtttgtttgtttgttttatggcagaaatgc

SEQ ID NO: 255854 - DNA, 622 bp, Homo sapiens
gttgtaaatggacatattataaataattttataaatgtattaacttgtatatcatttgaagaacttacatagtaaccaatggataaatgaataaaacccatgcccaagtaattaaaagaagaggaaaaatagttaatatgtgaaaaggtttattcttgctggtcatcaaaaaaattacaagttaaaatgatgtattatttcatacataatatataaataataaaagtgattttcaaatgttatttcttatcgctgataaatttgtggtaaaatggtacttttatgcattactaggattcaaatgcctgttcaatctgttgtgagctatgagactttagagtagtcactaaatcttcccacatgagatagtgttagtattaaaatagtgtgcaaataaataattccaagagaattattctcttagtaatcatatataattatatataattataaataaattaataataaataatttctaagagaattctcttagaaaagcaatttagtttcaagaagtttaaaaccttatatcctttgatgacagaataattccactcttaagaatttattttcaggacataattcaatagagaaaaaatgcttaatacattatgtataattc

SEQ ID NO: 255855 - DNA, 843 bp, Homo sapiens
gcgtgggaaaccagcaagttgagagaggatccagaagtaaccccttctaaaacgggaaagatgccttccgaaagcacttggccctaaagagaaaacactaggaggatgggaaccagggacagagaagctacttgctctgcagctgtttgggccagtatgttccctaatcttgatggccatcctgggcttattttcctgagagtctctaagtgactcactgcatcacgtaaaactaagaaaaaggatgtcctgaaaaaaaaaaaaaaaaaaaaaaaaaacaacgttggtgggggcccgccgcgggaccctccgagaaaacaagctttctaaggacacactcgtggtggggcggcgcggggccccatgaggtaaacgcaaaccggtggccaaacagcgggtccccaagagaaacccggggcaagacacaagggggggggtttccccccaattaaaaacaggccgggggacgaccgggcgcttctgacacacacccaagggaagtcgggaggccccaacggggcctcctacaccgaaggaggctcccaaggcggagggccgagaatataaaaataacgcccgggagggggggatcatacgccaacaacacggcgtacgtaacatcagccacctaagacgatagcgaaaccaaccgaatcacaagagcgagcagaaactagagcaacaggtaccacacacaaagggacgcgcagcaccgaacagcacgaaagcggacagcgcaacgcccgagacgcagaacaccagacagcagaccagagaacgagcaaacagcacgagcgaaacgcaagcgaaggactagtacaagcaaccacgacgaagcacacg

SEQ ID NO: 255856 - DNA, 482 bp, Homo sapiens
gcacacagtcaatattagttggtcgagttactgatagaacaacgctcttgatccggctccagggcagaaaggggagctcacagaggaggggatatccagctaacccagtgggaaccagacacgctggcaaaccccatcccacgggctaggctttcagttaaccctctcattcatgcatgagggggtgcttattaagccattttccagataaggcaatggaggcccagagaagtgaagtgacttgcacaaggccacatggcttgtatgctgcagagctgggtcttggcctggctttctgagatcgacagcccttttcctctccagggttccaaggctgtgattccgagagatcaccacacagggaaggaatcctgacagcctgtgaagtgcctggcactgggtcaggttatttgccaaggtttgttcatgtgcctgctctgtcttcataggtctattttacagatgtcaaactgaggcccaga

SEQ ID NO: 255857 - DNA, 368 bp, Homo sapiens
taagaaaagattgcagtgggtgatgaccgcaaatgtcctgtaaaagatttgatgttataggaacatggagaccctgtgacaaggagaactcctaatttagggccaaagaggggggatggagattggccccacatccaatcctttctacctcttgagaggagatataatcactggtcttccctgtcttcatttaaatgccaccccaaaatttggaatttttattttctctcaaattttcatgtgttaccgagaagctttagactcccaggaatttcagttgggagtatcaaatacctgggcggtaagtcttgagacactatagtttatgctaacgccaacctttttcaaaattcatagtaggccggcct

SEQ ID NO: 255858 - DNA, 316 bp, Homo sapiens
accatgcataactcaaaaacgggcatcaaattctccaaaaatctgttgttctctctgtgagcagcaacaccattcacagttgctcaagacataaatctagacatcatcctgaattccttcttcctcatgccccatatccaagcaatcacaatgtcctattatcattctacctcctaaataccttgatgctatctcactcttatctccactaactaccaaaagcggaccatcatttcttctcacctggattatagcaaccaccttctaaaggactctcttgccccaatgaagttaatgacgtcgacacactgcaagt

SEQ ID NO: 255859 - DNA, 534 bp, Homo sapiens
ccctctgacatgcagtgtaatctgcaaaaagtaatgacttctctgtagacctcagtcttcccatccgtacaatgggagaaggcctccagctctctccctacacctgtctctcacggtataattaatgacctagaaaagagctttccgaaaactctttcaaatgcactctgcaactttcagcttcacagcgaccctcgtcgttgttgttatcgttgtttttcatttttaggtggccctaaagcatgcgggggttggaggatggcgctttgcggaaagcacgtgcgagttcaaatcccaactccacactttctcacgatgtgcgttccctgggacgagtcggtttggctccccgggcctcggtttccccacccgtacaatggtagtgatcgtccgttctccactgagcaggtgggaggccttggccccggcctcgcaccgttcgtccccacctatggggcactcgtcaagtgtgagttctcccctctttgctccctttgacagatgggaaaactgaggcccaaggaggggcggccg

SEQ ID NO: 255860 - DNA, 775 bp, Homo sapiens
ggccgcgcgttggttctactgctccaaagcgtgggacacggaaccggacctagacgtccccagctcccaaggcggagggaaccaagaaaggggaatggagcatgaaggacttcgatgggggcgatgggctgatttcaggcagtgggagccacggaacaagcttcaggacgctgaaaggggtggacaggactgggggcatctggggtccatgggtttttaaggctgcagtgtttgatggcacactcagcggggaggccttggggcctggggctatgagaccctttggtgaccgattttcaggggcagtgacataattagattatttgtggccaggccgggcgcggtgcctcacatccgtaatcccagcacttcaggaggatgaggcgggtggatcacttgaggtcaggagttccagaccagcctgcccaacatggtgaaaccctgtttctactaaaaatacaaaaaattagccaggcatggtggtgggtgcctgcagtacgagctactcaggaggctaaggcttgaacctggagaatcgcttgaacccgggtggcagaggttgcagtgagccgagatcgtgccactgcactccagcccgggtgacagagtgaggctccgtctccaaaaaaaaaaaacaaacaacaaaacaaacctgtgtgcggccgcgccctgggcccctgcggaaaagtttttaaaaccattcgcgtgggggcgccgcggggcccccaagggctacctggcacctggggccatacgggtcccaagggaaacccga

SEQ ID NO: 255861 - DNA, 666 bp, Homo sapiens
cagtatctctgatgaatattgtaaaaatcttccacaaaatactagcaagatgaattcaataagacattaaaaggatcttacaccatgaccaagtggaatttatctctgggatgcaaggatggctcaacatatgaaaatcaataaatatagaatatatacaatattaacaactgaggacaaaaatcacatcatttcaactgattcagtaaaagtactgacaaaacataatacctttttatgataaaaacactcaacctaggaatagaaggaaattatctcaacataataaaggtaatatgtgaaaaactcacagctaacataatcattagtgaaaaatgaagtttttcctctaagatcaggaacaaggcaagaatgcccactcatcactttcttcaacattgtaatagaaatcctagctagagcagttagacgagaaaaagaaataaaaagcatccaaattggaaaggaggaagtaagattatccctaatcacagatgacttggttttacgtgtacaaaaccaaaaaaaataaaaaataaaaaaaactgtaagaactgttaaaccaattcagccaagttgcaggatacaaaatcaactctccaaaatcacttgtgtttctgtgcactaacaattaaggaaataaagaaaatctcatttacagtagca

SEQ ID NO: 255862 - DNA, 505 bp, Homo sapiens
agatggaggatgggtctttggaaagctgggtcatggcccaacaaatgtcagggcacatgcgtccagtcatagtaagtagactttttctagaaaattctgtccaatggtagaacataagtcctgtgaataagaaacaaaagcaccaccacggtgactacggtgcaaggatcagagatggcgctgtctccttttaaagttacagatggtgcctggcctccttcccttcagggcagcgtttaacggcagccctctcttagagcaaacaaagagtcttcctttgcatacttgataacaacttatttttctcatagatcacacatgcaaacaaatataggtaatatgtaaacaaaaagtaagttttctctgccttttcagctagtctcttccccaaatcactataatgaagttgattaccgtctccaccctggcgccggcaagcacgtgtgcaggccctgctttatacacggagggtggcacagtgttcacacgggtctagattggcacg

SEQ ID NO: 255863 - DNA, 401 bp, Homo sapiens
ttagctgtcactgattcctggaataaacttcccttattcataatagtatactataacaggtatatagtggtagatttattgctaatattatattcaggatttttatatttatttatttttatacagacaggggtctcactatgttgcccaggctggtcttgaaatcctaggctcaagcagtcctcctgccttggcctcccaaagtgctgggattacaggcgtgagctgctgcgcctggcttccgtgaatctttaggctctgtaattattcaaataccataagaatgatctgtttcttgaaggtttgaaggccactcacctagaggaccatctgatgcctttatagaaggggtattttatttaaaaataagaaaaaaaataaaaggttttctgtttatttag

SEQ ID NO: 255864 - DNA, 944 bp, Homo sapiens
tctaaattttgggttctttttaaaggctagcatggaatttttaaataatagactttcattttccagactttatgaagccttttgaagaagtgacttttcccatgtgttagaaaaatcttcaatatatgatgatgatcttatttcaggcttcattctcttctgagaggatgaaattgactgaggcagtcactctgtgaattatttttgaatttaaacgaagtgcagataggatttaattgatactggctttgcaagaagtgtactcatcctcaaccatttgtttgtataatataatacatatagatagaggggcgataatatactggtagacaaagaatgcaggaaatgcccttattcatcacaccaccaagcaggcctcaccctaaagaccagcaaaagtaacaaaagcacatttggaaacccaggaagccagtaaaagtaaatctaaaggctgacagggtgtacattattatgtatgtgcaatataaatcaaattcaaagctgttttctcttaaattttgatacttatagagacaggacttgccatggggaatttctttccccttactatataattttattactagaaggaaaagtaatagcaatgataataatgaacagacttcgtgtctttattacatttgctttcctagttacctttagactgtcacttctgagttctttctctgacatgcttttcttttctcgtgaagcgtcttacattctgactaaattttgtttttttgttgttgttttagtgaggtgatttttaaaacatgctctaggtcaataagacaaagttaatgatgagcagtaaaacaattcttgaacaattttgtactttttttctttatataatatatccgtaagccaaagtctttcttgacaagtacagcgttttactctgctttcttagtttggaggatatacaagtagttttagct

SEQ ID NO: 255865 - DNA, 878 bp, Homo sapiens
gtttagttttggtatgaactctcttgaatccttctgacctactcagatcatttcacagccatgtcttttattggccatgagaagctcctaagcagtggtcataactgggctacgggggatactgattgatgaacatgtacagtgtgtgttaacttagttgttgttggctgataaacgtggtctttccaccttttttgtagacccgacccagctttgtattatgtgaggccccaggcagcctttggataaagctttttcttcagcctcctttcactggggatgccagaggcttagaagtagatactgaatgtgaatttacaggaccatagtattaagaagcttacatttatagagtcattgatggaggtggaccactacgttctctgataaagttcaatgcttagaattacttcctggcccaaatctcactagtcttctgttcaacaaacttgtttgatgctgcttaaaacacatattaacctaattgcatcatatttacaaaatggtaggagaaaagagactgtgtgtgtgtatgtattttcaaaaagttcaaaatgttttcagaagactcttcagatgcattccaaagaatccagctaatcacatcttcaattttgtaatcattgtgttcaccctgttttggcatataatactgatgaaggtttgcttttatggataaattttgatgttctaatcaggacctatatttgcaagacatggttgcttgcaaagctggatttggtcatgagtactgtgaatggaaattgatctcaggacccccaaatcactaagccaaaggaaaaggtcaagccaatgggaactgcactgggcaaacctgactcccattctattcctaaaataagatagctatgaagata

SEQ ID NO: 255866 - DNA, 474 bp, Homo sapiens
tgatgctgcttaaaacacatattaacctaattgcatcatatttacaaaatggtaggagaaaagagactgtgtgtgtgtatgtatatgtaatccattatttactgctgccatctggtttaagaagacctttatcaggtattttcaaaaagttcaaaatgttttcagaagactcttcagatgcattccaaagaatccagctaatcacatcttcaattttgtaatcattgtgttcaccctgttttggcatataatactgatgaaggtttgcttttatggataaattttgatgttctaatcaggacctatatttgcaagacatggttgcttgcaaagctggatttggtcatgagtactgtgaatggaaattgatctcaggacccccaaatcactaagccaaaggaaaaggtcaagccaatgggaactgcactgggcaaacctgactcccattctattcctaaaataagatagctatga

SEQ ID NO: 255867 - DNA, 451 bp, Homo sapiens
agcctccctcttttgacagggctggggtaccccatctcttagctctgcccagggggctggtgaggaccctaatgtagggagtgtatgtaggccgcctgtcattgacaagttctcggcctttgtcagatgttggacaaggccataaggttcctggcttggtgcagatgctggaggaggaacttggaggatggtatccatggtacccatgaggaagagctgcatcctttttggggatcaggttctaaagtcagcacagcacattagacagaaatcatgtgtaaacaacagtggctttgaaaactctgcagattaccatagtgtaaggtggatgtggttttgcatatacacttcttttacgatgtttgcatacatgtgttacatgtatactcatatataagaatgggtatacatagaagataaaataattgtaattttaaagttacattcatgc

SEQ ID NO: 255868 - DNA, 324 bp, Homo sapiens
acatacgggtttaaggaccaggaatcctgtgtgtccacgtgtgcatgcacacacattgtcactagataaaacaccacattccaagacaataacatctggctgtccaaagattacttctggttaaagtcgcaaataatcagtattgccatatttccctttataaagtacctcttcacactcttccttgctcaatgcttaaaatgtcaacatttacttaaaatgttgtgcaggctgggcacagtggatcaagcctgtaatcccagcactttgggaggctgaggcgggcagatcacctgaggtcgggagttcgagaccaacctaacc

SEQ ID NO: 255869 - DNA, 648 bp, Homo sapiens
cacgcagctcggggtcgatggcaaagcggccgctggtgaagagagagctggcggccacacctaggggtcagaaggggtgtcagggagccccagtgggtcaggctgcttgggcaggagtggggaggagggccaagagagtaggctgcgagtagaacctggctgggactcactgaggcctgtctcgttgcgtttgtagtgctccccgaaggacaccagcccaatggagatggtctgcaggaatggccggatggcaggcgtgaactgtggagagacgcggctgcgtcacccaccgctcaagagagggatggggacagggcaggagcgaggcacagggatgtgcggggaagacacattcattcagtaaacgtttcatgagctcctactgtgtgctgggcatagctctcggctggttcacggacctgatgttctcaaagggaaaacaaatgatcagcagataagcaaagccacgcgcagtatcatgacaaggaatgacgaatggtttggaaaaaaaaaagggcagtaggtggggagggcaccagtgatgactaggggtcaggctacttagcgggtctcggaggagagatctgactgaagcgaggggagggtgttccctgcacagggaacagagagcatgaaggcttaaaggtg

SEQ ID NO: 255870 - DNA, 514 bp, Homo sapiens
tggtccactccgcagaggcccgagcgggctcgcgagggaacgggttctccgagtctggccggtgctccccgaaggacaccagcccaatggagatggtctgcaggaatggccggatggcaggcgtgaactgtggagagacgcggctgcgtcacccaccgctcaagagagggatggggacagggcaggagcgaggcacagggatgtgcggggaagacacattcattcagtaaacgtttcatgagctcctactgtgtgctgggcatagctctcggctggttcacggacctgatgttctcaaagggaaaacaaatgatcagcagataagcaaagccacgcgcagtatcatgacaaggaatgacgaatggtttggaaaaaaaaaagggcagtaggtggggagggcaccagtgatgactaggggtcaggctacttagcgggtctcggaggagagatctgactgaagcgaggggagggtgttccctgcacagggaacagagagcatgaaggcttaaaggtg

SEQ ID NO: 255871 - DNA, 520 bp, Homo sapiens
cggcggtcgccgcagcagcagcagcaaaaggcagcggtggcgtgcaggtccagccgtctcggtgaccgtgctccccgaaggacaccagcccaatggagatggtctgcaggaatggccggatggcaggcgtgaactgtggagagacgcggctgcgtcacccaccgctcaagagagggatggggacagggcaggagcgaggcacagggatgtgcggggaagacacattcattcagtaaacgtttcatgagctcctactgtgtgctgggcatagctctcggctggttcacggacctgatgttctcaaagggaaaacaaatgatcagcagataagcaaagccacgcgcagtatcatgacaaggaatgacgaatggtttggaaaaaaaaaagggcagtaggtggggagggcaccagtgatgactaggggtcaggctacttagcgggtctcggaggagagatctgactgaagcgaggggagggtgttccctgcacagggaacagagagcatgaaggcttaaaggtg

SEQ ID NO: 255872 - DNA, 508 bp, Homo sapiens
ggccaggacttgcctggagccatcagcccacattcactcagctcttattcagtctgacccagccctgaagctcatcctgaattcaactctgattagcctcccccaggcaatcaatagatgcagagtttgagcttggatttgtgacttttctcattttcccaatttccccacatcctcctgctcctgcagactgaccatcatcaagctccagccacaaaccaatcagaaattaactctacctgggcctgacttagtggtccacacccttcatgcttgacatccagccccacgctagtgttaactttgagcctgatccccaacccacagccatgtgatcatatacccgtaacatcatgtgcatcaacctcaccccatattccacaaactagttccaggaaacgctggtatctttcagagtgttttgggtcttctaaaggtgaagaaggagatcaacatgcttttggatatgctgtggctcatcatattaaactggttccctagtgcagga

SEQ ID NO: 255873 - DNA, 388 bp, Homo sapiens
atctttcttggaggattcttagggactttagttttagctcatgtgacaaggctgggacgccccccaaggccagacttccatgtccctcgtattactgactcaaccaagagagtgaatttttatgacagttttttccaaaccgtcataacataaaaattaccattttagtaccaatcgcctgccccggcccaggacgcctgctctttttctgaagaggttatcactacaaaccgtaaagtctgaaaatagttgcattagatgttttggtgaacacaccgtgcacgacagcaccagcacagtggtcccctgttgcttctgccccaagactctccttcctaaatcatgcaaaaggctttaggaccactgaagacacccagaatgaaggaaa

SEQ ID NO: 255874 - DNA, 498 bp, Homo sapiens
gagattagaagttcgagaccagcctgccaacatggtgaaacccggtctctactaacgatacaaaattagtcgggtctggtggtacctgcctgtaatcccaactacttgggaggccgaggcaggagaatcacttgaactcaggaggcagaggttgcagtgagccaagatagcgccactgcactccagcctgggcaatacagtgagactctgtctcaaataaaaaaaaaagttcaaataagtactctgatttctcttatgtctcatctctcatttttcctttatcttgagaatctcaaacagcttaacttcattcctttatcctaactctgtctgatttgctcatgatgaagagcataggatagtttcaaggaagctgactttttatagttattttagcaggttagaaatataattaaatattacatagtgccactgcattaaaaagtgaaggaggtccagttacatgacattctggaaaagacaaaactatggagacaa

SEQ ID NO: 255875 - DNA, 510 bp, Homo sapiens
atgtgaggagccatcttggaagcagatctgccagccccagtcaagccttcagaggactgcagccctgggcaacatcttgactaaaacccaatgagctactctagtgagaaccacccagctaagccttcctggattcctgactctcaaactgtattaaccaactgtcaaggacctcagctgccagcagacaggcctcgatgatgaagaatgtcagacacccacggcaggcaccgtgtggacactccaggcctgacccctccccgtggaaggcacaggggcagtgctggtgaacttctggatggccctgggtagttgattgctggctgccaccatcccccaacagggcaggaagaaacctgttttgtgccagatgacaaggtgagatttcctggctctgactctttaagacaaaaattgtgatttagaaagagactggcctgcagaggagcatcatcaaaacagttttgtttttctaaaaataaattttaaacagaatggcaaaattattaa

SEQ ID NO: 255876 - DNA, 459 bp, Homo sapiens
cgactccaagaaggcagtcccctgacagcctgtactgctgggtccagggccttgatgccgggaagttatttcgtttatgtttgcctgtttaaagtccccatttgcttttcttcaaggtccagcttccaagtctagttgactttttaccatcactcactgggctggccacacagtgccggaattcatgggcctccctggacaggctattttccgagacccatggaaatcagatcaatgctcgctcgctctgtgactttcatcatccacgtgctttctaaatatgaactcattcttcttgcaagaatcaggttaagcattgttatccccactttacagatgggcgtgcccagatttcattattccgaagatagattttgagtccatgataaatgtacttagcattatagtaaattgaagatgaaaaggcctaataggttacccggtattgccctccctctt

SEQ ID NO: 255877 - DNA, 664 bp, Homo sapiens
tactactactaaattcgcggccgcgtcgacggccggcgggagctccaggttcacctcctcctcctccaggaaatctcacttccaactggatgtctggatgaactactgaaagctgctgagtgtcctgcagcagcttgactaccacacaaatgaatccactcaaatgttggcaagtggagcagagtcccaggacaggtacagaaacacccccagttcaaggatcttcacacctggatttaggcctactcctgcaactaccccagaacctggaatttatatgttcaacatggagccatcccagccatgacaacagagaatgtaccactctcacgtgagtaagaggggtaggcagtgctcctgtatcaccagcccttaatgagaccctgaggaaaccacatcatggagatcagcccttctctcctgtaaggaactcatcctatgaaagagcaattagtgcctgcaagagctgtctctgggacagcggttcatgtctatatctgcagggtaacactcatagtcatatgcagtcatatccatagtcatatcgggagtcagactccagtttgactgagtgaatggagaaactaaacatttattactgaataataacattaataaaccatcttaatgataataataataaacatattgatgagtattaaca

SEQ ID NO: 255878 - DNA, 893 bp, Homo sapiens
ctcaattaacagggtagaggatgacctattgaaagattgggcattcatgtgtgggaggtaaaggcaagtcctgtgagtggtaggcagtccgaggcaagtgttctctctttttgttgtttgattctaaatttatgacaactgaagaaagggccttggcctggtctggatcaacttggtatggagcccatgagaaatgaaagatgattcataaacatacctaattcatcccaggcaacagcagaaatgaccatgaaaaatgagccatctgagaattctcaacgattcttggagaatgtcattaattacatttttattacagggcagggatgcccaagctgacatatgggttacaaaggcaaagtagaatttccctctatgggttttgttaatgtaaaatataaattaataagctttttgcttttactaatatgaaacatacccatcaattagttgtcttcaattcagaaagaactaaactagagttcgatagtatcttaaatccaaaaaataaaaataaaaacccaaccagcagccatttgctgaattcctgagtgcttaggagtctccatttctagtctagcaaatgtcttccagttgcaattttaaacatttttcccagatctttcaagaaacctgtaatagtatcaagtccagcacacaaagctagctttctgtaagcaatcagtctcatctacccacctttactttatacagcctcctaaattcaaccttagaataaaaagtacttttttgttgttaaaagtctgttctctagccaggtgtggtggctcatgcctgtagtcccagcactttgggaggctgagaccagaagattgcttgaaaccaggagtttgagatcagcctgtacaatgtagtgagaccaccatgtctta

SEQ ID NO: 255879 - DNA, 249 bp, Homo sapiens
atggtctgacttgaaagtgttttcggtaagtgtgtcttacagaaagttgtggtattaaagttagatattaaactgttcctggtaaaatattttttaaaagctgacctaaaatgattgtaatacaactacagattgaaatagttttgtggaattcaaagttacctgctgactgattgagtgtgggaaatgtttgggatgggaagaaagttgtgagggaaagaggagagttagatgacaagataatcatgg

SEQ ID NO: 255880 - DNA, 703 bp, Homo sapiens
tactctaataaagaatatcaagaaaaagtacagatgctatgaactgatatagcaagaaaaccttatttagactggggcgtgggtggaagatcagggggaggcttcccaaggaaatgacctatgtttccttccatgtctaaatgtatctctgtatagacatgaacggataatcatgaaaacttaaaggtgactatctccaggcagtggaattatgtgggattattttttccatatatatttatataatatgggaggaaggtttttctcaaccctcttagggtccctgagagagctgacacagacagattagcaggagagaagcattacgaatttatttaacataagtttgatgtgacacagaagccttcagaaatgaagatccaaagacctgttgtcccagccactggggaggcagaggaggggagatcaattgagcccaggggtttgaggctgcagtgagctatgattgcagcactacattccagtctgagagacagagctagactctgtcctaaagaaaaaaaaataagcacccgcatgccggccgaatttcgagctcactttgcccaattcgccctataatgagccgatttacaattaactggccgggggtttacaacggtgtacttggaccttggcgttcccaacttaaccgcttggagctccccctttccacgctgcggtagcgataggccccccccct

SEQ ID NO: 255881 - DNA, 438 bp, Homo sapiens
acaggagcaagtgccagctctggggttgcctgagatggtaagggcttcaccattcccctgggcccctttcacagcttagctggggcatgatggaagggtcagagtgtacgcctaggagcctggtggcttggcacagcggcttcttcctctctgagcctagtgtattcctctgtaaactggtctaagaaagtacctgtttttgagaaggatgaggagtcagtgacatgagcctatagaggctctttgttttttcttttctgtttttctttctttctttcttttcttagcctgactctgttgcccaggctggagtgcagtgacaggattagggctcactgtagcctggaactgctgggctcaatccatcctcccgccttggcctccgcctcccaagtggctgggactaaaggcgcaggccaccatgctggctaatttttc

SEQ ID NO: 255882 - DNA, 399 bp, Homo sapiens
gtacaatatgcataattaaaagaatatccatatagggaaagggaaaggaagttagctgaattatgctttctcaagcctccctcctacccccttacaattcctattgatttatttgtcttcaggtactaaacctatttggtggccagagtacagccaactgacttatgttttctatgccattcaacttcccattacatagaagttatgttttattaagaacttatcagcacggcatcaagagtagttgaagaagcacttagtgttcattttgaaactcaacgcattaagtctaaagtttcttaccagtttaaggcttaataacaacttttcccaaattcacctctttcttcagagctatttaatttatacactccttaccagtaagaagagtatcttgct

SEQ ID NO: 255883 - DNA, 426 bp, Homo sapiens
ctgagactgtctttggcaagaggggacacgtgcttggcaacggaagtcaagtaactcaggctgcaaactctggctgttctaaggccattggagccctggcctcatctcgaagatcctcctcagaagggctctctaaaggcaaaaaggctgccaatggccttgaggctgataacagttgcccgaattccaaggctcctgttctatcgaagtatccttatagctgtagaagccaagagaacatccttcagggattttcaacctcacataaagaaggggttaatcaacctgcagcagttgtgatggaagacagcagtccgcatgaagccttgaggtgtcgagtcatcaaatccagtggcagagagaagccagactcagatgatgacttggacatagcatctcttgttactgccaagttggtaaatacaa

SEQ ID NO: 255884 - DNA, 757 bp, Homo sapiens
tcctccagggcgcccacaccagctcccagccaggctgtgggatctgatcgcctctgtcctgggctgtgtccaagaatcaggtgcccagtgggtcgggatggcagtgccaggagtcctggatgggcaccctgctcccatcatcccggagatccggcttcatctccatctgggggcggggcctgtgactgccagctccagagccctatggagagctccctgggacaacagggcaggactggcaggggagagtcctggggccatcccagagggatcctgatgctcacagacctgtcccacacctgctgaggtggagcaggcgtgggtggtggccttcaagtttagggaggtggtatggggctcttcccaaggggctggagctcccctacatccaccctgggtcctccaggtgtctgagttcagagctgtatccacaagcctgagttagtccccttgtagtgccctgtgcatgcagggccctctgtggggtgggagacagactgggagggaccaggatgccacagaggctgcaagtccttgtgtggagacagctggccaggctgaaccagggagggttccaggggttccaggaggtgaagacacaggggcgccagcatggccttcccaagagggcctgtccaccttcaccaaggtgttcaggctgaggcgggcggatcacaaggtcaagagatcgagaccatcctgaccaacatggtgaaaccccgtctctactaaaaatacaaaaattagccgggcgtgg

SEQ ID NO: 255885 - DNA, 375 bp, Homo sapiens
tgtttcccagacttgcttacagcaagggacttagatcccgccagccagaggcactcccgtgagatgggcagctgtgcaggaggcatctgtcctgccgtgcaatgctcaggcacaaccagttttggagccaacagtcctgacattgactttctatccctcagacgccagccaaggcagtgcattcctggaatcaacgctctcaatagcagcttcccaatccttggccaaagtgatgtcactcagagccagcggttaggacagaggattctccagcctcagattgcggcagagttcacagtaccctggggtgggctgattctgcagggttgttttttatgtcatttctgaaggtccaattaatagcccatttctcca

SEQ ID NO: 255886 - DNA, 373 bp, Homo sapiens
tgtagaaacatagtgctaaggcataaaggtcagtacacaaaatccacttaatcctaatgtacatgaagcatagaacatactgaaacccaatcaccatgtaggtcatagtttctatggggaaaatgattttagaattgtgtattacaagccagaaatccatctcttttagctacaatgggatcacaattatgcctcccattctaaagtgtgtagtaggaagaaaaactctctcattcctgactttagtggcagttcctgcagccagtgggcctgcaagggcataggtagcatggaggattggcagaggtctttaaacctttgtaaagatgaggacatcttactaatatcatctcaccagagacccccctggttc

SEQ ID NO: 255887 - DNA, 334 bp, Homo sapiens
cctgggctcaagtgatcctccagcctcagccttcctagtagctgggactccaggtaagtgccactgtgcccatttaatttttgtgtttttttgtagagacagggttttaccatgttacccagggtggtttggaactcctgggctcaaatgatccacctgcctcagtctcccaaagtgctgggattacagacgtgagccgccatgcccagcaaggtataaattttaattaaatatttaaatgatatactcagggcagtattccaaaaaatggtaattcctcaggccgcagaagtaaaatggtgtcgacgcggccgcgaatttagtagtagtaggc

SEQ ID NO: 255888 - DNA, 427 bp, Homo sapiens
gcaggcccagccaatttttcaaaacattttttgtagagatggagtcttgctgtgttgcccaggctagtcttgaactcccaagctggagcaatcctcagcctgccaaagtgctggaattacaggcataagctgtaattacgcctggcttctttgctcctgttttttccctctgcctttgctcctgtttttttccctctgccttttccagatgtactttgtacatctgggcaaactgaggctccaagaggatttatcctcttgggggataaatctttgggaaatcttttggggacttcccaaagtcccccaagaagcatccgctggataaggtctccactcttcaggctccgccagttatctggcacctgtgtgaccttgggcaagttcactaacctctctgagcttgattttcacttcctggaaatgg

SEQ ID NO: 255889 - DNA, 485 bp, Homo sapiens
ccaggctggtctcgaagtcctgacctcgtgatctgcccacctcagcctcccaaagtgctgggattacaggtgtgaaccaccatgcccggcagtgattcatttctaaacccagcttgttaaaaggtgaggactctcctatctggactaaaccaatagtttagtttagttaggatagatgttgatgctcatatctgggcttggaaccacaggaaagatcttcttggacaaaggtcacagaggattaccactcttgcatattgtataaatcatcaagtgaaactatcataagagaacatagcacatgcgtgagattttgtcttttgaatgtacacccaggcaacagtaaagattgtcattctcccatataaacacatctcactgttgaggttctgaatgtcagacacagagactgtgaaaagttgaataattgactctcacgtggatctggactagaggtggactggtgactctcagagcaagattca

SEQ ID NO: 255890 - DNA, 4670 bp, Homo sapiens
agctgccctgagggtggtctcctgtgcagttaagtctcacctgagcagctccatgggagggggcttgccccccgcctgcacacgggctcagaaggccagggcgacagccgggcacgatgtgacagcacatccagcacacccaagaccccagatggtggacactcctctcaggagataaagtctgagacctcatccaatcccagctctccagaaatctgccccaacaaggagaagcccttcatgaagttgaaggaaaacggccgcgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccaatcatcatgagccggagtcccacagatgccaaaagcagaaactccccgagatcgaacctgaaattccgctttgacaagctcagccatgccagctctggtgcgggtcactaatgtgaaagtggagtccttcgcctgtccaagggaatcccctcttctgtcctggaaaaggctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccacaaaggggtgggaagccaggagtgagaaggaattcagggagagcaaaggagccagtgctgagatgctgctgtgttggttgaggaaaacctcgggcctgagggccaggccggagcccaggtctctgctgacaatgggggttcaaggaagacgtcgttatctcccctccccacttactcgaggagagaggtgagggggggatgacttgcgggttctgatcaggcccctgggtggggaaggggcacagtgtccctcagcagcttacgcccctggagtcttggggggcccagcctggccctggggccttttccagctactgtgcccttgggcagctgcgtctggggctcaaccccccaatcctgttcccctctccagctgcgggtctgtaggcagctgtcacatctgaagggtttctgcaacctggaccccatctgggtgtgggtcagaccctgtgacccacatgccacccccaccctccacagagcccccttgctgggacagccagctcacctccaaggacatcccctcctggcttctcccccttccgagtctgcagcgccgtgggcttctctgccgatgggcccgggttggggttaaggtgggcatcctccaggtacaacgagcctgaagagcccctttcagtgcagacggggctgcagagtgacactggctgggcacctgccccacgaccaatgacaaggatttccagctgaatgctttattcccatagggatctggacctgtgcccaagatataaatactacactttttttttttttttttttttaactgacattgtgaaattctccctatagcttttgccattcaagcaacattgtgatctttcttccccgccacgtgtgtgggaatgattgagtcctgtttgcaagctggagaggagctctcccttcgctagtactttctctaaagtactagtctagtaaaatttattcttgttagaaggtcaacaaaatatctgtttagcttttatgaagagtcaccgtagcagcccccacggctggaaagaggcccgtacgttctggacgcgttttgttggctgggcttctggaggcactggcaaggtcaaactgcatttctttaagaacagttgcaggatctggcttgcctctgtgggaagccggcattacaggtgcttggtggatgggccgtgtcacattgccatctggggtcctttggggtttccaggttgtcagcatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgggatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggcccagcctcccctccctcccctagaccacggggcgggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccagtcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggaataacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggccgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcagcttcccttttcctaaattaagaggaaaagtggtcaaagaaaaactcttcatttctccctgattcttaagcgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggagggggacatttggctggaagactggaatttaattgccatcgtctttgattttgtgacatttctgcttggaagtgtgaactaccctcccccccccgcttcctgctccttagcatgcgtgcagctctctcctgttttgggtgttccccttggacactccagctcggggactgctggcgtgtgaatgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattct

SEQ ID NO: 255891 - DNA, 5532 bp, Homo sapiens
tgctctctaaggttccccgccccttgcgcacttctccaggctgaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagggcccggaattcagggagtttctgctcaccaagctcaccaatgccgagaacgcctgctgcaagtcggacaagtttgcaaagctggaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccagaaatctgccccaacaaggagaagcccttcatgaagttgaaggaaaacggccgcgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccaatcatcatgagccggagtcccacagatgccaaaagcagaaactccccgagatcgaacctgaaattccgctttgacaagctcagccatgccagctctggtgcgggtcactaatgtgaaagtggagtccttcgcctgtccaagggaatcccctcttctgtcctggaaaaggctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccacaaaggggtgggaagccaggagtgagaaggaattcagggagagcaaaggagccagtgctgagatgctgctgtgttggttgaggaaaacctcgggcctgagggccaggccggagcccaggtctctgctgacaatgggggttcaaggaagacgtcgttatctcccctccccacttactcgaggagagaggtgagggggggatgacttgcgggttctgatcaggcccctgggtggggaaggggcacagtgtccctcagcagcttacgcccctggagtcttggggggcccagcctggccctggggccttttccagctactgtgcccttgggcagctgcgtctggggctcaaccccccaatcctgttcccctctccagctgcgggtctgtaggcagctgtcacatctgaagggtttctgcaacctggaccccatctgggtgtgggtcagaccctgtgacccacatgccacccccaccctccacagagcccccttgctgggacagccagctcacctccaaggacatcccctcctggcttctcccccttccgagtctgcagcgccgtgggcttctctgccgatgggcccgggttggggttaaggtgggcatcctccaggtacaacgagcctgaagagcccctttcagtgcagacggggctgcagagtgacactggctgggcacctgccccacgaccaatgacaaggatttccagctgaatgctttattcccatagggatctggacctgtgcccaagatataaatactacactttttttttttttttttttttaactgacattgtgaaattctccctatagcttttgccattcaagcaacattgtgatctttcttccccgccacgtgtgtgggaatgattgagtcctgtttgcaagctggagaggagctctcccttcgctagtactttctctaaagtactagtctagtaaaatttattcttgttagaaggtcaacaaaatatctgtttagcttttatgaagagtcaccgtagcagcccccacggctggaaagaggcccgtacgttctggacgcgttttgttggctgggcttctggaggcactggcaaggtcaaactgcatttctttaagaacagttgcaggatctggcttgcctctgtgggaagccggcattacaggtgcttggtggatgggccgtgtcacattgccatctggggtcctttggggtttccaggttgtcagcatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgggatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggcccagcctcccctccctcccctagaccacggggcgggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccagtcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggaataacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggccgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcagcttcccttttcctaaattaagaggaaaagtggtcaaagaaaaactcttcatttctccctgattcttaagcgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggagggggacatttggctggaagactggaatttaattgccatcgtctttgattttgtgacatttctgcttggaagtgtgaactaccctcccccccccgcttcctgctccttagcatgcgtgcagctctctcctgttttgggtgttccccttggacactccagctcggggactgctggcgtgtgaatgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattct

SEQ ID NO: 255892 - DNA, 5336 bp, Homo sapiens
cggcccctggcatccatgtgcatggctctggacgaacatctggatggagaggagcagtggggagttgggtgcgtggatgtggagctggggcagagggccgggctgggattcactcttccttctgctcctctaccaccagggtggagctgtggcagtggtgggacgacccagggagaagggcagggggagtagagcaggaggccgagcacgcagccttcatcttagctgcagcatttgtgagcacgaagctcagctcagcagtaggtccacaccgttgctgggccgggctgggcagaatgtcagcctccaggccaggtgtctggagctcacaaggagcaggcacatctctgctctcagagccagcttctccatccccaccctcttcccttctaggaccggaccagggctgccctcctggacaaccttcacgatgagctccacgcccacacacaggccatgctgggactgggcccagaggaggacaagtttgagaatggaggccacggggggttcctggagtcttttaagagggccatccgcgtacgcagccactccatggagaccatggtgggcggccagaagaagtcgcacagtgggggcatccctggcagcctcagcgggggcatctcccacaacagcatggaggtcaccaagaccaccttctcgcctccagtggtggcggcaacggtgaagaaccagtcacggagtcccatcaagcgacgctcggggctcttcccccgcctgcacacgggctcagaaggccagggcgacagccgggcacgatgtgacagcacatccagcacacccaagaccccagatggtggacactcctctcaggagataaagtctgagacctcatccaatcccagctctccagaaatctgccccaacaaggagaagcccttcatgaagttgaaggaaaacggccgcgccatctcccgctcctcctccagcaccagcagcgtcagcagcactgcaggggagggcgaggccatggaggagggcgacagtgggggcagccagccgtccacgacctcacccttcaagcaggaggtgtttgtctacagcccgtccccgagcagcgagagccccagcctgggggcagctgccaccccaatcatcatgagccggagtcccacagatgccaaaagcagaaactccccgagatcgaacctgaaattccgctttgacaagctcagccatgccagctctggtgcgggtcactaatgtgaaagtggagtccttcgcctgtccaagggaatcccctcttctgtcctggaaaaggctcctgacctcccagtgtgatgtccgggtcctttatcatcctattcatcctggagaggaaaagtgtcgggcaaagggggatctggggggagctcagcagtgactggggagctggtctgcctcagagacagagtagggggtgggagcagagcctcggtgagggtcttggccacagggcagtgccttcctgaacgtggcaggctttactaccaggaacgcactcggtggtggaggccccatgttcccaggagccaagattcgtagcatccttgaggccatcctgataaaattcggcgctattgcccccgtagctctggagctctaaaccgtctatctgcttctgtgctgaacgcctttcccatctgctgacgtaggcccagggctgccctgcccctgctgccagtgtaccgtgagcggggctccagccagttcaagctcagagccagagctggacgggccagaactgcgctgcacacttcctggactgaggcggggactttgggtcccacccggtttctcctgattatggctgctgtggggtgaggggagggaggggcagccccgaggcagtctcttccctttgagaagatattttcccacaaaggggtgggaagccaggagtgagaaggaattcagggagagcaaaggagccagtgctgagatgctgctgtgttggttgaggaaaacctcgggcctgagggccaggccggagcccaggtctctgctgacaatgggggttcaaggaagacgtcgttatctcccctccccacttactcgaggagagaggtgagggggggatgacttgcgggttctgatcaggcccctgggtggggaaggggcacagtgtccctcagcagcttacgcccctggagtcttggggggcccagcctggccctggggccttttccagctactgtgcccttgggcagctgcgtctggggctcaaccccccaatcctgttcccctctccagctgcgggtctgtaggcagctgtcacatctgaagggtttctgcaacctggaccccatctgggtgtgggtcagaccctgtgacccacatgccacccccaccctccacagagcccccttgctgggacagccagctcacctccaaggacatcccctcctggcttctcccccttccgagtctgcagcgccgtgggcttctctgccgatgggcccgggttggggttaaggtgggcatcctccaggtacaacgagcctgaagagcccctttcagtgcagacggggctgcagagtgacactggctgggcacctgccccacgaccaatgacaaggatttccagctgaatgctttattcccatagggatctggacctgtgcccaagatataaatactacactttttttttttttttttttttaactgacattgtgaaattctccctatagcttttgccattcaagcaacattgtgatctttcttccccgccacgtgtgtgggaatgattgagtcctgtttgcaagctggagaggagctctcccttcgctagtactttctctaaagtactagtctagtaaaatttattcttgttagaaggtcaacaaaatatctgtttagcttttatgaagagtcaccgtagcagcccccacggctggaaagaggcccgtacgttctggacgcgttttgttggctgggcttctggaggcactggcaaggtcaaactgcatttctttaagaacagttgcaggatctggcttgcctctgtgggaagccggcattacaggtgcttggtggatgggccgtgtcacattgccatctggggtcctttggggtttccaggttgtcagcatgctgtcccatttgggaatcccatacctgcctgtccccactgcgctggctgacccttgctgcctgctgcctcttgggagggctttgtccctgcctctgagctggtgggcaggatggctgggtggcccccagagaagcacagacctgggatggggtctccatgcccggtttgctgttggaatgatctgaacaggaccccaaatgcctcttccctctggtcatgcctcactatctctaggagctccatcctgtggcttccagagtgtgcacttccagcccacccgggcagtgctgagagggaggaggagaacaaggatggcccagcctcccctccctcccctagaccacggggcgggcagctcgggttcctggagggctgtttcccccacgctgtccctacatctgctctgatctaaaatgtctttccttttatgctgcgcccagtcttggggctcaaagatttgcccaaacctcattggccctcgtgactaggctcatctagatggtgctcacgctggtgtttgaggcatttccactgtgatctccacgaggggatgttttccgggacacatctctggctctgggaactgcctgactcactgaagaaactacttttcaggcactgtagggtcacccatatgcctccagctcagttgacgcttaaaaacaggtgcagaaaagctcgcgatggaaggtcttaatgagagtgtctgtctatgccagtcatgtaaaatgacgtttcttgaaaaagattcagtggttcagctttgtcagcatcatctcaacacaagcctgctggctctttttagcatctcatccaaccatgtcatcgtccagatgagaaatcttagcccaggtgaggggaataacttgcttgaggtcacacagctggctgttggcaaagctgggattagaaccctcaacccagggtcccttcctctgcagcgcctacatggttggttgaataagtggctgcgtttcctggggccctgggttttggggaagccagttagctgctgctttggcactggcatggaggtgagcagtcaaggatgctggtgaggccgcagtttctgctctttttcatcaggggggatagtctctaggatttttcagtgaggacccttgggctttggatgcagcttgaaccaagaaaacgaggagggaaagggattcagtgaactattcctcagtgggatcggttcttcagctcctgatgggggctgtgtaatgggggcagaggccagggaaaaagatgctgttcacccaccctcagcttcccttttcctaaattaagaggaaaagtggtcaaagaaaaactcttcatttctccctgattcttaagcgaaggtggttaatagaaactcaggctcccgtgacaaggcaggacaagagcctgtttcgctttcctccctgaccctgccaggtgccaactcaaacactacctttctcattggtttctaagtcagtagagacagatctgttttaagcagttgggggttcgagtagatctcatgggtacaggaggccagcagggaccaggccagtcagccatgctcaggacccctcggctcctcccccagcctctagctaccctgtatcgaggcaaggggaggccagtaaagtttgccaagcctgatcctgcagcctggtggggctggctggggtattcttttaccaaactctgttttaccgccagccccttgtacaccccaatcccatgtctccctcccttcagctggaccgtgtgcccctttgggaggaagaagacaagccccactagggccaagggcagcagagccctgccgagtgagaggctgtggggcagcggctctgtcctgtgccttaccagccctggggagggggacatttggctggaagactggaatttaattgccatcgtctttgattttgtgacatttctgcttggaagtgtgaactaccctcccccccccgcttcctgctccttagcatgcgtgcagctctctcctgttttgggtgttccccttggacactccagctcggggactgctggcgtgtgaatgtgcagattcccctgtgtggtcgaacctaagaactgtggcttggaagtgatgctccatgtgacgacgactttgctttctttcctcttagtgaggaggtgattcgtagatcccaactgcctatgtaatgtaaataatgtacatttaatttattgctatggtagcacattgtatttgttaatgtacaaaacaaattct

SEQ ID NO: 255893 - DNA, 636 bp, Homo sapiens
  misc_feature (508)..(508): n is a, c, g, or t
tgctctctaaggttccccgccccttgcgcacttctccaggctgaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagtgcgcntgggtgcgcacccaggcgcacttctgggagctcctcatgaacgtgaagagggggacctacctgccgcagacgtacatcatccaggaggagatggtgtcacggagcatgtcagtgacaagaaggcgcca

SEQ ID NO: 255894 - DNA, 536 bp, Homo sapiens
tgctctctaaggttccccgccccttgcgcacttctccaggctgaccctggaggaggagctatttgggaacaatgaggagagcccagcttttaaggagttcttggacctgctgggggacacgatcacactgcaggatttcaaaggtttccgaggaggcctggacgtgacccacggacagacaggggtggaatcagtgtacacaacattccgggacagggagatcatgtttcacgtttccacaaagctgccatttaccgacggagacgcccagcagctccagagaaagagacacattggaaatgacatcgtggccatcatcttccaagaggaaaacacgccgtttgtcccagacatgatagcctccaatttcttacatgcctacatcgtcgtgcaggtcgagaccccaggcacagagaccccatcctacaaggtctctgtcactgcgcgggaagatgtgcccacctttggtccacctctgcccagtccccccgttttccagaagtgcgcctgggtgcggggagtcctctagagtgacg

SEQ ID NO: 255895 - DNA, 551 bp, Homo sapiens
cagggcctgtgctggcgatgctcacaggagtattttgtttgtgttctgggaagaggaggagggagaaggtgagtagctttgtaaggagcgtggctcccgtaggggcagcgctcgtctcttccctccaggtccgtaccatgactctgtttcactcaggtctctgtcactgcgcgggaagatgtgcccacctttggtccacctctgcccagtccccccgttttccagaaggtaggacactcttccttctgcccctctcgcatccacgatgccaggtctcagtgcttgagtagcaatggttgggatggagccaaattcaggctgggaacattagggagctccttttgcaggttttggggggaacctcctttcttggggtctctccccacctctttcatgctgccagtctggcccagcataggaccacttgtcagggtgtttgacactggggttgcttttctgctgaaagacgggcttttatgttgagccccggtcaaggagccttgggcaggaatgagctccagtcgtggaagtgccactgtggcttcccagga

SEQ ID NO: 255896 - DNA, 744 bp, Homo sapiens
cgcttacaggtaggtggaggtggggatgggagattgtttacatacccagagattgatgaaataagtttattaaaaacaataagaaacagaattcttactgttggaaagagtagttataaatacaaaacaggagaaaattggaatagactatgggctatggaattggaattaaaacatcaatgttgtgttatttttctattgctgccttaacaaattatcacacactttatgatttacaatacaaatttattattttacagttctgaaagttagaaatctaacataggtcttactgggctaaaatcaaggtgttggcaggggtgcatttctttatgaaacgcaagatgtcatttttttcccatgcctttttcagcttctagaggctgcctgggtgccttagattgtgccctcttcctccatcttcaaagccagcaatgacagacttttgagtttgccacatctgcgtcacaacttaattcttgaaaaggccgtataaaatgctgcttcctcaggatgcctgctctttatcagcatccctgtctccatggtgatagccttcttgccgtaatcagagggatgacctacttaaccatggaaatattggcttcattcgagttaactttgctggtaatatgcacgtatgtgtttaattccatttttgatccaaactgccacaattgtatctgtctatagtaggttctctaagaagaatgtaaaatccgtttttgtcttgcttgcccgaaa

SEQ ID NO: 255897 - DNA, 500 bp, Homo sapiens
cgcttacaggtaggtggaggtggggatgggagattgtttacatacccagagattgatgaaataagtttattaaaaacaataagaaacagaattcttactgttggaaagagtagttataaatacaaaacaggagaaaattggaatagactatgggctatggaattggaattaaaacatcaatgttgtgttatttttctattgctgccttaacaaattatcacacactttatgatttacaatacaaatttattattttacagttctgaaagttagaaatctaacataggtcttactgggctaaaatcaaggtgttggcaggggtgcatttctttatgaaacgcaagatgtcatttttttcccatgcctttttcagcttctagaggctgcctgggtgccttagattgtgccctcttcctccatcttcaaagccagcaatgacaggtgaggcatgctcacattgcatcactaccttcctttttcacttttaaggtcccttgtga

SEQ ID NO: 255898 - DNA, 2236 bp, Homo sapiens
  misc_feature (1444)..(1444): n is a, c, g, or t
  misc_feature (1895)..(1895): n is a, c, g, or t
  misc_feature (1897)..(1897): n is a, c, g, or t
  misc_feature (2096)..(2096): n is a, c, g, or t
gcgatgttactttaaacccttaagccaacaccaccaacctgggaatactgtctcatgtgaattaatattggtcaatataaaacacgaagacacaaacccctaggaccttacatgttcaaatgattactgaattaggcctagcaatttctcctctccaatattaagagttataaaaaaaatatatttacactttcatcgaaagaacaaacagaaagggaagaaatgatttgcaatttgaagggactgagcccaaatatttctttatctctttatgtgtatgtgatgaaaaagttgctcaacaattatttcttgacatgtcaacaaaaatttaccaaaggctttggttgcaacgaaacttgatttacagacagtgaaatttgaatttcatagaattttcatgtcatgatttttttcccagtcatttaaaaaagttaaagcccttcttagctccaaggcagtacaaaaacaggagattggttggatttggcctatggggcatagtttgctgactcctgttcttcaccaaggcagcaaattagaatcatgtaacagctttaaaaaattatatgtctctcccacacacccagatgcttaggccctatctgtagaaatcaatttcctggctagatgaaaggtgagggtgagggggagtacaataaaactatgagatttgttaaatattccagatgattctaatgtgtagccagggcttaagactatagaatttagaatcaaatggacattccatagcttcctaaattttgacaagacacctattctttcagattcttggtttccgcatcgatactgttcagaactggcacataagtgctcagtattatcattccctttcactgctgcactgtacacagtaactgcttagtacacgtctgatcaacacaattctgcacaaaacatactcctctcctttaaataatttaagaaaaataaggcaagaacacatgtaaaccaaaacgcagaaatgtctgtaatgaaataactattaacacaatacattgctgtttgcagaaatgtgacaaccagcaacaaaaagaagagactccaggattatattttagaatagcagaaagggagtaacagtgaaaagatcctaagaataacatacctgtttgataaaagacccaaaacactgagagtacttccttcttctattaattaattataggtcaactatcacttgctgaccaaagaacagagtactaagtcttccagcttcctcagcatttctgcctaatgccttggggtaggtgaaatgtgcccccaaagtattgagagtctgctcagttttaaatgataaatacttgaccattgtgataggaagctttcaacaattagggtgaaaaaaaatggagaaaaacagccacttcctctaccacaaaattatgtatcgtttaaggtataaaggtttggttttcattaatcnacttaatgttgagttataaattttttaaatactatgtataattttcaggaaggtggcttaataaaaaaatatacaaaacaacagcttacctattaaccaggaacaaatataaaacacaaagtatatcagatctcgatagcaacaccaacaaaattaaaacatctagaaatatatttaataagtaatacgccagctgatatttaaaaagccatgaagtttactgaaagatatggaatatctaaataattcattctaatgtcttaaacttctaattgaaagatgccaaattaatatacgtaactagtgcaattccaattaaagccccaaagacgtttatggccaggcgcggtggctcatgcctgtaatctcaatactttgggaggctgaggcgggtggatcacttgaggtcaggagttcaagaccagcctggccaacatggcaaaaccctgtntntactaaaaatagaaaaaattagtggggtatggtggtgcacaccctgtagtcccaactgctggggaggctgacgcaggagaattgcttgaaccctggagagattcaaatgattgcagtgagccgagagagatcacaccactgcaatccagcccgggtgtcctagtgaggctgtctcaaaaaccaaacaaacaaacaaaanaaaaaaacccaaaaggacgtttgtaagtggtgtaaaaaaaagtctagagtaatttaaatatgactaacaaagagaacttattccaccacatagaaccataaagttccagtaatcacaactatgtaattaaaaaaaaaaaa

SEQ ID NO: 255899 - DNA, 4832 bp, Homo sapiens
  misc_feature (1486)..(1486): n is a, c, g, or t
  misc_feature (3453)..(3453): n is a, c, g, or t
  misc_feature (4515)..(4515): n is a, c, g, or t
tgagtttgagtcaagctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcnggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccagggcatgagcatcccagcacagccccacgcctccacccgggcaggctcggagcggcgttcggagcagcgccgcctgctgtcctccttcactggcagctgtgacagtgacctgctcaagttcaaccagctcaagttccggaagaaaaagctcaagttctgcaagagccacattcacgactggggcttgttcgccatggagcccatcgcggctgacgagatggtcatcgagtacgtgggccagaatatccgtcaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaaccccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactaggccccggcaccagactcaaaggatgtcagccgtagccctgggactcccgagcgtggagcccctggccccggggcccggccccccgcgcccgcccccatttcaggtgctgtcctctacccagcggccattcagggcctggcgccccacactaccccctggagcccctggctccggcccctccgcgggaaagggcttctctgtcgttcagcccacgtctctctcattttaacaaacgcccctttcaggatttctgtttaactccagcatcagcttctctctctccgtctctcctcccctctctctcttctctgtctcttctctctcccaccatcaccctcggcctcttcctgtgaatgctgctacgttgttttgtcttctctatttttttcctcgttgtgagaaaagacatttaaccgttgaaatgtgaaggtggaatcagagaggggccccgcgggggtctgcagaggcctcagtgtggctgtgcgtggcccgtgtcctggaagccacccggacctggacgcagggccaggtgctgtgggaaggatggaggcccccacggccttgacctcagaacactacgccctgaaagcgcccctcactgcccgtgggcacagtgaggagaccccacacctttccccacccgagctgcagcctgttccttccccagaggcctggggcaccactgacccggtggaccctgatggagctaagctgtcccaggcaggggtctccgctctgggctttccctgccacctcacaccccagcaccccctaaaccttgggttcaatgtttactttctcattcggatgccagcaacgcgggagcctctcggaggccccagtgcaggtgaggggcgctgagaacgcgggcagccactctcttctgcccttgccttcgccctgggtgggacagggctcccaagggcaggcgggtcccccagtcccgccattacgggttgtcagaccgtctgcgtgtggcattttttggcttataagcttcacccactcacccccaacccacaccccacatccccctnccggcagcccctcaacctaagaaggccagagcatatttattttcggagggagcagattacttctcccagagaaaggaaaatcttggaaaagatttaaaaacacaaatctaagccttgacggtttttttttcccttttgacccccttcccatctcttcagaatttattcccatggcttttttttttcttgtgcgtgtataaaatcaaaaggaaggggaaaaaggtttttgaagttcagaaccaacttctgtatatagaggctgccgcaaaggactttctcttgggaacattgtttcttgtagaaacatgcgggaagacattttttgctcatttctttgtacttccaaaaaaaaaggaaaaaaaagacaaaagcaagtccccccgtaccccagaaagcagaggaggcgtgtaaataatttctggaaagtgactgttgtgacccggagtcctcatcaagatgagcgcgctccatgagggagctgctcccaccctgcggacgcaggcggccggagcctctggtatctcagcttgtgtcaagcttgttatcatgtaaattctgtacaaagaattgttatttttctcttttttgttgttggtggttttgttgtgtgttttttgttgttttttttttattcctttcccccaggccctctctatttgagactgtgcccgccggtttcaagatcaaggaaattggtggcaacaagacacagatggggtacctgggcacagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataancaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcttgatgtaaatatttgttcatatttttgtgaattcaatactatgtaccattgtattatagtaacttttataaagcaaaccataaatatactgacttttcttacag

SEQ ID NO: 255900 - DNA, 4885 bp, Homo sapiens
  misc_feature (1539)..(1539): n is a, c, g, or t
  misc_feature (3506)..(3506): n is a, c, g, or t
  misc_feature (4568)..(4568): n is a, c, g, or t
cgcacatcggcggacatgcgggaccaggacaccgggaaggagaacgagatggactgggacgactctgccctgaccatcaccgtcaaccccatggagacctatgaggaccagcacagcagtgaggaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcnggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccagggcatgagcatcccagcacagccccacgcctccacccgggcaggctcggagcggcgttcggagcagcgccgcctgctgtcctccttcactggcagctgtgacagtgacctgctcaagttcaaccagctcaagttccggaagaaaaagctcaagttctgcaagagccacattcacgactggggcttgttcgccatggagcccatcgcggctgacgagatggtcatcgagtacgtgggccagaatatccgtcaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaaccccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactaggccccggcaccagactcaaaggatgtcagccgtagccctgggactcccgagcgtggagcccctggccccggggcccggccccccgcgcccgcccccatttcaggtgctgtcctctacccagcggccattcagggcctggcgccccacactaccccctggagcccctggctccggcccctccgcgggaaagggcttctctgtcgttcagcccacgtctctctcattttaacaaacgcccctttcaggatttctgtttaactccagcatcagcttctctctctccgtctctcctcccctctctctcttctctgtctcttctctctcccaccatcaccctcggcctcttcctgtgaatgctgctacgttgttttgtcttctctatttttttcctcgttgtgagaaaagacatttaaccgttgaaatgtgaaggtggaatcagagaggggccccgcgggggtctgcagaggcctcagtgtggctgtgcgtggcccgtgtcctggaagccacccggacctggacgcagggccaggtgctgtgggaaggatggaggcccccacggccttgacctcagaacactacgccctgaaagcgcccctcactgcccgtgggcacagtgaggagaccccacacctttccccacccgagctgcagcctgttccttccccagaggcctggggcaccactgacccggtggaccctgatggagctaagctgtcccaggcaggggtctccgctctgggctttccctgccacctcacaccccagcaccccctaaaccttgggttcaatgtttactttctcattcggatgccagcaacgcgggagcctctcggaggccccagtgcaggtgaggggcgctgagaacgcgggcagccactctcttctgcccttgccttcgccctgggtgggacagggctcccaagggcaggcgggtcccccagtcccgccattacgggttgtcagaccgtctgcgtgtggcattttttggcttataagcttcacccactcacccccaacccacaccccacatccccctnccggcagcccctcaacctaagaaggccagagcatatttattttcggagggagcagattacttctcccagagaaaggaaaatcttggaaaagatttaaaaacacaaatctaagccttgacggtttttttttcccttttgacccccttcccatctcttcagaatttattcccatggcttttttttttcttgtgcgtgtataaaatcaaaaggaaggggaaaaaggtttttgaagttcagaaccaacttctgtatatagaggctgccgcaaaggactttctcttgggaacattgtttcttgtagaaacatgcgggaagacattttttgctcatttctttgtacttccaaaaaaaaaggaaaaaaaagacaaaagcaagtccccccgtaccccagaaagcagaggaggcgtgtaaataatttctggaaagtgactgttgtgacccggagtcctcatcaagatgagcgcgctccatgagggagctgctcccaccctgcggacgcaggcggccggagcctctggtatctcagcttgtgtcaagcttgttatcatgtaaattctgtacaaagaattgttatttttctcttttttgttgttggtggttttgttgtgtgttttttgttgttttttttttattcctttcccccaggccctctctatttgagactgtgcccgccggtttcaagatcaaggaaattggtggcaacaagacacagatggggtacctgggcacagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataancaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcttgatgtaaatatttgttcatatttttgtgaattcaatactatgtaccattgtattatagtaacttttataaagcaaaccataaatatactgacttttcttacag

SEQ ID NO: 255901 - DNA, 871 bp, Homo sapiens
  misc_feature (754)..(754): n is a, c, g, or t
  misc_feature (801)..(801): n is a, c, g, or t
  misc_feature (803)..(803): n is a, c, g, or t
tttgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgttttgttttttcctgccgggtgttgtatgtgtggtgacttgcggatttatgtttcagtggtactggaaactttcccatttattcnagaaatctgttcatgttaaagccttgattaaagaggagttttataancnaaaaccaaaaaaacaccacctacaaacacaaacaactgtgtggccgctccgcccagaaacttttaaac

SEQ ID NO: 255902 - DNA, 817 bp, Homo sapiens
  misc_feature (700)..(700): n is a, c, g, or t
  misc_feature (747)..(747): n is a, c, g, or t
  misc_feature (749)..(749): n is a, c, g, or t
tttgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatattttagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgttttgttttttcctgccgggtgttgtatgtgtggtgacttgcggatttatgtttcagtggtactggaaactttcccatttattcnagaaatctgttcatgttaaagccttgattaaagaggagttttataancnaaaaccaaaaaaacaccacctacaaacacaaacaactgtgtggccgctccgcccagaaacttttaaac

SEQ ID NO: 255903 - DNA, 818 bp, Homo sapiens
  misc_feature (701)..(701): n is a, c, g, or t
  misc_feature (748)..(748): n is a, c, g, or t
  misc_feature (750)..(750): n is a, c, g, or t
acttaacttgccttgtagagactgtttcacagtaatcttgtcgaatccagtgggagaacgtagcaaaagcggagctggaagtttcctggcgtccctaacagacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgttttgttttttcctgccgggtgttgtatgtgtggtgacttgcggatttatgtttcagtggtactggaaactttcccatttattcnagaaatctgttcatgttaaagccttgattaaagaggagttttataancnaaaaccaaaaaaacaccacctacaaacacaaacaactgtgtggccgctccgcccagaaacttttaaac

SEQ ID NO: 255904 - DNA, 461 bp, Homo sapiens
tgggtcttatccaaggcctgcggtaatcactgcctggtgaccacttatgttcactcaagaaggagtctctccacatatccaccacagctgggattgtgctgggtcatatctgaagctagcacacatctaagtctcatccaaggcccacacctggtaagaaaaatccacatcgtgacacggaagagatggaggaagaagagaaaacaaaagaaaatgtattaataagataatgttgtaaatgctgttgcaactgcaagctgcattacgtggcctcatattttcttccactgacaaaaaagtatgtataacatactatgaatctggaaatatatggaaatatcaacttggttgcaggctgaagtccatgccctttgccattcacatcctcttccatggaatgaggactcatcagataaaatattgttttaaataaatggaccttgtgaaattgcacatgatat

SEQ ID NO: 255905 - DNA, 1058 bp, Homo sapiens
ggccattcgtggtctacttttgataattattttgtaacctttctttctgcctgccatatatttttctccttgcttgtgaattgttgtgatcttagaaacaaaaaatgtggcctggtatggtggccttacgcctgtaatcccagcactttgaatcgcttgaactcagtagttcaagaccagcctggccaagatggcaaaatcccatttctggcctggcaccgtggctcatgcctgtaatcccagcactttgggaggccaaggcgggcggatcacctgaggtctactaaaaatacaaaaattagtggggcgtggtggcgcacacctgtaatcctggctactccagaggctgaggcaggagaattgcttgaccctgggaggcagaggttgcaatgaactgagatcgtgccactgcactccagcctgggagacagagcgagactccgtctcaaaaaaaaaaaaatatgttttaacaacaaatacctattttggatttttaaactccttaaagaactaagtcaataaaagaaacatcaagaagtaatacagacattgtaatttcttgggatatatgtagtacatgaatacaaatattttaaaacatttttagccttttcaagtacttctaaaacttaaaaattatagaagtacagatacaaaaggatgaatacatgactccacttaattgaggtacctagagtagtcaaattcttagagacaaaatagaatggttgttgccaaaggctggagagaggagagaatggggagttactgtgtagtgggtacagagttttagtttggaaagatgaaaacgtactggtgatggatggtggtgattccacaacagtgtgaatgtagttcatgccactgaattgtacagctacaaatgtttaaaatggtaaattttatgttatgtatatttttaaaaaatcaacatatacgcccctccttatgcctgcagaatcatcccttatttttttccctcagctcagagatggcagctgacctcactcttttagagtgagaccccaaaataatagtttatgtgatataaatttaaa

SEQ ID NO: 255906 - DNA, 396 bp, Homo sapiens
tttaatcatcaagcacatctacttttttctaatggttcatattgatttgaaactaaaaacattttgtggatggatgaaatttattaatcttgctacaaatccttcagaaaatttgaccattaccccatttgggagtattcatttccatgtagcattacatcaaacatgcaacacacattatccttatcacaaagtgtaatacagttgacccttaaacaatacgagttcaaactgaatgagtctacttatgtgtggattttctttcacctctgccacccatgaaacagaaagaccagcccttcctctttctcctcagcctgctcagtgtgaagatgacaagggcgaagacccttatgatgatccacttacacttaattatcagcacatacattattc

SEQ ID NO: 255907 - DNA, 2515 bp, Homo sapiens
  misc_feature (607)..(607): n is a, c, g, or t
  misc_feature (1386)..(1386): n is a, c, g, or t
  misc_feature (2303)..(2303): n is a, c, g, or t
ctttgcctttctttaattgtgtcaccttctttgttagagaaacccaaatcttctgtttcttgaagaagctgctttttttaaaaatgtatcttttagatacctattgtggaaataaaacaacttgtggtttttttttaagagaaatgatggtttcttatatggagagaggctagtagcgaggcaaatatttatgcaaagatgtttgctccaagaacctaaactgaaaataaaattagactgaatttttagttaaagctgcacctggattgcatgcatatttgaaaacattatataaggtttaacaaatgtatgattagagcattgaccagtgttattctgttaagtagttttgcaggattttctcttgcaagaagaatttgttgtactcgcattattgtttcctttgggatcgtagacaatgactctgtagtgtgattcattaatattggttgtcttcagcagagagtatccagatttgacctgccaagtattaaatttttaatgtattactagttctttcacagagtaaggcttgtctttgttctttgtatttttgtaccagtatagcttgaatcagatacagatttaatttgtagtatcactaaanatgcctcatttaaaacacgcacaatacacatataaaaatgtttattgatgaaaatatttcaatatgaatagctacctttttaaatatttgaaagtatgcacttccaaatttattttgaaaagtgccagggggtgctgtgtgctatgtgcaataagttaattattatgctattaacattgatgatggtgaatgtatattagttaatgtgttaacgacgtgttaattactgtacatgttgtgaagacccttcaggcttgttctatgatgcagcatgtcaacttgaactagaccaagtaatctgcaaagcagactgtaactcttaaaaataacacttgtaaacataaattataaattaaattatgctttttattattctttttctttctggtagaatgaataagtaattcttctgctatctgcacctgttagaacccaatactgtcagactctgttttccccaagaggattgaaagagatttgttatgcaataacttccgctttgtttacgctctggcatttagtgtatattttatatagattcatttgttttgcagcctgaaagatctttctttttttgtttaccagcttgatttgaaatgaaagacactcacacttagtctttgtgtaagcaggtgaaaagtggccttgtttgattaggactactagttgatactaaactaatctgtatatacacatgtgattcagttatagctcttcaagtttagttggccaaatagttgaaatctcaagggaccagacataaaaacaaaaaactcaangacagtttcaaatcatttacaacagaggccagaatttgttgctgtttgtgagaacatggcattatatatttgttgtccttttcatcagtatatcttgatgccttgaaaatgtcaaatatttgaattttattactttaacttttgaattagtggttgcccatttctttctaattgtcagtatttttgaaaaatacacctgatgataatcctcaagagactaatttggagaaatacaaaattatagaattcgatgttattcatacaatggtatttcttatttttatgtcttcaaaatctttgtttcatattaaacaaaagaagtaagttaacaaatgagagttcccaaatttactgagggtcttgtgaggatgttttttaaatgacccaaaaccaactcttgaaaatacaaaaataaaatagaaatgagtgtttctgtaaggcatttactctgtcttttagattcttctaacataatatgtataagaggtggtaaagagttagttcagactgtaaagccagactgtcctgcatccagttctagctttttcaccttccagctgtgtgactatgagcaatggatctaactgtggtgtgcctcagtttcatgataattaaaatgggcttaataatagtacctgccttacttaggggtgattagttaatacaggtaaagtactttgagtagtgcctagcacacagaaagctctcaaaaaatgtgaggtcttattattaacctgcctttgatattatactaaaaattatttggaagcatttaattttcacaaactctttgatttccctaggacccattttgaatgtgagtttttggtttccagtcattatagtctcgtacttcatcatagaaaaacaccttatttttaatgatggttttattactccagtgttgtttacatccncctggagtcatcccagatttttccattcgtctaaccttgcttgatttcctatagcacagctcttgttgaagatttatattggtgtggaaggatattctgaccaggattttggtttctcttgcaaatatttgtgtatctcttgtttacagccccagtgtcctcttgtaaaacccatgcaaaatgggattctaataaatcttgtgctcagcatt

SEQ ID NO: 255908 - DNA, 545 bp, Homo sapiens
gctctgacggtgatgataatggggagcatgtgcactgttatgccttacaagaagcaggccatccctaacatttcctgtttttctctgaattttactgaaccaacatttttaatcttttttaaaattgtatttttaaggtcgatttactttttctttgttctaacctacctaaagttttaacggtgattgtttaccagtaacatatctggtggtaggaagatgaaattaggtggggcagttgaagctgtatgcatggatggatgatggatcattcctaagtgaaaaaataatatctgtaaattccaggccagtttcattctagaagatatatattttcttgcctaaagtgattggcttttcacttttaagtggctgggtccatttgagtctgacaaagcacttggcctttgaagtttttggtgatcctttgggtgacgtcttttcacaaagcttcagcattcagccacttcgtttcagtggcatctgtaagatactctttaatatgaagatgttgaattaaaagtcaaaatactgatgtgagttga

SEQ ID NO: 255909 - DNA, 565 bp, Homo sapiens
acagagaaaaaagggatcaagttccaccattatgcaaaagggactcctgtaagccaggtgaagaaggggcaaggcccttcttggtcagcagggataaggcagttgcgtatgggagagcatgcgaggagggcgagggctgggggagatggagcaggaacatttggttggggctctgaggcactcttctgcttggggagtgtgtgggcaaaggcaggggctgtgcaggaaggatttagctaaagccataaagctggaagagggtttggggaacggctttgaagttacatttgttttgcaagttctttgtttttattaatgtttgcatgttatttgggtagctgtagggagtaggttttcggggagttaaagtgcactctctcacccctccttcagtcctactactgcccctagatacacaatcacctcaagtgactttcacgtcaccaggaatgggcaaagtctagattttggaacagaaaatattttaggtccccgtccctctctgtaaccaataaccaatgccatataaatggaaaagtataaagaagtccagaaattcttaaaa

SEQ ID NO: 255910 - DNA, 382 bp, Homo sapiens
acagagaaaaaagggatcaagttccaccattatgcaaaagggactcctgtaagccagaccctgagccgttgtcaaaacacagcttaatccccattccctgggcccgagaccctgcagcccccacgctgcccggcttccggtcttacctggggcaacctgaccaacaagaacgcggaaggccaggagccaaaaacagagactcctgatgggtaacagaaggaaaaggcaggacatcccagtgctaaggagagtgacctcagacaccagagacacagcaagtgcagcagagctgacggctctgggaacactggtcttcaaagtcttccccgttgttggttttgttgtctttatttacaaataaagtaaatatttcttatttata

SEQ ID NO: 255911 - DNA, 280 bp, Homo sapiens
ttgaacaaactatacgtgatatcattctgtagcatagttttacatctggattcttattgtcaatataatggctctgaaattatttcggttgttgcttatatcagtagttcatttttaacagtatcattgaggtataattgacacataatcaattacatatttgaagcatacaatttgataagttttctcatatgtattccccccagaaaccaccaccacaatcagataatgcacatatccatcacccaaaagtttttgtagccgtaggtaaccttcattt

SEQ ID NO: 255912 - DNA, 846 bp, Homo sapiens
ggaaatctgagagcctgactgctacttcaagggacttcccattcctctctctggattttccctccaccctcaaccttcagttaggtggtgccttccatagctcagcttctcccaggttctgcagtgggaatcagcttactccttaccggactttccccttcaattctctctggcattaagtttctgcctgttctgctctgccagcagccagcttcagctcaacaaagacaacaccctaggggctggtgaacagcaggatggaaaggacttgggtctctaaatgaacacgtgaagcagagccacccaccatcctggaccattcgcctccagactattagagacagggtttctccatgttgtccaagctggtctcaaacctctgagctcaagcaatcctcccgcctcagccttccaaggtgctgggattacaagcatgagccactgcacccagcccaaattcatctttcaaggtatagtttgtggctaaatgaaacgcatttgcttttattaatgattttaaatgtcctttgtttgggtattatttcaataatagtaatgaatctacatctatatccacatctatctccatctatatctatattatatacaacatatataatatataaagatgtaatgtattaacactatatataatatataaacccttctataatcttgttacaattctttgagatgaatgaaaattctatattcatagatccaatgttatttttaaattaagtccatttaaaattacaaattgtatgattctgctcttatatcatcaaccaacctaagataaattacaccattcctttatttcagcagcccataaaatgccaatgc

SEQ ID NO: 255913 - DNA, 391 bp, Homo sapiens
tgcttctgaggcaaccatgtgacctagagttatagtaactacaagatgggctcttgtgccatcaaggaattccatgaagtactaacaggagaataatggccactctcatgctacaaatgggccatttcagcatcacaccaaaaagttttcaatacaataatttacgctctgaaaagaaggtacttttactaaatagggagaacaaaatgcaagcacgcaagcacacccatcagtgaatgactccgagcgtccataactttctaaacaccaaactaacaaaaatgattgacgcatggtaagtgctcaagcgtttgacagtttgttattcaacgcccaatgtgcaaatagtattaacatttttgtccattaagataaaattttggctaacatc

SEQ ID NO: 255914 - DNA, 424 bp, Homo sapiens
ttctttttttttgagacggagtttcactcttattgtccaggctggagtgcaatggcgcgacctcagctcactgcaatgtccgcctcccaggttcaagggattctcctgcctcggcctcccgagtagctgggattacaggtacccgccaccatgctcggctaattttttgtatttttagtagagactgggtttcaccattttggtcaggtaggtctcaaactcctgaactcaggtgatccacccgcctcagcctccaaaagtgctgagattacaggtgtgagccactgcgcctggctggatgcctacatattaatgagggttacagaagcctctggaagcagcttgtacttgtgacatcttcaggggatgggaagtgccgtgaagttttagactacagcttggcagctgggacctgaaatctgga

SEQ ID NO: 255915 - DNA, 183 bp, Homo sapiens
atttcaccaattatattattcatttcctggattgctaattgttttttgttttttgtaatcacctgttcctatttcaaggatactaatactctccctttctctctgaggatgttacagtttaagtcctctacctattgtgttaactctgtttcctcagtgatgagcctccaagcctttctcaag

SEQ ID NO: 255916 - DNA, 439 bp, Homo sapiens
tgcctagtgagaaagcagccatgagaaataaacaaggacatcagagcagctgtgtttcaataaaactttatttacaaaaacaacaggggaccagatttgccaacctgtgatataagccttatatattgattcaactaaaaatagctgggggtggctgggcacggtggctcacacctgtaatcccagcactttgggaggctgaggcgggtggatcacctgatgtcaggggttcaagactagactagccaacatgatgaaaccccgtctctactaaaaatacaacaaattacctgggcatggtggtgggtgcctgtaatcccagctactcgagaggcaggagaattgcttgaatccgggaggcagaggttgcagtgagcagccaatatcgcaccactgcactccaacctggacaaaggtgaaactccctctcaaaaaaaaa

SEQ ID NO: 255917 - DNA, 189 bp, Homo sapiens
aagtctttttgttaaatctgtaactatctcatccaaatgccaaggggcacaagtctaaatcctttgcccctttcaatattccttacctcaccaattgataccaccaacccccaagttgattgagtctaaaaattgcagttatcctagattcctttgccttccgtatgaacaaaacaattctttctatgt

SEQ ID NO: 255918 - DNA, 532 bp, Homo sapiens
aagttggtgttttgaaatgagacaaattaaccttaatataagaaatttatgagaaaaatttttttgataatttaaggggaaaaagacaagaaaatagcaagaaaaattagcatggctctgaaaaatgggaaagtaacaaaaataaaatcaatgcttcccattcaagaaactgaaacaattttgcaaatagctccctaattctaaaaacgaatagataccatgtctattattaaaatgtagattagatattttagcagtttgagcagagcataaagtagttaacagtgaagctttttaaaaccaacttatcatacaacaccttaagcttattctaacagtaaccatgttctctttcaggtcacctcactatgccaataaaaaattttcaaatcctacatggttacaatacttagagcaagtcaaatatttcatgccctcctctccccaaccactgacatcaactaaagggctcctactttgctaatgcagaattgaccttacacacatccccttccctatggttttagtgata

SEQ ID NO: 255919 - DNA, 269 bp, Homo sapiens
tttttataatctgtggttatacatataatcagtgattaataaatacatatttcttcagagcaagtataaaaattgctattccttataaatcttttttttattattatactttaagttctagggtacatgtgcacaacatgcaggtttgttacatatgtatacatgtgccatgttggtgtgctgcacccattaggtaaaggcctttttaggcatctttaaagtggtgttcattgggggaagctaagtaaagcatacagaaaaactctctg

SEQ ID NO: 255920 - DNA, 425 bp, Homo sapiens
caacaagttttgcctagaaatgtggataaaaattgaacattgttttaccagctgccagcaaaaaggtttgtcatgccatttgttcaaattatagtacccttgaatttggtacccaagtatgaatcattagaatagccagagagggctgggcgcagtggctcacgcctgtaatcccagcactctgggaggccaagatgggcggatcactaggtcaggagatcgagaccatcctggctaacacggtgaaacccccctctactaaaaatacaaaaaaattagccgggcatagtggcgggcgcctgtagtcccagctacttgggaggctgaggcaggagaatggtgtgaacccaggaggcagagcttgcagtgagctgagattgcgccgctgcactccagcctgggcgacagagcgagactccgtctca

SEQ ID NO: 255921 - DNA, 409 bp, Homo sapiens
aggtgtagcctgactcataacatcactaaccctactaccaatggtgatgtgtaagcactttgtgctgggttaaagtttcaaacattttcttatagagattagatgatctaagcagtagagtcccttaaatcaaggttcagggccaggcgcggtggctcacgcctgtaatcccagcactttaggaggccgaggtgggcggatcacgaggtcaggagatcgagacaaccccgtctctactaaaaaaaatgcaaaacattagctgggcatggtggtgggcgcctgtagtcccagctactagggaggctgagacaggagaatggcgtgaacccgggaggcggagcttgcagtgagccgagatcgcgccactgcactccagcctgggcgacagagcgagactccgtctcaaaaa

SEQ ID NO: 255922 - DNA, 423 bp, Homo sapiens
aagcaaaataagccaggaatagaaatttcaacaccacatgttctcactcacgcagaagctaaaaaaaaaagttgatcttatagaagtaaaaagtagaacagaggatactgcaggctgaaaagggtagggagaaaggaggaatagtaagagatttgttaatggatacaaaattacagctaggtaggagtaataagttctagtgttctatagtaccgtagatgactatagttaacaatactatattatgtagtttaaaatacctaggagtagtttgaatgttcccaacacaaagaaataataaatgtttgagatgatagatatgctaattaccctgatctgatcaccatctacatgtactgaaacatccccgtatagccatgaatatgtataatctttgtcaatttaaaaagtaaaaaaaaaaaa

SEQ ID NO: 255923 - DNA, 271 bp, Homo sapiens
tatgggaccactatcatatatgtggcccattgttagccaaagcgtcattatgtggtgcatgaccatacatgaattgaatattccccactgacatatccatttttagtatttttgtaaattggcctaacggttatttgtgctctatatgcacaaggtaagttattttatccccattttacagatgaggaaatcgttttaaaggacttaaagcattgtcattgcttaagaccagtggtattctcttgcattattcctttaagccagagataaa

SEQ ID NO: 255924 - DNA, 479 bp, Homo sapiens
cgagctcaagctgatgctcggtgaaactgaaaaaggtcaatgcattatactcttgctagctactagttactgtcctcagcagatactcttgttcatttttatgtcctctactatgtctaccataatgtagtgagtactaaacaagtgtttcttaaacaaatggattgaaagaaaataagctcttctactctctaatggtaagagatgtattagtaaatgtccctagtgattataatattgaaaccaaaaagacaatactgtttttatttatttcctgtaatataatattcaaaccatatttgtgtggatgcagaaaaaaacagatacatatgaaatgttaaacagacaaaattattcaacagagctggtaaacgaaaatcacttaatagtgccacattttatttaacagcaaaaccctcagaggtaattcctccctgagtgagagccacagtccagcaccacagggagaataattggag

SEQ ID NO: 255925 - DNA, 701 bp, Homo sapiens
cccagctagtttctaatcacatgatctccttcctcagtgtttttcaaatcactgtaaaatttgcagaacaaatgaacatttattcacctccaacatctataactgatgctaattgtccccaaataaatgataaatggaattagattctgtttgtacacttgccaggtccccaaaaggttaggtatgagcttgtttttatttttactgtaaatctgtttttaagcacacttgcctaaatggttgcctaatcattctgggaagtatcttcattaaaacggagtgattatctgatatactctcataagtccagattttgacatacgtgcttaaaatgctagccccacatcattaatgagagtgagaaaaatgaaggtagactaaaaacagcaaaaaatacttgaactttcaaaatgctacaattttcactcacttaacatagattatcccgtttgactctcagaacaatcccatgaggaaggaagaggatttattacttctgttttccaaatgatgagattgaggctcagaggtttgactgctccagcttcagagtaggaagagatggggaatagaatagactaggaaccaggtcatccatctcacatttcccatcatgttccttcccatcactgtgtgatgcagggcacatgaatgctaagtgttgtcacctggatcaatgaatgagtgactgatgaatgaat

SEQ ID NO: 255926 - DNA, 537 bp, Homo sapiens
agtatttcttagtcccctaccaaatttaggatgtgtaccatgttaggaatactatattttttcccaggagacctgcacatattgggtgttcacaccttggttcctactgagagtcaaaaattggggttttgggatttgaagcagcttgaaaactcatttgtcagagctcattagagtcagtattgatcagtgactctcagaaggcttggaatgcccaatcagagttgcaatgcatagcaaagaactcctgagtttcaggggatgtcattttgtaaggttctggtggaaagacactgggatcaaagggaacactgagggtctagaaataagttctccatttaaatgtcttattttaaataatggaaacacacttcaacatagtttccttcttggagttgaaaactcgatagtcctcatagaaaaggaaaaaagttaaacctcgtcttcaaataccaaactcaggtaaaataacactctgctgttcatagattgttgatcattataaagatgcaaaataaaattctaagagatgttggc

SEQ ID NO: 255927 - DNA, 566 bp, Homo sapiens
agacgcgactcccgcagacacgtgacctcctcccagccgccgcttcccgcgacccagatccgtccccggaacccgtgcccggcggggcgggccgggggacacgtagcgggcgccccagtccctgctgcgccctggtgcatgtacctttggcgttcttctcccctcggttcacttatcaccggcaataatcaacgtttcagagatcaccccggggagaatgagcacacgcggccccaaacgtcgtcatctgctgctgtgattagtggcaccgcaattccggctgctgcggggaagtttagttggcccagggacgccgtgtcaccgaaagacacttggattgcgacattcggacccagtgacaacgttttcatgtatcttaaatccttcaaggagcggattgcaagttgcttcttctcgaggcaacctctccacccagcgccaaggagtccctccaggccaccgatcacacaatcggtggaaaagcaaaaagccacgttcacattcctgcaccgtaacaacggacgaacccagggagtcgcattttggagccaaggaagctcaggctg

SEQ ID NO: 255928 - DNA, 659 bp, Homo sapiens
agacgcgactcccgcagacacgtgacctcctcccagccgccgcttcccgcgacccagatccgtccccggaacccgtgcccggcggggcgggccgggggacacgtagcgggcgccccagtccctgctgcgccctggtgcatgtacctttggcgttcttctcccctcggttcacttatcaccggcaataatcaacgtttcagagatcaccccggggagaatgagcacacgcggccccaaacgtcgtcatctgctgctgtgattagtggcaccgcaattccggctgctgcggggaagtttagttggcccagggacgccgtgtcaccgaaagacacttggattgcgacattcggacccagtgacaacgttttcatgtatcttaaatccttcaaggagcggattgcaagttgcttcttctcgaggcaacctctccacccagcgccaaggagtccctccaggccaccgatcagtgagcaaacaagtctccaaaatttcctttgggactcaagtttacccaccgcgaattctcttttcacttcctttctatggttcaaaccaacagcacaatcggtggaaaagcaaaaagccacgttcacattcctgcaccgtaacaacggacgaacccagggagtcgcattttggagccaaggaagctcaggctg

SEQ ID NO: 255929 - DNA, 422 bp, Homo sapiens
gagctgttacatgtactcactttcatgacatttgcaaattcactctttctttcaggtcacttatttgaaaatatgaaaaggcatagattcctaacaccaaccaacaatgttaataaattgtatggaaagggttgatataaaggctctacagtgaaaggaaggaagctggctcatacttagcaacattctacttagctgtctttccactcttccatattctctttgattatattagtattaaattttcttgattttgtcagtataagtaggaataccactgccattcctagtgtgcttggtttaggtaggctggaatgcagtggtatgatctcggctcactgcaacctgggaggcagaggttacagtgagcccagatcacatcactgcactccagcctgggcaacagagcaagactctgtctc

SEQ ID NO: 255930 - DNA, 428 bp, Homo sapiens
gtcctctgctattctgaaattctatcctcaccattgacactatggagcccggttcaatagagccacttcccctacaacgaactccagcctacaaaggtcaccaccactgagcttcccaacaaggccagtgccacctcactagcacatttcttattgctattatgatgggaagacctctggacactccggagaacaacagaagctggtccatataatgaattcatgcaatcatacccacctccacgtgccttttgactcattcttcaatactctgccgaggaagttctggcatccccacttcatttactaaagaccatcatttttccaagcatcagctccagatgtccttgccaggacgctaaattctgagtcatgggacagtgtctccaaatcattgctcctcctttcccaatcttttccccacaagt

SEQ ID NO: 255931 - DNA, 212 bp, Homo sapiens
tgatttgtaaactctaaagtgctgtccacgtgctttggaggaaaaagctttcctcaggactggcctcgtgagctggtcaagcaaacagtgggactggggctgtcttgattgattgctgactttgagtcagcctgggcgggtgacgtctctattggataaatgtgaaaaccaaggctcacaatggttaagccacatccacaaaggtgcagggc

SEQ ID NO: 255932 - DNA, 416 bp, Homo sapiens
attctttaatgcaaatgggtgcaaatcagtagaactaaagcgacaaaataataaacatgggcttcaggatataatatgtttatatggtttttaaactgttttcgggcagagtttgatcccatatcataacctgaggattgatttaaccctcttgtgatgagggattctttatttttgaagtgggatacattgaacttgttagcgtgtctatgctagtagaataagtagtcttttttaaaaacagctaatcagttcatggtaaattatttgctttgcacaggactatggtaaacctagtataaatattaggcatagcactccagtagggaagcattcattagttgaatcattttgacctgatccataggacgattggtttaactaggactatttttaccacgaattaagacaaacta

SEQ ID NO: 255933 - DNA, 160 bp, Homo sapiens
tgtgagggccatatatgttttcctggagggcggacctgtgactcctcagattccaaaagggatccaagactcccaaatgctcaacactcattgtttgagtagccgaaatgttaattgcctagcatcacctgaattagccattctcttaagtgtttagtct

SEQ ID NO: 255934 - DNA, 438 bp, Homo sapiens
aaagaagtttggtctggcagttccaaaagacatcagtgaagaggcaggtaactggttaatcttacttgacaaaacctattactaatgtgctactgatgctgttaaagaaagacttggccaacttcaagaaaacacatcgaatttcctgagtgacaccaagtccatcagatcatcctgggcataattggaaatggtgcctgcacttttaagaagcgaaccagtgcaacgactggttgcaaagaagagtttctccttagctttgggtgccaactagagacctgaactcagaatatcatcagatttggtctacttccttcctttgttgtctatctggtcctttcaagtactacatggagctaccagccaaacttgtgcttgagtgatgtggctctttcctcccaggcaggcaaataaattcagctttgtttcagatgactg

SEQ ID NO: 255935 - DNA, 325 bp, Homo sapiens
aaatgtatttgtaatgatgtaactcatctgcatattgagtgaatacccattacacgaaggggtaagttcacattctagcgtgacacatatcttatatggtttggccccattttatctcttcatctctttcctctgtgttccagttttacgacatcaccttggcacccctcaattgccatgttgtttcatgccttattattttacacatgctattgcacctagagtctttgtatcctgactctgcactttgtctgtccttcccaatatggccccattatggcagcattttctatgcttttcagataaaactgattgttctctcctt

SEQ ID NO: 255936 - DNA, 278 bp, Homo sapiens
cagtggaaggtgccggcttcagcattgaccggctggccgagttctccaaggaggacgacgagtacgaggccttccgcaagaagatgatgctggcctaccgcttccggcccaaccccctgaacaatcccagacggccttactactgagcgttctggaaatacatactttttgaatgaccacccgtccctggactgtggaatgttccggcctgcatttttgccccccccttccgttgtcacgagtgccatgccgtgtaataaagtcccagtgttcttcca

SEQ ID NO: 255937 - DNA, 414 bp, Homo sapiens
caggctggagtgcagtggtgcgtgcaatctcggctcaccgcaacctccacctcctgggttcaagcaattctcctacctcatcctcccaagtacctgggattacaggcatgtgccaccacaccccgctaattttttatttttcgtagagatggggtttctccatgttggccatgctggtcttgaactccttacctcaagtatccaccccaccaccccccgcctcccaaagtggtggaattacaggcatgagccaccgtgcccagcccaactctgcttcttttctatttatgtctccatgactccaaagtttgtctgattcttttattctttttatggctagctctgtggctttacattaatttgtttatttatatccagcctgggtgacagagcaagactccgtctcaaaaacaa

SEQ ID NO: 255938 - DNA, 452 bp, Homo sapiens
gcttcatgcgttagtcagtgtctctgttaggagctgaattgtgtccctgcaaaagggatgtatttaagttccaaccccttgcatctcagaatgtgagcttatttggaggtgggatcttaaccgagtgtgactggcttccttagaaaaagaggaaatttggacacactcgtacagggaaaaggccatgtgaacagccacctccaagccaaggagacaggctcagaacagattctccctcacagccctcagaagaaaccaaccctactgacgccttgatgtctctgaattctgcactccagaaccgtgagagagtcagtttctgtgaagccaatcagcttgtggtactttgttatgttgggcctatgaaattcatctactgttactagcctttcccaaatatttcagtccatgaaatgcacccagcatggcaactcttcaacttacagaaatgg

SEQ ID NO: 255939 - DNA, 342 bp, Homo sapiens
ttatctgaggattaaaatagccctcttgcagtgctcaacattaaagtcttccgcatttgcaaaattgcaaacagatgcaactcaagtacctgcaaataatctgccaagaccaatttcaaaagggagatttcaaaatatgtggaagtcattaggacatgtattatttttgcaatgaataggcgccaggagtgtctcaaggagcagatgggtgctactttgtttataaaagatcaacagaatattcggctgtaaatgaagacatataagctatatgaaacaattatggtaaaatggcgaacatttcaaagctaattgtaatggtcttttaagatctgaattcct

SEQ ID NO: 255940 - DNA, 645 bp, Homo sapiens
agacacaggggagaatgccacatgaagctggaggcagagattggagtgatacattgtgggaaccctcagaagataggaaaaaagcatggaatagattctccctcagagttccagtagttgccaaccctgctaacatggttttgcacatctagcatccagaacagtgagaatgtatttctgctgttttaaggtacccagttcatggtaatttgttacagcaatcctaggaagctaatactctgacagaaaaaaatcttggataatatgcatgagaaaaatccttcaataaacacaaaattggtttcaaaatgttttcatgtaaaaataaattaacttttctgtaattagattgtgttttatagtaattcttgcctgcttcttagtctttgttgtaggatgcataataaaatacatgaatgagttttaaatggttagctttggagaatggttttgggaagttcctacagtacacagaaataaaagctaatgttactatgaatgcgcattacttttctaataaaatgtttctgaatctctgtcttgactgccttctatgaatcattttaacatagtatcaatgtcattatgtagtacatcagttcttaacagtttttagttcattacttaaataaaatttaataacta

SEQ ID NO: 255941 - DNA, 264 bp, Homo sapiens
taaaattttttaaaaaatcacataatcatttcaatagattcagaaaaatgacatgatataatgtaatactagtcatgataataactctcagcaacctagggatatatgaaaacttctttaaggaaataataaaaagtatgtacaaaacaatacagctagcaccacacttaatggtaacatattgaacactttcaccctcaggtcagaaacaatgatgtccagtatcatcaattttatccagcattatataaaaggtcttagtgc

SEQ ID NO: 255942 - DNA, 327 bp, Homo sapiens
cccctgccctgctacttccactgaccacagctggactcttccgctcaagcttcagagacagcgccagaatgaagcccaggagccatgtccttcctaccagtcccatcttttctggcttttgccacccctccaaccccatcagcacctcccaaggcctcctaaatggcattcctttgctgatctggaatccatgagctcctgtagcagcccagtatcataccccatgcagggtgacacacaccaacccatactcccgtgaccagatcccactgcctttgtccgtcactccctttccacacattggcatggagggagcatgcatctgta

SEQ ID NO: 255943 - DNA, 498 bp, Homo sapiens
caagaagtgtttgagaatgacagatgtggccgggtggctgtgccagagatggggaggcatgccatcagagagagacgcagggcagtcggctgcttgtgacatttcttccagaagctcagtgatggctctggttgttcatgacatgctttgtaccttttttcttgatccaaagtattttataataattgtttttaaaaacaaggtaagtggctgggcacggtggctcacgctggtaatcccagcactttgggaggccgaggcgggcggatcacgaggtcaggagatcgagaccatcctggctaacatggtgaaaccccgtctctactaaaaatacaaaaaattagccgggcatggtggcgggcgcctgtagtcccagccactcaagaggctgaggcagaagaatggcgtgaacccgggagacagagtttgcagtgagccgagatcgtgccactgcactccagcctggttgacagagcgagactccgtcccaaaaaaaaa

SEQ ID NO: 255944 - DNA, 223 bp, Homo sapiens
tttgtgctgctcacagtgttctagctacagacaagatgctcttttaagcatagaaaatccatgaaacaaatcactgccgacctgtagcatttgcctgttcctgttgtataaatactcccaccagggccaatttcaagttgccaacatgacttgcgtgaacatgggttcgagatgcgcagcagcacagcacgatagagtacttccgcctggagacacagtcagt

SEQ ID NO: 255945 - DNA, 451 bp, Homo sapiens
gctgacaccccttatcactccccatcaataccctgccacaccactatcccagacccaggttcatatgctcagagtctctggcatgcaacaaactcattcccaccctcaatcatgctgggtctccttctcctaacatactctttcccctcctttctacgtaaatcctattaacttcttagagcccaagactgactacttctgtattttgcatccaaaatgaagcactccggaagcacagcctttcctacatttttttctaactgctccatgtactttatgtcccactttttaaatttttgtctgatcccacccaaggcacataatgcagccacttgttcaactgtactgaaatgcctaacggtaatttaattaattcatcaatttagaaaagcattcttcctggacagcagtggacatgtccacagttttaaaaccatcactgcaccgagaa

SEQ ID NO: 255946 - DNA, 897 bp, Homo sapiens
gggacccagggaagacacagaggggacggatggtctgcgccagagcagggaaaacgcgaaaccaaggagaaggagaatgatgagtttaaaaataataatagctcatgctgggggaagggagaatgtaaaggcctccccgacaggtttatggtgggcaggactgtagattcaatgcagagagcagcagccgccttctctgcagtgggaggggagccatgaatcttccctttggaaatgcaagcgccataaagcactgcaggaaggatgctcaacccagctgggcccagggagcccgggagacaggctggccttccaggttccgcaggcaagagtgggccctggggtccagctggccccacagcatgcaggcagcccaggggcgcagagagggtcagcgcctcgctggtggagaggtctttcctgcccccacactacacgccccctcccggcaccccgctccttcagagggcccacctgggatctggcctgcccagccctgcatgcggcaggagtcaggcggccgctcctaatgcactgggatgactattaagaggctctgagccgccactcagctgggctcacttccccaaatctcgcagccagccaattactggcgattaattacccatctccggaggtaggcgaggactccgcgtagccaaggtcagccagttcaaacgatccagctgcccggccgcccacatccaacctcttcactcaatgtgcaggactcccagccaggggtcaggtcgggtgcggggcacagctctgaccccggggtgggagagaatccccccaagaggctggcatctgtctcccagacccttggagctgtcccctacacccctgatacggaacggcgaccttcctcgggtatcccagggatgtaataatggc

SEQ ID NO: 255947 - DNA, 283 bp, Homo sapiens
aacctctgtctcctggtttcaagcgactctcctgcctcagcctctcgagtagctgggactataggcacacaccaccacacttggctagttttttgtatttttagtacaaatccatgttggccggtctgatctcagactcctgacctcaggtgatccgcctgcctcagcctcccaaagtgctggaattacaggcgtgagccactgtgcctggccaataccctttttctagtcaatattcttgttggcttttcttgtctcggccagcactcccaggtgcaatggt

SEQ ID NO: 255948 - DNA, 279 bp, Homo sapiens
cttgattatcacatccagttgtgcacatagaaatctctaaaggattacctcattaggtgctttcctttgaaagaaagaggtgccttttaagggtttaatttaaatataggagaggagtgccaggatagctccttgatttcttatctctagctgtaaactgtagacccaaaacatcctctttagtggaagaactctaaatcattttggttgtctttttttatatgtaagcaggagtcatttttctatttacttcctcttggtaaatttttaattttttgt

SEQ ID NO: 255949 - DNA, 435 bp, Homo sapiens
aaaccaatgatcagagcccagatatgagagggtggaaggagaattcagagttgcccactgacctggaacatctggatatggactgttgaaagggcttccagatgtctgtaagggatgttgggctcgatggacaaggcagtgcaaagctaggctaggtgcacagcgtcccttatcatcccccaccccccaacatatgcaaggagttggctggggccatgactgctccttcctcagccccagacttccaaacagcacccccagaggagaaacaaaatcagcttccattctctccctgtgcatagcaatagctttaacagctaaagagagagtgagaggaaggaagttgtcttagtccattttctgttgcttgactgaatgtctgagactgggtaatttataaataaaaggaaattatttcttacagttctgaaggct

SEQ ID NO: 255950 - DNA, 594 bp, Homo sapiens
tcctcaggttgtattccttaaatatatataatttaaggatatgtattatatatatatataaatatatatgtaattccttaaatatataattttaatacaattttttttttgagacggagtctcactcttgtactccagcctgggtgaaagagtgagatcctgtgcagaaacaaaagaagaaaaaaagagatgtgaaagcctatatattgaagactaccaagtactgcttagagcagttaaagacctttggaatagaaaatgtttcttcttgcatttcaagattgcttttgttttggggggacacactattttttaggaatatgaagttcttgttaggcattcctgtaaaaaaggccactttttgataggattgtattgaatctgtgggttgctttgagttgtatttttatcttaaccatgttacaacttccaacccatggacacaagatgtctgtccattgatttaggtcttcctgaatctcctcgagcaatgttctgtagttgtctgtgtacaagtactgcaccttcttgaacaaatttattcccaggcatattattcttaccagtgctattataaatgaaatcattgtgtca

SEQ ID NO: 255951 - DNA, 639 bp, Homo sapiens
tcataagcttgaaactagcctaggcaacatggtgggccctcatctctactgaagatcagaaaaattgtccgggtttggtggtgtgagcctgtagtcccaggaatcagtggatgaggccctaggatgtcataggcctgagaattccatgctgcagtgagctgtgattgtgccactgtactccagcctgggtgaaagagtgagatcctgtgcagaaacaaaagaagaaaaaaagagatgtgaaagcctatatattgaagactaccaagtactgcttagagcagttaaagacctttggaatagaaaatgtttcttcttgcatttcaagattgcttttgttttggggggacacactattttttaggaatatgaagttcttgttaggcattcctgtaaaaaaggccactttttgataggattgtattgaatctgtgggttgctttgagttgtatttttatcttaaccatgttacaacttccaacccatggacacaagatgtctgtccattgatttaggtcttcctgaatctcctcgagcaatgttctgtagttgtctgtgtacaagtactgcaccttcttgaacaaatttattcccaggcatattattcttaccagtgctattataaatgaaatcattgtgtca

SEQ ID NO: 255952 - DNA, 663 bp, Homo sapiens
cccctacttaccctccttacctccattaaggactttctgctcccagatataaggaatcagcctaggatttgaagcagtacagctctacatactgagttaaatttcctattttggactatcctaaaaatgtaccactgtgtatagtactacttttgtaagaaaatgagttcctcattccaagccactatttgctcggctggcaatgccctgtagactctggtatgcagtgcccatagtaaagctcgttaaacattagttcttagaaagaaataaatgcattgaagttcttcaatgtaactatattcctgaacaaaaaaaactaaccaaattcattctaatatgtgtaatggccaagtttagaccagactgtgattaaaacattcattcgtcaactcagaagccacctttgatatagcaactacaaaaatcttctcaatagctggaggccatatgttaaagaaacttgatgaaatattttcagcagtgaatgccagcttttcacatctaggactgtcagaatgttgagttctgaaatttgatctaaattcagtttcacattaataaatgaaaggttatttttctgttactgacactgaaaatacacaaatggcactttcaaatttgaccatgttccctggttaaattttcaaattagttaagaaa

SEQ ID NO: 255953 - DNA, 694 bp, Homo sapiens
aaatatctaaacaaaagtatttaccattcatatcctacctttagctgggtgagtcatttgatggcaattttctattatttgcatagcacatgttagagtttagaaataaacagacatatgtcattcaaatttttataggaaagtgtttaattgctgagaagtaaaacacaaaatgacctcgcagcataattataaaaaagaagcgtaaacacgaaaacaaagggaacagaaaggcaatgcaataaatatcacaatcaaacacctctttcatcaaaatatcagttccctttttaaattctgaagtgaatgctctaaatttattgttgaggctgctttaatattatagtttgatgtactatcttcgaattgatctgatgttataatcaaccttgggtcagtaacagagacaaaatccatagcttcatgccacttaactaaataaatatcaacattcaggtgaagggctttggattctatgattttacacgttcctcacctaagtcttattatcaggcaattttggtaattgatgtgctaatataattgttctcaacacctaattgggtgtcaactttaagttcaaaaggagctatgccaaagaagcgtttttacgtttctcactctttatttttctgtactagtgagtatagaagtctggtttgaaaacagtgataatatcagataacttcaggga

SEQ ID NO: 255954 - DNA, 479 bp, Homo sapiens
  misc_feature (25)..(26): n is a, c, g, or t
  misc_feature (33)..(33): n is a, c, g, or t
  misc_feature (36)..(37): n is a, c, g, or t
  misc_feature (53)..(53): n is a, c, g, or t
tctctagcacgatccccccccttgnngagctcnagnnacacagtctttttttnctgagatagagtctctctgtcatccaggagaattgcttgagcctgggaggcagtggttgcagtgagccaagtttgtaccactgcacttcagcctggcaacagagtgagattccgtctcaaaaaaataaagaagaaaaaaaaaggaaagaaagaactctaaacaataaagtaacaccctggatagaagtagagagcactttcagaggacacctgaaagtaaaaataaaaaaactttctgatgagagaagtctgtggtttgagagcttaaattaaagcctaccaagaaagcaggtttctccagaatctgcccctcaaattgcttaacagccttcggacagctctaacaaccttgatagaggttaaagctctaacaacctttaaacatacctacatacatacagaattttataacatttgtttgactac

SEQ ID NO: 255955 - DNA, 301 bp, Homo sapiens
tgtctaaatgtttctttctcagagaggcattccctaaccctcaatgtagatcaaggccacttgttatatgctctcacaatgcctgtcgtctgtagctggccttttcagcacttatcatcgtgataacaacatagttatttatgtgtttagctgttcagtgcctgtctctctccctctgccacgttttatgaaggcaagaactatggctattttcttctttcctctttccccagcacttaatgcctgacatgggagcttaatacatatttgttgattgaataaataaatggtaatagtgata

SEQ ID NO: 255956 - DNA, 380 bp, Homo sapiens
atgctctgccctttgtgcagtgcgtgagtctactctgagtccatttccatgtctagttcatgctatctaattctttgctcttgtcatcggtagccttattctttctgcagtttcactcatctcagtctttagtttccctcactctgcttcccacatttttctctgacttttccaacaaaacctccaaaacgtgattcctctttccttggcattattgtatgttagaaggtctggcaggagtgttttcacagccttggtcaggccaaggttgggggagtccttaccttcattgctttgattctctttgggaccagggtggacaatgggggagggcagaaccttctctcctgtgagatatgggcaagggatgaatgaataaa

SEQ ID NO: 255957 - DNA, 498 bp, Homo sapiens
agtaatcatgataagtaacatattaatatgatgtttttaaaaatcaaaatgaatgcagagaatctatgatgaacaaaatattaaaattttaagtaaagacataatcagtgtaaacatagaaggatcaagggatcaagactgatttgggggcacacaccaactctacatcccaattgaagcattgaaacaatttcttagtaaaagtggcagtactctggcctggcacagtggctcacgcctgtaatcccagcactttgggaggctgaggcaggcagatcacttaagtccaggagtttgagaccaggctggtcaacatagtgaaacccccatctctactaaaaataaaaaaattagctggtcatggtggtgcgcacctgtaatcccagctacttaaggctgaggcacgagaattgcttgaacctgagagttggaggttgcagtaagccaagatcccaccacagcactccagcctaggtgacagtgatactctatcttaac

SEQ ID NO: 255958 - DNA, 185 bp, Homo sapiens
ctgtagagatgggggtctccctaggctgcctaggctggtttcaaactcctgggctcaagagatcctcccatcttggcctcccaaagtcctgggattacaagagtgactcaccatgcctggccctaactaatttttaatgatggatgtttgcatacttggaaatgtcttttttaaaagcacaaaga

SEQ ID NO: 255959 - DNA, 448 bp, Homo sapiens
acgggcaggctggtctcgaactcctgacctcatgatctgcccgcctcagcctcccaaaatgctgggattacaggcatgagccaccacacctgacattaatttttattccctttaagaattagaattctcagtcttttggggtgaatttgcccttgtggaaatgttgttttattcctatttttagtcagaataatttttctgtattaaacaatacaaaatgtgaaagcctggaattgtgggaattaaaaatgtatgtcttagaagcaaaatagcctccttttcttttactaaaatttgtgaagttttaaagtaatccctttttttaatgttcagagaagaatatatgtatgttaaagaatcctagtgataatgtaatggaatggggtatctgggcatgatgctcctgcttgtctgaatacatatatatgggaattttaaaaattgttgt

SEQ ID NO: 255960 - DNA, 240 bp, Homo sapiens
tttcctttgcatgtagacccagaggttggattgctggttcatatggtagttccatttttagtttttgaggaacctccatactattttccattatggctgtcctaatttacactgggaaaacagtgtacaagggattccttttttccatatcctcccaacactttacacaaagcttttcttaacattaaaccgaaatctaactgcctgtacttactatcctagagtgcttggagcttccta

SEQ ID NO: 255961 - DNA, 394 bp, Homo sapiens
tttttccaaactgcagcttattacatgggtcacacaaggacagtttgcagcataaggacagctagctgcttatacaagaacatgtgcctgacacagtctcacaagcccagtccaaaactacaagggcctaactgtaactccaggattacaagtcctacctaataactattgacactcgccagtcagaactcaccagctcttttgttgctgccagcaccaataagctttcttccaaaaccaacgcatagcctccgcctttcccaataaactctaaccttttcctttattctgtggacactccagaggccaatctggtctgtatatatgtcccagattgcagtcctacttcttgtatattattctcaaataaaacaatttttacttaagagactca

SEQ ID NO: 255962 - DNA, 460 bp, Homo sapiens
cgggcatggtagcaggtgcctgtaatcccagctactagggaggctgaggcagagaattgcttgaacccgggaggcagagggtgcagtgagccgagatcgtgtcacagcacttcagcctgggcaacagagagaaatttggtcaaaaaagatgtccttcccaaacactttaagcctgcacactgcctgtggtttaacgtgcctctagtatgagacctcattgtcttccttattactttgtaaactgtgaagtaacatgttcgctatctagttccaagctttgttcagtgatttagaggataaatgcctatgactctcagtgtcagaaacagagtaaaattacatatcttatttacttattttcttgtttaatatatgttccctctactggaatttaaactatacaaggtggagaacttgatctgccaataatgttatcctctgtgcctagaacgatgtctga

SEQ ID NO: 255963 - DNA, 510 bp, Homo sapiens
agaagggacagtgggagggaggtgaggaatgaaaaactacatattggagtacaatgttcactacttgggaaatgggtacactaaaatcccagacttcaccactctacaattcatccatgtaacctaaaaccactgcaccccctgaagctgaacccccaaaaggatgagtttccatggcatggagatagctatataagtgcaggtggccccactcatcatgctggcagtcaccagagagtcaagcaggaaggctggtggctccacagtccacaaccacacgacaggaagccatgaggctgactcgtgattgaagggccacagtacctacgtgtatcttatgtacaaggtgcagcatgccttatcagctaaaatatggcacgtatgtgctatgaacttaaattactatctctgtgagtttggcccatgagagacagaattaaagaattgaaagagacttcagaagaaatcagccagtccaattccctcaccttgtttccacaaacaagaaaa

SEQ ID NO: 255964 - DNA, 115 bp, Homo sapiens
aaggctttgatttcaataacaaaatttgttacttccacattgagtatagaagatcccaacttcaatatatacatattgtaaaaagtctcttcaaaaattgtgtttttatgatatg

SEQ ID NO: 255965 - DNA, 417 bp, Homo sapiens
ttcacagagcaggaatggaggaatggaggaaaggaggtctgggagacaaaatctctagcaaggggttgacagtcccttagagtcacccctcagcttgaggacctattattctttggaaaagggagaccagtacattctgagaaagaacccaggctttggagcctgaaaatctcaacttcttcctcttgagtgtgtctttggtaagttatttatcccatctgtacctcggtttcctcatctgtgaaacaggcaacacaccacctcctatagttatagagcaggatcaatgagattgtctttgaaaagttgcccagcatttgcaggtatttaataacaatatcttttattattcaaaggtcattcagccatttgtattggtgctccagtactcttgtaggtattgggaatatagcagtg

SEQ ID NO: 255966 - DNA, 1548 bp, Homo sapiens
  misc_feature (12)..(12): n is a, c, g, or t
  misc_feature (1196)..(1197): n is a, c, g, or t
gtggtggcaggngcctgtcattcattccagctacttgggaggctgagacagggggatctcttgaacccaggaggcagaggttgcagtgagccgagatcacgccactgcactccagcctgggcaacagagcgagactccatctcaaaaaaaaaaaaaattgtataaaattatcttcagacttttgtataaggtgtacatgaaacataaatgaatttcatgttatttcatcatgaatacatcaatattccgaaatccaaaatctgaagcacttctggtcccattttagagaagagatatttaacctgtattcaaagtagatggcccttctttttaaaaaatgctgagttgctaagcaatccagttcctttcaattttagggtcatctctaattattatggctttgaagaaaaagccattcttcctatctaagcatttccagataccaaagatttagcttttcacacttgttaatctgatagaatatactggcactgacgtgacaggtagtttaattcaccatcacatcttttaatgctttaaaattgttctccctccctaggttggttggggagcaaagtgtaatcccaggttgcctaatctaatttggcagttttagttccaatggtattgcagaatgtgctaatgggaactaacatttgctactgcacagtgaaaagaacaagaatagtgtgattaagaacaatagttcaaatttggccaaagattaaatggcctaggcattcagacttctgtcttatggctcctgtctttacaacgaccctggggttaaggtggcatattccattgaaaggctgcgtggtgtgagttttctacgatttgaaaattatgagcttctgcggcaacaaacttggaacctggggatggaacttggggcctgacttgttaagttccaattcttttcatattctctgtaagtgtaccagtctgtttcatgtcatctggaccattctgatgtgcctagaaatcaatctttttccctccctcaatcctgcatggggtcaggcctacacctctgcacaaactataaggccataaacataatcctaaagtacaaataacctgtgtagcaagactataggacatctctacagatggttgtcctccagcatatcctgggattctaggaaactaagatgaaacagagaggagaaaggggtggtgcataggtgaaccanngacttcaaactaagggatttgctggtttctcttctgctgccacagtagcttacattagagcaggaaaactacgagaccttcaatactatagtcaggacagcaacagcaacttccactttaccttgcaaatattgagagcttggacaatagtctaacaaattcaatttcaaacatctgtcgagaattggatgatgctgacattctaacatttcaacatgcccccaaatttgtggaaagtacacgtgtttacaccaggagagttctatctctgagtcagatgtggggaaactactactctagaacaggattctcaaccagaatgtgaccccctgggcacatttagcaatgtct

SEQ ID NO: 255967 - DNA, 855 bp, Homo sapiens
gaatttgtagctgatagtagaggctttacttgtgtaccccaaatgcactttgatgtggtgtagatggttttgtgagttatctgagccatgtaactcagagaatagtatttccttgtacataaagtgacctcacttttaatcagcccatttatggtatgttgaaatcactgtgtgtaatgagagatactgagagtttctcacgcatatgagtacaaagggttgagaactatattatacaaagtaagtcacagtgcatggcaactctctacaggttggattacaagacttcgtatgtggagtaagataattatattgggaaaaattattttcactaactttaagactccagagacacttttctcagccatgaccagtaatgtttttaaaagattttggaaggaatagctcctcactataccaccagttcgtgattttaagggaggagacaacccctcatactgtcttatgcccaatttctgcctccaaagaaagaagtaaaatctaaaaggcagaaatgaaatccacaagcagacagcctggccccacatcctgggcctggtagttaaagattgacccatgacctaatcggttatgttatctatagattacagacattgtatagaaaagtaccatgaaaatccctgtcctgtcctgttccattctaattaccggtgcaggcagccccgagtcacgtaccccctgtttgctccatcgatcacgaccctctcatgcggacccccttagagttgtgagcccttaaagggacaggaattgctcactcggggagctcggtttttggagacatgagtcttgctgaagctcctggctgaataaagccctttcttctttaactcg

SEQ ID NO: 255968 - DNA, 421 bp, Homo sapiens
gcagccgctgtaggagacagtttggtagtttcttataaatgtgaggatacgtgttccgtacaacctacaagtcccatccctaggtatttagcaagagggatgagaactgtgtccacgcaaacactgggagatgcatatttatcaagcagctttatttagaattgtccccagtggaaacaacacaaatatccttcgactgctgaatggacggagaccctgcgaggccttcacgaggagacactgcaaggcctccatgaggcagccagcactcaggagccaaggcacaggcctctggcagacgcgccaccgtgggggaatctcgactgctgaatggacggagaccctgcgaggcctccacgagacagccagcacttgggagtcaaggcagagacctctgtcagacatgccaccgtgggggaat

SEQ ID NO: 255969 - DNA, 327 bp, Homo sapiens
cttttgccacattggccaagctggtctagtactcctggcctcatgtgatcctccctccttggcctcccaaagtgatgggattacagtctgagtcactgccctcagcctatacatacatatttgcacacttatttattttggatacattttctagaagtgtaactattgggtcaaaggatgggcataattttgaaatgtgattattttctaaagagcttttatactgatatgccattgttggataaagccctgctagtagtgaataggagtgcgcccccacaacctttaaacttattctaactggcatagtgattctagtaaaaaaaa

SEQ ID NO: 255970 - DNA, 627 bp, Homo sapiens
gaccagccaagaggccaggaatttaagaccagctagactgagtgatagggcaagactccatatctaacaaataaataaataaacagaaaaataaactttgaataaagccacaacagataatttggtaaatgtgatgtcatggcatgtcatggattagcagtaacccattttccatgggtaataaggtcatcattatattcaaactgtacaagctacctaacccaagaatcacatcactgaattaacaagacaaaaacaaaaacaaaggagagtaccttattgttttaaaacaatagactgtaatttagaggtctaattcaggagccttgttacattgtattgagtctgagagaagtaaaataaaaagtacaccacagattagtaattgctgacagtggctgcttcatcaagttcttggaaaacaaaagtgacaaaacggtgtaatcagagcccagaagaacactcagtgcttccctgctagggtagctagtttagacagtgctgaaaccatgacgaagaaggcctgcagcttgtcctagaaccatgcaagagggaccattgaagctgaaggtggattgctgttgggtggaaaggatgtagtcactcaaaaatgctgccagaagaaga

SEQ ID NO: 255971 - DNA, 235 bp, Homo sapiens
aaaaaaattattttagattgtgcttcctaatattttgggattaaaatgtcctatttaaaaatcacattattggccaggtgcagtggctcatgcctgtaatcccagcctttgggaggccgaggcaggtggatcacaaggtcaggagattgagaccatcctggttaacacggtgaaaccccgtgtctactaaaaatacaaaaaattagctgggtgtggtggcgggcgcctgtagtcc

SEQ ID NO: 255972 - DNA, 296 bp, Homo sapiens
aactaataacttttttctttgtggctattacagcacttcaatttagaagctacattcaaagacaaaagctaaacaaaagctaagggtctgtgtcttagaatgctaaatcaccattaaaataaaccatttcaaaaactcaattagctgttcaattttatactgtgattattctttctccaggtttttcctgacatacaaaaaatagaaaatttggtttgttttttccatattaagaaagctgatgtcacgcctgtaatcccagcactttgggaggccgaggcgggtggatcacgagg

SEQ ID NO: 255973 - DNA, 789 bp, Homo sapiens
gggcccggcggccgcatcgggagcccggcggaaacatggcggcgcccggaggccggggccgcagcctctccggcctgctccccgcgcagacctcgctagagtacgccctgctcgacgccgttacccagcaggagaaggacagcctggtctaccagtatctgcagaaggtggacggctgggagcaggacttgtcagtacccgagtttccggaaggattagaatggctgaacacagaagaacctatttctgtctacaaggatctatgtggaaaaatagtcgtccttgatttcttcacctactgctgcataaactgtattcacctattgcctgatctccatgcattagaacacacatactctgataaagatggtcttcttattattggtgttcactcggctaagtttccaaatgaaaaagtcctggataacattaagagtgctgttcttcgatacaacatcacccaccctatggttaatgatgcagatgccagcctttggcaagaactagaagtttcctgctggccaactctagtcatacttggacctcgtggaaacatgttgttttctttgattggagagggacacaaagataaattatttttatatacttcaattgctttaaagttttacaaggacagggggcgatcagagataataaaattgggatagaactctataagaatcttggcagcttcaccattgctatttcctggccaagtaacagtagaccaagttactgatagattggtagtagcagacactgggacatcgtgataatgaagcctcgtgg

SEQ ID NO: 255974 - DNA, 538 bp, Homo sapiens
gggcccggcggccgcatcgggagcccggcggaaacatggcggcgcccggaggccggggccgcagcctctccggcctgctccccgcgcagacctcgctagagtacgccctgctcgacgccgttacccagcaggagaaggacagcctggtctaccagtatctgcagaaggtggacggctgggagcaggacttgtcagtacccgagtttccggaaggattagaatggctgaacacagaagaacctatttctgtctacaaggatctatgtggaaaaatagtcgtccttgatttcttcacctactgctgcataaactgtattcacctattgcctgatctccatgcattagaacacacatactctgataaaggtatctgctctttaattagtttctaacagactgtcctggcatagtcactggaagagtggctgactcattagctcataggagaatgaacatttggcaaggcttcagggattctaaaagtaatctcttatctatgaattaaagacttcatgtaccttttcataaaggattaagc

SEQ ID NO: 255975 - DNA, 1921 bp, Homo sapiens
  misc_feature (117)..(117): n is a, c, g, or t
  misc_feature (1017)..(1017): n is a, c, g, or t
ggtgcagctgcaggcaagcctggccactgttggctgcagcaggacatcccaggcacagcccctagggctctgagcagacatccctcgccattgacacatcttcagatgctctcccanctagccatgctgcagggcagcctcctccttgtggttgccaccatgtctgtggctcaacagacaaggcaggaggcggataggggctgcgagacacttgtagtccagcacggccactgtagctacaccttcttgctgcccaagtctgagccctgccctccggggcctgaggtctccagggactccaacaccctccagagagaatcactggccaacccactgcacctggggaagttgcccacccagcaggtgaaacagctggagcaggcactgcagaacaacacgcagtggctgaagaagctagagagggccatcaagacgatcttgaggtcgaagctggagcaggtccagcagcaaatggcccagaatcagacggcccccatgctagagctgggcaccagcctcctgaaccagaccactgcccagatccgcaagctgaccgacatggaggctcagctcctgaaccagacatcaagaatggatgcccagatgccagagacctttctgtccaccaacaagctggagaaccagctgctgctacagaggcagaagctccagcagcttcagggccaaaacagcgcgctcgagaagcggttgcaggccctggagaccaagcagcaggaggagctggccagcatcctcagcaagaaggcgaagctgctgaacacgctgagccgccagagcgccgccctcaccaacatcgagcgcggcctgcgcggtgtcaggcacaactccagcctcctgcaggaccagcagcacagcctgcgccagctgctggtgttgttgcggcacctggtgcaagaaagggctaacgcctcggccccggccttcataatggcaggtgagcaggtgttccaggactgtgcagagatccagcgctctggggccagtgccagtggtgtntacaccatccaggtgtccaatgcaacgaagcccaggaaggtgttctgtgacctgcagagcagtggaggcaggtggaccctcatccagcgccgtgagaatggcaccgtgaattttcagcggaactggaaggattacaaacagggcttcggagacccagctggggagcactggctgggcaatgaagtggtgcaccagctcaccagaagggcagcctactctctgcgtgtggagctgcaagactgggaaggccacgaggcctatgcccagtacgaacatttccacctgggcagtgagaaccagctatacaggctttctgtggtcgggtacagcggctcagcagggcgccagagcagcctggtcctgcagaacaccagctttagcacccttgactcagacaacgaccactgtctctgcaagtgtgcccaagtgatgtctggagggtggtggtttgacgcctgtggcctgtcaaacctcaacggcgtctactaccacgctcccgacaacaagtacaagatggacggcatccgctggcactacttcaagggccccagctactcactgcgtgcctctcgcatgatgatacggcctttggacatctaacgagcagctgtgccagaggctggaccacacaggagaagctcggacttggcactcctggacaacctggacccagatgcaagacactgtgccaccgccttccctgacaccctgggcttcctgagccagccctccttgacccagaagtccagaagggtcatctgcccccccactcccctccgtctgtgacatggagggtgttcggggcccatccctctgatgtagtcctcgcccctcttctctccctcccccttcaggggctccctgcctgagggtcacagtaccttgaatgggctgagaacagacc

SEQ ID NO: 255976 - DNA, 1758 bp, Homo sapiens
  misc_feature (117)..(117): n is a, c, g, or t
  misc_feature (1017)..(1017): n is a, c, g, or t
ggtgcagctgcaggcaagcctggccactgttggctgcagcaggacatcccaggcacagcccctagggctctgagcagacatccctcgccattgacacatcttcagatgctctcccanctagccatgctgcagggcagcctcctccttgtggttgccaccatgtctgtggctcaacagacaaggcaggaggcggataggggctgcgagacacttgtagtccagcacggccactgtagctacaccttcttgctgcccaagtctgagccctgccctccggggcctgaggtctccagggactccaacaccctccagagagaatcactggccaacccactgcacctggggaagttgcccacccagcaggtgaaacagctggagcaggcactgcagaacaacacgcagtggctgaagaagctagagagggccatcaagacgatcttgaggtcgaagctggagcaggtccagcagcaaatggcccagaatcagacggcccccatgctagagctgggcaccagcctcctgaaccagaccactgcccagatccgcaagctgaccgacatggaggctcagctcctgaaccagacatcaagaatggatgcccagatgccagagacctttctgtccaccaacaagctggagaaccagctgctgctacagaggcagaagctccagcagcttcagggccaaaacagcgcgctcgagaagcggttgcaggccctggagaccaagcagcaggaggagctggccagcatcctcagcaagaaggcgaagctgctgaacacgctgagccgccagagcgccgccctcaccaacatcgagcgcggcctgcgcggtgtcaggcacaactccagcctcctgcaggaccagcagcacagcctgcgccagctgctggtgttgttgcggcacctggtgcaagaaagggctaacgcctcggccccggccttcataatggcaggtgagcaggtgttccaggactgtgcagagatccagcgctctggggccagtgccagtggtgtntacaccatccaggtgtccaatgcaacgaagcccaggaaggtgttctgtgacctgcagagcagtggaggcaggtggaccctcatccagcgccgtgagaatggcaccgtgaattttcagcggaactggaaggattacaaacagggcttcggagacccagctggggagcactggctgggcaatgaagtggtgcaccagctcaccagaagggcagcctactctctgcgtgtggagctgcaagactgggaaggccacgaggcctatgcccagtacgaacatttccacctgggcagtgagaaccagctatacaggctttctgtggtcgggtacagcggctcagcagggcgccagagcagcctggtcctgcagaacaccagctttagcacccttgactcagacaacgaccactgtctctgcaagtgtgcccaagtgatgtctggaggtaggtgcagggtggggtgaagctccgcccacccacaggctcacccagattgacactcccattccctccccaggttcttgtgcgcccaggtgctgtcaggaggatgggtgcaggtctgggccttgcccacccataagctcacctggctgtgccccttcggtgccttcccccattgagtccttgaagtcccctccaggtctcacctcctcctaaagctggcaccaccagttttcctcagagacaaggctaaagaaacactgagtgcagggccccgggggggaggcaccctataccctatcagt

SEQ ID NO: 255977 - DNA, 423 bp, Homo sapiens
ggtacctgtaatcccagctacttgggaggctgaggccctgagaatctcttgggcccgggaggcggatgttgcagtgagccgagatagtgccactgcactccagcctgagcaacagagtgagactccatctcgaaaacaaaaaacaaaacaccatgtgtacatacttatgttaacctcaaagttaccactgtctaagaaacttaatgttccaggccatatccatgtctcctaattggtttgaaaaaggttgcagcaaaagaaactgaggttgcttacgccacccagtaggggccacacactgcagtccttattagcaacacagccttcatttacttctgcaaagaactttacagcttttgttttaagacagggtctcactctgttgctcaggctggagtgcagtggcataatcacagctcactg

SEQ ID NO: 255978 - DNA, 520 bp, Homo sapiens
ctacaagaggcaagaaatgatcatccctggaggcttcagagggagcacaacactggcaatgccttgctttcctgctgttgaacatgagattccttgttcttcagttttgggactcaggctttccttacttctcaactggcagacagcctattttgggacctagtgattgttctttcagtttcacatggctggggaagcctcacgatcatggaaaaaggcaaggaggagcaaatcatgtcttgcatggatgtcaacagtcaaagagagcttgtgcagagaaattccaccttataaaaccatcggacctcatgagacttattcaccatcacaagaacagcatggaaacagctgttccttaagtttaagacagaaacttggtctgaaaagtgacacacgctctgtttctgcagatgtctccaaaaacagaagttgttgcacctgacagtgaatattaaaggtttggcctgctttatctctcgctttcacaatgaatcatatctcaataaattctgtctcacca

SEQ ID NO: 255979 - DNA, 429 bp, Homo sapiens
acagccaaactccttgaaagagttttgaatattaaatgtttcctttccctctgctctcaccaactccccagctcccttccatcttgctattgctttcaccattccagaaaccagctcttgctaagattgtctgattgctaaatttaatggatccttttcaatcattacctcctttgacttctcaaaagcatttgccactctgaggcgctcatctttctttgcctttctcagcactgtactttgtaatttttcttacctatctctgtgtatgctgggtgttcttccactgtacatcctccagatgttcctgttttgtttgaggtcctctccctgggaaaccttattcactcctgtggcttcaatcatcatctatatgctgatgacttctgatcattatctccagcctctcttttgctcctcaataccgta

SEQ ID NO: 255980 - DNA, 407 bp, Homo sapiens
tcccaggccacagccaaatggaaccatctgcaccatgaagctgaagataaagccgcagaaagattgctgtattgtgagtggagaagagccctgcttctcttcactggctgatgtgcagacatttattagtaaatcttcacggcggtctagggaggcctttgactgagcgctgttcatcgagtccagccccggctttgcaaataaacagctgacaccaagagaggagaagcaacacggctgaggccacagggtgacaaagccttaacagcaagaaggggagaaggcagtcatctggaaacgaggaagacagccctcaccagaaactgacactgttggacctcgatcttggacttgcagcctctagaattgcaagaaaataaatttaagctgtggactctgttatttaa

SEQ ID NO: 255981 - DNA, 200 bp, Homo sapiens
cacatgtaggaagcggcatctgggctaagactgggcctgactgtatggtctgagcttcatgaagagagagtgctacagaagtaggttgcgggaccaaagtatatgagttttgaagcatggtgcataagcagtatgaatgacatcaaatagtgacaccaaagagaggaaaaaaatctctgcaaaacacggcacccctttgg

SEQ ID NO: 255982 - DNA, 444 bp, Homo sapiens
tattttgcatggcagaaattattttaacctggaaaacatggctccttctactttctatccttgttaggctggtaatacattgataatatatatctaactatatgaaatgaatgaattttttaaaatatccctgagtaattgtataaatgacttgatttttcacatactgtatttgattatttggaagacatacttaacatttctgtaatcagaatgccttttagaatagatcatgtgttatagttttaactgacaaccttttttaccttggtgttttataaaatgatgatgcagtcccaattcgtagcatatgagatttgataaaatacagtaatatagtaggaagcattaaagtttagagactgcaaaatattttagttttaatataattattgttgtgctacactttttggggctataggtgatattttctctctctctctg

SEQ ID NO: 255983 - DNA, 278 bp, Homo sapiens
atcaactaaaataaaacaggtgttgttatcaatttgactttttgatttttctcccaaaatgcatcttctccataaaattcttctaacagccaatgttttcaccagtgcctaccacctactcaacactccacagatgtttattgaatactcacatgaatgaatgaatgagtaaatgaatgaacaaatgaatatttcaaagagtttgtctgcttctctgagataattatatgttcacatgtgttatccaaagaaaatgagtttttctatttctgaggttt

SEQ ID NO: 255984 - DNA, 434 bp, Homo sapiens
actatctgtaatcaaatctttatctcactctgcattctggggaacccaaacaaagatggtaagtttgcctatctacatttatgtcttatttgctacaagtattactggtaattttcttgacaaaagtaatatgatatctgctgataggccaaaataatacatatttatagtgataactgcagcaaaaatgtgaaaaccaattttaaaaagttattttcactagtttaagaaaaatgaagaaattgaacttttaaaaaatgcagtaatacctcctaacacattatgaagaggaatattttcataactgtagaaatggttggtaaggctgtcaactatccaaggattatattgaaatagctgtcattggccaactactatgactaatgaaatcaacattttcaccatgcaggcaaaataaacgtcatgagtcaaat

SEQ ID NO: 255985 - DNA, 147 bp, Homo sapiens
gcccctatactgaaggaaataggcaaaaaaaaaaaagtctgagtcatttattcctgctaacaagaagcttgcaaaaatagttgggaagatcggaccaactcatatgaactaatcagagaacaagataggatagataaaaagataatg

SEQ ID NO: 255986 - DNA, 138 bp, Homo sapiens
ggggagataacagctttagtcatctggttgattaaatgaccttcattagctcctccaatacttggtttctatatttaaatagatttctaccgcagagggtgtgtgcatgtggggatgccgcctactgaccctcttcct

SEQ ID NO: 255987 - DNA, 451 bp, Homo sapiens
cacatgattttatattttagaaaagtattggtcagtgatggatttggtggaaatactgatctttcactacagatagtttgagaagtattgacctaagccattataaaacaaaatatgggggaaaatgactgagaactgcaatttgtatgtatatattggatgaaaggcttaaaatggtgtatctttacacttcttttctgatatataatgacaattttatttgcattaaagtcattgtggaattacaactaaatttttagtcctaggatttgactattgtattagttttcatgctgctgataaagacatacctgagactgggcagtttacagaagaaagaagtttaatcggacttacagttccatatggctggggaagcctcacaatcatggggaaggcaaggaggagcaagtcacatcttaatggatggcagcaggcaaaggaaaaaaat

SEQ ID NO: 255988 - DNA, 484 bp, Homo sapiens
aggtcaactttcatttctgcaagatattcattttagagtaagatacagttatctccaattggacagaaatttggggcaagggctgaattatggtacaaacatatgacagatgatgatgtactttaaaaaatcaaattctcaaataatttttaatgacagggagaatgttcataagatgttaaatgaaaaaagcaggcccagtgcggtggctcacgcctgtaatcccagcactttgggaggctgaggtgggcggatcatgatgtcaggagatcgagaccatcctggctaacatggtgaaaccccgtctctactaaaaatacaaaaaaaaaaagaatcagctggatgtggtggcaggcgcctgtagtcccagctactcaggatgctgaggcaggagaatggcgtgaacccgagaggtggagcttgcagtcagccgagattgcaccactgtactctagtctgggggacagagcgagactccgtctta

SEQ ID NO: 255989 - DNA, 440 bp, Homo sapiens
tccaccatataacataattggcaaagccgttgtcattgtcaaattaattagcaaatcaggcttactttcatatagacatggctttctattatgttttctaaatcatttcaaatacacatgttagtacacattcctcagcaaacattacttctgaattctcattctaagctacatagctggctggctggctggctggatggatggatggatggaggcaaagaaactcaccatgactttgtcacctgaatgaaacagtgccacatctttaatatttcctcccaaaccttcctttcctttactttcctgtgactctctctcagaagggatgcatgtctaaattctttatttggtacccagaagtcttttacagctcagggtaatagtgctccacaggaagatgcaggattgcagggagagctgtttgtcttcttttccaaact

SEQ ID NO: 255990 - DNA, 561 bp, Homo sapiens
ctggcactccacagggttctgtgacacaggcttcattctgtggtgtccctgcggcttcctgggagagaggagaaaagtcaaaggcaggaccccatcaaacccaccgtggtaacccgcacaagaaacagtggctgagccaggcatggggcaggcttgtggagcggtgcatagtgcctggaagacggggacacagggttttggctgaatgtgaggagagcacgcaggaggcgtcaggaaggacttcccctctcactgctcagtacacgtgtgagcatcgatgtcacaggcttccaggcagaggagtgcgtacgtgagggtctgctgtgcgctcagtacagagtgggtgtgggtttctggctcaggagcctcccgttgttgtcacttctcctcctctgtctctggtcctcccacctccctcattgtagggatcattgtggtgaccccaacagtctccccatctaaagatcctcaacgtgggtctttcctttccatgtagggtcacatattcacaggttgtagggattaggatatggccatcattcaacccactaagtcacggta

SEQ ID NO: 255991 - DNA, 558 bp, Homo sapiens
ctgttagcacacttctatttcatttttaatgtataatttcagtaggcatgcataattaaatgaaaatttgagaataaatgctatttgacatttctattagtaagacgagcacttaaaacatgacatcttttaatatcttcttaaactgagatcacttaatattctatcactttcaatttacttctcagtgtcatcatatgatgtaacatacatgtcattggtgcatgttacacttgtaacatacatgtgttatcctgtgtgataacacagtctttctgcggccttctgaaaaaatgtgtcttatctcctcttttgatgtcaggctgcccactggggttttttgctagtctagtgtacacacttgcattgggtgaatttctaccctttttctcttcttgtttttcctcaccatcacaaacaccaagatgatgctgatgtcagtaatttcccaaagcccctccccaaagtagcagttttgctttcctatcaatctatggattgattcttctgtataactaaatctggagccagttgatgagccaagtagaaaaaacattt

SEQ ID NO: 255992 - DNA, 1615 bp, Homo sapiens
tttttttttttgagatggagttttcgctcttgttgcccaggctggagtgcaatggcgcaatctcagctcaccgcaacctccgcctcccgggttcaagcgattctcctgcctcagcctccccagtagctgggattacaggcatgtgcacccacgctcggctaattttgtatttttttttagtagagatggagtttctccatgttggtcaggctggtctcgaactcccgacctcagatgatccctccgtctcggcctcccaaagtgctagatacaggactggccaccatgcccggctctgcctggctaatttttgtggtagaaacagggtttcactgatgtgcccaagctggtctcctgagctcaagcagtccacctgcctcagcctcccaaagtgctgggattacaggcgtgcagccgtgcctggcctttttattttattttttttaagacacaggtgtcccactcttacccaggatgaagtgcagtggtgtgatcacagctcactgcagccttcaactcctgagatcaagcatcctcctgcctcagcctcccaagtagctgggaccaaagacatgcaccactacacctggctaatttttatttttatttttaattttttgagacagagtctcaactctgtcacccaggctggagtgcagtggcgcaatcttggctcactgcaacctctgcctcccgggttcaagttattctcctgccccagcctcctgagtagctgggactacaggcgcccaccacgcctagctaatttttttgtatttttagtagagatggggttcaccatgttcgccaggttgatcttgatctctggaccttgtgatctgcctgcctcggcctcccaaagtgctgggattacaggcgtgagccaccacgcccggcttatttttaatttttgtttgtttgaaatggaatctcactctgttacccaggctggagtgcaatggccaaatctcggctcactgcaacctctgcctcccgggctcaagcgattctcctgtctcagcctcccaagcagctgggattacgggcacctgccaccacaccccgctaatttttgtattttcattagaggcggggtttcaccatatttgtcaggctggtctcaaactcctgacctcaggtgacccacctgcctcagccttccaaagtgctgggattacaggcgtgagccacctcacccagccggctaatttagataaaaaaatatgtagcaatggggggtcttgctatgttgcccaggctggtctcaaacttctggcttcatgcaatccttccaaatgagccacaacacccagccagtcacattttttaaacagttacatctttattttagtatactagaaagtaatacaataaacatgtcaaacctgcaaattcagtagtaacagagttcttttataacttttaaacaaagtatcaggtaaataattgtatttcctaagtaacctgaaggtgttacttcaaactgagaaagcctgccctccacacagcagaggcaaattcaaaccctccaccattctggagggcctttactggtaagggttgcattggagaactcccaaatctggctgtgcatacaactcacctaggaagctcg

SEQ ID NO: 255993 - DNA, 564 bp, Homo sapiens
acttacaaagggattctaaaaaacttaatcttattgaagtagagagtaaagtggtggccaccagacaccaaggtatttaggagacaggagggtttgaaaagatgttgatcaaaaaatacataattatagttaatagaagttcaagagatatttttgtacagcgtagtgactatagatcaaaataatgtatttgtagttttgaaaaatgctgacaatgtcacttgctcttgccacagaaatgttaactatgtggcgtaattacctagaattaagcatttaacaatgtatatatacttccaaacattatgttttacaaaataaatatacatttattgattacagatggtaatggtatgaaagccactgaaagggcaggcgttgcttatggtcttatgactggccactttgtgaacacaataaacaagtttgcattaaaaaaacccagaaaatggtttaatctaaaagttgccatgatcttcagaatttttccagagaaaatgaccaagaagttgactacagttaggtgactaagaatataagctgtagacaccttcacccactaaa

SEQ ID NO: 255994 - DNA, 393 bp, Homo sapiens
gcctcagtaaaagtggtagacagaggcttccctgtcgctcaaggagctcccagggctttctaggcttcccgttctcctcctgtttcccaggacccaccagagtgccccctgcaggtcaggacgggaaccgacacctggcctttgtcaaaacgcattccagcgcccagtgaattactgtcctcacgcctgtcacctctccatctccggctcctcgctgctctggctccttaaagtcctgctctgggcaaagtggccttaacaggaaatcaaagctgagtcaaactaataatagtttggctattgatcaggcagcccctttaaatcacccggtgttttgtttaattgcagaaaaatacacataacataaaattttccattttaaatgtacagtta

SEQ ID NO: 255995 - DNA, 250 bp, Homo sapiens
agtatcggctgcctttggacaccaatctccagttaaagctcacaacactgacatcagaacatgcagaactcagctgcagtgggagcccggccacgttagtcaagctcacttgtttccagacaaaacattttaattcctggcatgggagaggggacctggggaagcagtgttggaagagaatggagaggagggaagaagaagaggggagaatgaaaagggcatcattagcccagcgccaagatatttggct

SEQ ID NO: 255996 - DNA, 435 bp, Homo sapiens
tgatctccctttagcctttgttatgagcaggtttgtgaagacataaaaggaggacagggagtggactgatacaaagttgtttgtcaggaattctctttggcttaaggaaataacattgattagtgactggcaatatattgttaagctataaaagttacagtgtctgaagtattattgcggttgattcatagctacttgcaagcaatagcaagcagtttcaagagatgaatacataggtcaaggagggagtaggttgtgattctctctttttatttttgatacagggtctcactgtgtttcccaagctggagtacagtgacaattgtagctcaatgcagctttgaatgcttgggctcaagcaatgatcctcctgcctcagtcctccaagtagcttggactacaggtctgcaccaccacatctggccaggttttaaa

SEQ ID NO: 255997 - DNA, 550 bp, Homo sapiens
atttctaggaaatcctgggaatcgttttctagaaaaaacacctctgtccatatgatgacttttccatttgctttgtattctgatccgtggaatatcttcacatttgttatagtctccatggacttcccatctataggacttagacacccttgctaacgttcttgtcatcatccacccaccggatgtgcatgcgctcctggggatcctccgcgtctgccttcccacaggtgatgctgaagtccctcgtctctagcagtgcctgcctcgaggaatccatgttctctgcagtgatctggaccataacgccatcttccacaatactggacttggcaaggtatccagaagaggatttcagagcgccaccgaacacaaaaaaactgctttgagtttgcatatagttacagtagtactgaaaaatcctcgcaatttaggtttttgttttcagttttgtttctctgttttctagtgcataatgacttaataaatattcatttaacaaaaattgaaatctcaaaggtacatataaataaacaatataaataaccatcct

SEQ ID NO: 255998 - DNA, 451 bp, Homo sapiens
gccgctccctccctcctcccgcccccttctccccgcgcttggcaagaaaagcgggcaacgtggagcgggaacaaaggaccccgcggcccacggcgatcggggactccgtgccaccctactccaggcccggggctggctgcccgcccacacgagccgagtctcgagagctcttccagaagagaatcccaaaccccaggcaaacccgaggcgaggcgtccgttcctgacagcaagaacggggagtcccgcgccctccttccggcgggtcatccccgcccgcggcgccctaacccaggccccccaaaacccttcgaacaaaaaactcttgttcctcccagcctgcctcacccgcgccagtgtagcaaaggggctccagcctccgcgctctccgaggcgaccggcgcccgctctcggccgccaacgcaacttggcaaccatggcagcgctggagc

SEQ ID NO: 255999 - DNA, 282 bp, Homo sapiens
gttttttgtttttttacatggagtgttgctctgtcacccaggctggatatgttgcatggtgtactggttttctggaactgaggaaacaaagcaccacaaaccgaatggcttcaagcaacagaaatctactctcttacagttccagggactagaagtctgaaatcaaggtgtcagcaggaccacgctccttccaaagtctccagggaagaatccttcctactatctgtgggtggctgcctgcaatctttggcattcctgggcttgctgatgcccttattccat

SEQ ID NO: 256000 - DNA, 454 bp, Homo sapiens
atttcagaaaaatattgcaagtcatttgacttagctacttagcttgcactctatgtaaaaattttagaattttacctctttgaaaaactcctaatatcaatagtgatattgttgttttgcagcctcaaatgattttgttactttggactaattttcactgagctagttaataagtgactttttattgtctaaaaaattcttaagtgtatcatagagagaaagattattgggtcactaagtggctttctatatatatacctttgtccatatttaatttttgcaaaactcaaattaaggtggtaaacttagtgtggatatacattcatgtattgtattgataagattaactacattttaaaactaaagtggaaagttttaaagaaaattgtcattcaactatgtatgtatttctgtaaaacacacacgtaatgatgaattcgaattaataagcaaa

SEQ ID NO: 256001 - DNA, 711 bp, Homo sapiens
gcaaggtcatcattattgctaccatctatgtcaactttggggacctcttgactcaacagctgcagacacattgctttctgctggagctgtagtttttgccccttttttgctgactcaagcttgccaacactttttgctaaggaacccaccacagtgagggcatttcctgccacattgtcaagataacttctctgaaatctcacctgtttttaatgtaacagctaggagagttttccagggcaacagggttgaccacaagaaattctttatatttatttcagtcatttctcattctttagtgggtgacctttattagcattataaattctctgcagtatcctctgaatactatcagtctgtcaattttgggtggagcctaatttatctgtcttaaggaactctccctaaaaaggccaaagctttcttagaggacaggagcctctgcctaggaccctaagacattattttagatagatagttcgaagaaggcctcactgaagaggtgatattttagaaggatttgtttaaattgtgaacatgaactgtgtgggtatttggtggaagagtggtccagaaagtgaaacagccagttaaaggatcctgaaacaagaatctgaggagtacaagagaagaacaacagagaagccaatgtgactgaaatagtgtgaaggaagaaacatgtggtaggaaattgtttccaatataatattt

SEQ ID NO: 256002 - DNA, 500 bp, Homo sapiens
cagggaccatgtttcctcacagtcttggagttgtgatggaggcgttctctgtcctgaagttttgcctccctttgtaattgcatttatatgttggcctgaactgatcagtaagtttagatactgttttggatgggccaggtgagactgaatgcaacctcaggcgttcacatctcgaggtggcctttggggaagagctgcctcgtgctgggtcctgcctctttcagagcaggccagcacagctccttggagcaggaagacccttctggcagacgccaggccgcggcgtcttgctgcctctgggcaggagactgaagttaaaaacagacttgcaaggctcggccatggctgggttttacaagaatgatggcccggtgtttggcgagctgaggagtggatcctccccctgccagcgatattagggacgatgaggagcacgtggcaataagacggcaagggtttggtcccctcacacccaataaaaaaacgcctttcatgagaga

SEQ ID NO: 256003 - DNA, 343 bp, Homo sapiens
caaatagccagtactacaggtgcacaccaccacggtcacctaattttttttttcaatttttaacagagatgtggtttctgtttattgcccggtctggtctcaaattcctgagctcaaacaatcctcctgcctcagcctcccaaagtgctgagattacaggtctgacccactgcacccagcattttgttttttatgagatggggtctttccctctgtcacccaagctggagtgcagtggcacagccatagctcattttaacttcaaactcctggcttcaagcaatcctcctgccttgggctccatagatgctggggttacaggcatgagtcaccatgccccacc

SEQ ID NO: 256004 - DNA, 428 bp, Homo sapiens
acagtgagcaccccctgccctggtctgagccacttcagatttctcaacagcaggcagcactgggtcttgccttggttcttggttttgctgccagaagcccacagtcccttggatacatggcaccagggcaggactgctggatccccacagaaagctggatcccttggagtcccactcagctgaagagcccctgagttctgagcagataaaccttcttgccctcatggtctgtggtgatttaaaatatgcctgcaaattctctgctatttcccctttccaaggtggaggctgattccctttcccttgaaagtgggtcagacttaaatgactcgcttctagtgcacagaatgtagcagaagtgatgctatagaagtgacttcaaaggcttggctgtgaagaggttacagctccctcctacatcctgactc

SEQ ID NO: 256005 - DNA, 330 bp, Homo sapiens
tggagtcttgctctgtcgccaggctggagtgtagtggcacaatcttggcccgctgcagcctcccctcccagattcaagcaattctcctgcctcagtctcctgagtagctgggactacaggcgcgcacagccacgtcctactaatttttttgttatttttagtagagacagggtttcaccatgttggccacgatggtcttgatctcctgacctcgtgatctgcctgccttggcctcccaaagagctaggattacaggtgtgagccaccgtgcccagcctcagttgaattttttttaaagagcaaaatggaagaatggctaattgaatgtta

SEQ ID NO: 256006 - DNA, 350 bp, Homo sapiens
ccccatctgctagactcctttcttcccttgggttccagacacttcttcttcctggtttgcttctagctcactggcccccgatcaccctgctggttcccccacctcctgtcctccaggtatggcaagctcagacctcggcagctgcctgtctctccagtctccccctcggtactttccttccgaccatggattttaacattatctagatactgatgactcccaaagtgacatctccaagccctacacttccccaggggtgtttcacaggcatctccaactttccaaattcaaaactgaactcctaagttttcccctccaggcctgttcttccttcgggcttccccagcgga

SEQ ID NO: 256007 - DNA, 297 bp, Homo sapiens
ggggtttcgtcttgttcatcactgtatcttccctagtcccttgcaccgtgtctggctccagtcagcttatagtaaataccgattaaacaaatgattgatgaataccaaatacagcctgataaatctccctctttccactccctggtctgcatttctccctgccttacggatatctgcaactggatattccacttgcatctcaaaattatcatgtctaaaaccaaacatttgatctttctcccaagccattccttcttgtgatgtcctgatttgtaaagtcccaccatgctcacaaac

SEQ ID NO: 256008 - DNA, 315 bp, Homo sapiens
aaaatgttgtacagccttattatgcaacacactctgttttgctctgtgtgagttccactcccactgtcacagctctgtcagcagaccctgaggcctgggcatcaatttcaaatcttcatggagagccaatgctgtgggaagggtgtcctttagtctgtgatattcacgagtgagggacagagctggacattttagtgaatctcagagctgcagggaaagtactgtcttcagctactcttctctgcctagacttgggactattctataatttcctcactggattaataatcggtacctgttgaatcctgtgtccac

SEQ ID NO: 256009 - DNA, 473 bp, Homo sapiens
ttccgcttcctacaatggccctcctaccacctcagtatttcttctatccatctatcctgaagtaacagtagtatatgttttcataagaggaaattgaagcccagagatgtcaagtgactttcaactggcttgggacttgttttctgattctcagacttaagaattcttagtgtttttttcagacttgacagattgcttccagaaagagtcagcaaaaacacataaggtttttcgatttagatgcttgggcttatctactcatataggctttaatactgagtgcatgaataataacatttgatacgtttttaagcatgatgctaatttctagaacatgactggggataaagggaaactaatagaaaaaagttgtgatttatatttagcttctgcaaactgcttttcaagccatcatttccaataaggaactttgtactccagcctgggtgacagaatgagactctgtctttaaa

SEQ ID NO: 256010 - DNA, 269 bp, Homo sapiens
ttagtggccaaactgcacagtgtattattttactctgttaggcgctgtggtccatagcgctgattttttgagctataggacacgtctagattccgttcactttcctcagaaaaccacagaagcttgaagctcttatccagagcattccttctaggatgtcactgtgaaccagcacttgtctgcacctcagcttgcaacttagcggattccttctttattctttgtctgttagaataagcaaatatgaaatgttactttaatttttgaaa

SEQ ID NO: 256011 - DNA, 144 bp, Homo sapiens
tggcagagccccatggtggggtggggatggctttgcttatcaaaatggcttgggaatccggtattccgcgggcagcctagcacctggactcttcagaactgcgttgtctgtggcctcccgcatccagaggagggaggcggaagt

SEQ ID NO: 256012 - DNA, 442 bp, Homo sapiens
ataccccagagtcagatccgcagaccttagttcactgtgtatcctgaagcagccttgcaactcagttccatcaactctcagccatggtgcagggcctgtcctgcccacttaaggacccacaaaatgacttggtgagaatcctgtcatggaccaggtgtgagttatccatgtatgtgctaggaaacaggcccatcatctgaagacctaactgtagaccacaaaatagatctgtgtcctagcaccagctttactggctaagatcctgaaggaagtcccatcttcccaggaaccaagaaagatccatgctgcccgagtccctggtaacaggcccaccaacactgaaccccactgcagactcagtgacagccatgtaacctgcctttaactcttcttgtcagagattgcagaggcaatcccattagccttgggacctgagagacaa

SEQ ID NO: 256013 - DNA, 503 bp, Homo sapiens
gctctaaggctggctttgggaggagagagctccacacaaagacaccagctgcctgagcagctcccctaaacaagctgcaccccagaggagtcatgtgagtccctcatttttgctggagtgtctgcccttcctcacagaaccctcctctcctcactttgttcacaaagggcaagctctgagaccagctgccaaaccctggcttccacagtccagttaagaatttgcattaggccgggttacctgaggtcaagagtttgagaccagcctggccaacatggtgaaaccccatctctaccaaaaatacaaaaattcgccgggtgtgttggcgtatgcctgtaatcccagctactcaggaggctgaggcaagagaatcacttgaacctgggaggcagaggttgcagtgagccgagatggtgccactgcactccagcctgggtgacagagtgagactccgtctcaaaaataaataaataaataaacaaataagaatttgcactaaagtt

SEQ ID NO: 256014 - DNA, 440 bp, Homo sapiens
gaaaaaaattagctgggtgaggtagtggtacacacctgtggtcccagctactcagaaggctgtggcaggaggattgcttgagcccaggagtttgacattgcagtgagctatgaccgcaacactgcactctatcctggaggacaaagggagaccctgtagacagctcgaggagccacaataagcttctcacccatgaagcactcctgccaaaaatgacgaatccaatcaagccttcacacctgacagtttataggaaatacaaggatagaggatcaagttaaacatcacaagaaaacagccaaatccaaaatgcggaatactctgatctgttgaccggttcaaattgtcaatattattgggaggaaaaagtgggagggctgttctagaatagagattaaagggatataaccaaatgcaatgactgaatcttgattgaatcc

SEQ ID NO: 256015 - DNA, 834 bp, Homo sapiens
  misc_feature (650)..(650): n is a, c, g, or t
cttatcaccgccatgcctaatcttcatttaccgggagcagtgtgctgatgtttcttagttagaccagagtaagaagtttatggtcagttgatgaatttttaattataactgtttaaaaagaagacgatgactatgaacagcagctcactcgtagcaatctttggacagtacttcgaagtgacccactttcccatttaactcttgggaagcctgggttgccctgttttcgactttggaggtccgtgggctagattcagagtgccctggcaggctggcttgggtttgaggctgtggctgcagcctccgcaacaccctatctcagcacctgggaactggccccttggtacccgattctttcttctttgtgtgtgtgtgtaaatcattttcattttttctaatgatcaaagtatacattaaaataaatgaaagcaatacaagtccatgtgtatggtagaaaatctggacaatactaaaaatgtacagaaatggcttttaaagattaattttcaacctataaagtaagctacttttcattttagtgtctttttaaaggcagcttttaaaaacattttaaagggctcatcatgttcaagaatgagggaatgtttggctacaaggccttcagtatgactctatcctatagctggagngtttaataatcaattatattaaagcttttctaagcctccagaagggtttgtctgggtcttatttactataacaggcaagttaaagaaacttgagtttaatttatatttcagttcactttttttagacaacaagtgcaatttgggctttatttatggaaggagagagttgtccttctccccggaa

SEQ ID NO: 256016 - DNA, 700 bp, Homo sapiens
aaaatactgacatacaaatttaataaaatatgtgtaagatctacatgaggaaaactacaaacgctgatggaaaataaaatcaaagaactatataactggagagatattccatgttcatgaataggaaaacctcaatctaaagtttatacagacaggcaaaagacccagaatagccaacacaatactgaagaagagcaaagctggaggactgacattacccaacttcaagacttactagaaagctgcagtaatcaagacagtgagatattgttgaaagaatagccaaatagatcagtagaacacaatagagatccaagaaatagacccacataaatatagtatattgacctttgacaaaggggcagagacaataagatggagcaaagacagtcttttcaacaaatgctgctgacataactagacatccatgtgcaaaacacatatgaatctatatacaggccttacacccttcacaaaattaactcaaaatgcatcatagacctcaatgcaaaacacaaaaatataaaagtagaagataacataggataaaatctaaatgatcttgcatatggagatgaccttttgatagaacatcaaaggcatgatccatgaaggaataattgataagctaaattaattaaaatggatacctactgctctgaaagacaatgttagaagaatgagcaagccacaaactggg

SEQ ID NO: 256017 - DNA, 478 bp, Homo sapiens
aagtactcttctaagtgctttatatatgttatcccatttagtttcactttagtactcctaacagccctgtgataaaggtactactgtactcccagagtacagaggaagaatttgaaacataaggaagccaagacacaggataaagtcaagatctttaccatggcctttaagaagctgcctacttcttcaacctcatttattcccatttatgtttttgcattatgtgttcttgtgacaccaaattgctttgagttctcctgacaacatgctgttttatgcttttctatcttcgttcatcttgtttcctcagcctaaaatatgttctttctgttcttccttcatacccattttgagccacttcttccagagagtcttccctgatctttctcatgaggataaaatatcctttccccaatacatctatcatagccctggaccactttacattgaagtaacccaattgcacatctggggctgt

SEQ ID NO: 256018 - DNA, 406 bp, Homo sapiens
tgagtggaaatctcagctttaatttttgagtcagaattgtgtaagctaacgtccgtcaagatgtctgtggtgttgactgtcattcctgttgttaatcaccagtcctcttcagttgggatgcaaacaaaatggatttttgtcctcacaaattgatgcggatgttccgtcactgcaggctttatcttcaacatcatctcatcctttaaaatgagttgtccattttttttgacccctgaactttttattggcctcctcctccccagagcggaccctacttctgctggcttaatgttttagaactttggtgtcactggtctcgggcaccactttgccatccactatccggtggctggtggtcttttggatgttttgcatggaattgctgctgtccagggcatcaccaaga

SEQ ID NO: 256019 - DNA, 1604 bp, Homo sapiens
cacacacacaaacgcacagcacacacaaacgcacagcacacacgcacacacagcacacacacgagcacacagcacacaaacgcacagcacacgcacacacatgcacacacagcacacacactagcacacagcacacacacaaagacacagcacacacatgcacacacagcacacacacgcgaacacagcacacacgaacacagcacacacagcacacacacaaacacagcacacacatgcacacagcacacgcacacacagcacacacatgaacacagcacacagcaccatatggcgcgcacacacacacacacacacacaggctgagagacaaggtggagatccagggagaccccagggagcagtgcaggtgtccgtggattctgctttcagttaaacccctgatcacttcacctccctgagcctcagttaccttatctgaatatcgggatcatgacggataattgtatgtcatctattctaccgacggcagccagaggacgcctgtgagcacctgagtcagggcccatccctgctctgcctacagccctccatggctcccaccttcctatgcgtcaaagcccaagtcctccctgcagtccacaaggccctgcacaccttgccctgtcccttccctgccctcccctcctccctctctccccctcgttcactcttctggagccacacgggccatcctccctgttcctccaacacccaggtgcagtcctgccttggcgccttggcacgggctgtgccctcttctcaagaaaaccctcttcttccaaatatccacacagcttgttctctctcctcctttaagtctttgctcaaatgtcaccaatgtctcaattttacaatgaggtctctctgagtaacctataaagtcgcaaatacccaccctgagcgtcccccctccccgctacacacactcctccttcctgccatgtcctgcaaatgagatttattcatttgataattgcttctcccatcgcctcgccctctattgaacctaaatccctccaggaaggaattgttatgtttgttgagggttttgtcacctgaactcagcacaatgctggtatatagttgggtttaataaaaaacttactggaagaagcgagaaggatgggaggagagaaggggaaggagggtgttctcatagaattatcatgaggatgtgttgaaatcatacaaggctaggtgcagtggctcacacttgtaatcccagctgtttgggaggccaaggcgggaggatcgcttgagcccaagagtccaagaccagcctgggcaacacagccagaccctgtctctacaaaaaagaaaagttaaaaacaaacaaaaaaacagctgtgtgtggtggtgcttgcttgtggttgcacctcctgggtagctgggaccacagacgtgcgccaccacatccagctaattttaaaaaatttttgtagagatggagtctccctacatttcccaggctggtcttgaacccttgaccttgagcaatcttcccacttctgcctctcaaagtgctgggattacaggcttgagccattgcgctcgccctaatacattattttttgagatggggtctcgctctttcacccaga

SEQ ID NO: 256020 - DNA, 342 bp, Homo sapiens
  misc_feature (5)..(5): n is a, c, g, or t
  misc_feature (145)..(145): n is a, c, g, or t
  misc_feature (202)..(202): n is a, c, g, or t
  misc_feature (214)..(214): n is a, c, g, or t
  misc_feature (247)..(247): n is a, c, g, or t
  misc_feature (318)..(318): n is a, c, g, or t
cctgnagttttaattgaattgactttggttttgtttctcaaaaagtgggacaacaaaaatacctacttaagactactgtttcaggcactgtctaattgcattcatcagatcttattatattcattccatgaggaatcgaagaccnattcagtcaagcagcagcccaaggttacacgtctaataaagggcacattcccagatnaagcccatgtangctgactctagattctgattttgaactgctctntttctgaattggagtttaactcctctgttacccctagattaatggtgagtattttctctcacccaagttanttccattaactctaatcagaaccc

SEQ ID NO: 256021 - DNA, 331 bp, Homo sapiens
gtctcaaataacaacctctccctaagcagcactgaagaagcctaaaaaaggaaaacaagaaaaggaaggcagtgcctccaggagcccagcgctctttgattataacccactgaagccacctgcgtccttaagaggagcgggtgctcaggtggacagctgactctttagaaactgggcctcgtgggtggcacgggacactccgttgctggcgtatcatttgctcttccccacatgggcaatactgtggtgggtctgtatggtggggaatgagggaagggctggtaaatatcttagaataacaaacaaacaaaaccctgtacgggatttctca

SEQ ID NO: 256022 - DNA, 471 bp, Homo sapiens
agtcctttgaggtatccaggtggttcgtaaggccacataagtctgtcaaatatcatcgctttagagatttctgagatttcagaggatatcaggtcttgatgcttggaaagaggcaatcggcaagattttagcaaagggactctgagacaaaagccacaggtttttgttcgtccatgcatgctttcctcagtttcactgtgcagcacctctcaaactttcatgagaaatttggggtgccctggcactctgtgtttttctaaccggctcccggccgacactgaggctagtggttcttgaaccacgcgtcggtattagggtgctgtgcagtacgtagctcgaggaaggcacttccacagaaggcagtagcctacctccaccctgtttaccacctgcaggattcatctcatctcttcactcaagaaaattgggcagccctgtgcgggaggcctgacttgcactagcggctggaga

SEQ ID NO: 256023 - DNA, 271 bp, Homo sapiens
tggtgggtatgagttccaaggttatccccccaccccactgttccccctcctccctgtcccagagtgagagttccatggggtatactttggtctgcaaatctactgtcaactcttgaggagagatccctcttggagcacagttagatgaacttgccctgtagggaatgtctggtgagggggaggtaaagcgttgtatttgcatttctaaagggctaaataggaagctgaggaacaggggaaaaggagaaaataagagaaaataataaaaaaa

SEQ ID NO: 256024 - DNA, 528 bp, Homo sapiens
agctgccaagaacagcacatgctaaggaaaagaagaaaattatagaaataaacaggcagcatcattctgtttatataacgttcaaaagcaggcactaaaggagatatggttcacagatacacacacgagtggtagacgtgcaaatccctccaatcacctctggctgaacgtcctaaaggtaccaagtagagtaaagcgaatcagatgcttcccactatcgtattctgtgcctgtgagtctgaagccacctataatactgagatgtctcaggaaggaaatattcttgtaacatggtttcactgataactcttttaaaatctgaaatccttaatatctgaaataataaagaatttctttccatattatgacatacagtgcatacccattggctggtgataaaactattacagaaataagatataaattgcttgaaaaggtgtttggaattttgtaagataaaaagtatttcagtctcctatttctttgtaacttacaaattaagaattaaaagatattcattccaacatg

SEQ ID NO: 256025 - DNA, 376 bp, Homo sapiens
gtattttaattgtctttaccattattaaggaaaacaatctgatcagatagtggcaggaagttgtgaaagatttaacacattagattatacagtgttatttgcactttatttgacctgcctgaaagaagtaatgtttactccaatagcatacatttttattgcagaatttcaacaatgtggccagtaagtagttcctgcctaccccatatgtgtgcaagtcctaacccaataacatattacaaaatgaacaaattcatgacctcaatcacaattcttggcattatttttttaaaaaagaaagtggtctgggagagacacaagacataaaatttgccctagtttttgaaggtgtggtaaaataaggctaatcagagaa

SEQ ID NO: 256026 - DNA, 424 bp, Homo sapiens
ggaagctaaaacagacctctctttcagttttgtgtcaggtgacgtgctgggtgaaataacagaaaccctcaactccatagattcacaaggggagcatggtgtgtcttttagcagaaaagaaactgatggtgtctagaacgttttatatttctgtcagtttgttgtagtgtatgtatttgagtaatttcaaaacagattcctaggatagtcttttatatatatataatatatataaaattcatatatatataaaatacgtatgggtgtatatgtgtgcatgtgtgtgaataataacattgaccataaattatgaagcctagtatatttcatatatataagtatgtgtattttatgatagctaattgtatgatatttcatttgaagaatttatctctctttgtaattaagaaattacagcatttat

SEQ ID NO: 256027 - DNA, 311 bp, Homo sapiens
gcctctcagcttttgtaaattgttacactttttttaaatggttgggtaaaggaaagtctggaggaatctaactctagcactgtccttgagcagctctcatcaagtataacagctgctgtgtatgtaagagaagtgggggatgactgggaaagttgttccagtgtgatctcctgaaatagatagaagacttgcaatttcacaccaagatccacagcctggccttgttttctagttgcagatctgaagtagtagtagtccatctgtcagcctgacatctttttatgctccctttcaatcactcccagaggaaa

SEQ ID NO: 256028 - DNA, 347 bp, Homo sapiens
aattcagtggcttaaaataacacatttactatcttagagttctgtaggttagaaatctgacctctgatggggctaaaatcaaggtgttggtggggctgcattcttcctggaggctccataagagagcctgtttcctggtcttttcccacttctagcagagctcacattctttggctcctggccccttcctccatcttcaaagccagcaatgtctggttgtgtccttctcacatctcatcactcttacactaattctcctgctatcctctttcacattttaaagacccctgtgattgcatcggacccatctgggtaatccagattaacctccctattttaaagccagc

SEQ ID NO: 256029 - DNA, 361 bp, Homo sapiens
attattccaatttctgactaaattaaagtaacttttcatcaggcttgacttcaggttctctaaatgggcttcccataagagaagcaatcacactgcaggaggtttttctttatattttaaaagttttcctaggaaaactgacttgcatcttatcaaaatgattttctttttcctgtttttttttttttttttttttatcagggcctttgattaagtggtaaaactgagtgatctctgttaaaggtctaaggcttgcttgtttttttttccccctaaactatgtaactttctctaatttcttttaaagtcttttagttatcaccctggtgaaataaatgactgttgtttcatgatcacctgt

SEQ ID NO: 256030 - DNA, 206 bp, Homo sapiens
tttggcccccaaatcaggtaaatggaaattatagatctgttaatggcttaaataccggataatagattttatacaattgattgaatgtataacttgaaacagtgtcgccgctgccagcctgcctgcaagaatctttcttgtggttttgctttgtaaaagtaaatgttttccccgtgaatcttctgtagtgttttattcttggtgtt

SEQ ID NO: 256031 - DNA, 546 bp, Homo sapiens
gatttagaaatatatctaatatttcactgttcccacttccctacacagtggaaattgaaagagaagagactttgatgtcattggagaacctcaattaaactgataacaagtgaaatagctgaaacacgtaagatattattaaatgattaggttgaatattgaatggttaatatagcctgtagaagtgtgagaaaatgtagttccacatccctgatgagaaaaataaggatttatttgcctggttactggattcattcaagttccattcttattcaactttaaaaatatatttattataggattttaataatattctaaggctagggactataaatatatttgcaaatttatattttgattaaaatgctttaccactcaacctaaagagataagcctttcatgaaaagtgtctaacaacatgttatctctacttcccaatctgagttatagagagctaaagaccatgtaatatgagaacattctattctcatgtaactgttcattgtggatttcttgcttaaaaatacattgttaagacattaaata

SEQ ID NO: 256032 - DNA, 613 bp, Homo sapiens
  misc_feature (593)..(593): n is a, c, g, or t
cggcacgagatacagtcacacaatgaagcctgagggcaacagaaggagattaaattgtgtgaaggacaaaaaaattagctagtctcataacccagtcttgaaaaaaataaagaaataaaagaaccacaatggcacttcaaccctcttaacagcaacaactaggtccatggacctacccaaaagtcattttccagctccctaaatgtatagtttgggatggatattgtattggaaattggcagagtccgacgctgattcctgtcaagacaggaacacacaggacaagtaaggaaatgtcaaggcctgaatgattccatcagtaaagctgtaacatgctgcttttagatttagatggtttattacttacatagacagtgaaaacaagaataagcccccagcctggacaacatggtgaatccccatctctacaaaaaatacaaaaattagctgagcatggtggtgcacacccgtagtctcagctactccaaaggctgaggtgggaggaccccttgagcccgggaggtcggggctgcaatgagccttgatcgcaccactgcattccaacctgggcaacggagtgggaccctgcctcnggcagcggatcacctgaggt

SEQ ID NO: 256033 - DNA, 150 bp, Homo sapiens
gttgtgttggaggccaaatgtaactacttacagtaaaattgtgatgttatacaacctacgctcttccctggaaagaatcatgaagaagtttcatagtagtttggtattattggagacattttagctaatacattctaactatgcattttg

SEQ ID NO: 256034 - DNA, 196 bp, Homo sapiens
cctggccaaaatctcagagactgcaggacactgtggagttccctgggagaactcagtgggataagtacacatttccaccagagaaggaaagccagctggtctctgagtgttaataaggctacgtggattagatgttcatgctgagttattaagcctcatttaggagttagtttttccaagttcctactcaagtttt

SEQ ID NO: 256035 - DNA, 333 bp, Homo sapiens
gggatctttaaaggttcgattgccttctcttctgagaatattcctatgatagagtctcaagagtccagagaattcaggcaaagctgaggagaatgacacaggccattaagctctgccccggacctatctcatctgccctttttagttgttaagtcgcagtagggtagaaatcttaacgaggtcagaagtgatgggtgacacagctctaaatgccaggtactgagttttcacatcctggtctcctcggaggccccgggcatacagagtcacctactcctaaagcaactgcgcctttcagaagtgcagccttattctaaaattaaagattctcag

SEQ ID NO: 256036 - DNA, 389 bp, Homo sapiens
gctgtatttacccagtgcctgtacccccattgtatctaggaagtaactaacttgttttcaattttacaggctcataggcagaagggacttgccttgtctaagatgaggctgggctgtggccttttagttaatactgaaatgagttaagactttggggaacttttgggaaggcatgattggttttgaaatgtgaggacatgagatttgggaggggccaggtgcagaataatatggtatgattgtgtctccacccaaatttcaccttgaattgtaataatccccacatgtcaaggatgggaccaggtggagatcattggatcatgggggtggtttcccccatactgttcttgtggtagtgaataagtctcacgagatttgatggttttaca

SEQ ID NO: 256037 - DNA, 527 bp, Homo sapiens
tataccatactaatgtaagataagtgtttatattagtacattactaatacaatgtaataatatgggaaactgtgtgcaggggtatatatgagaattctctgtgctttttgtcaatttttccattaatctaaaactgctctgaaaaataaagcctgtttaaaagtatatataaatgttatatgtgtcaaaccaaactaaattatgtcaaaatgtcatagtccaaattctacagataatgtctatctattcagctcatttatgtctgtatgtagttgataccaaagtaaagtaagagaatattaagtaaagcaaaagattattaagttaaccatctcagtcagatgcaggatgtgcactaaacatctgtgtgactggctccttttaaaagttttcaaaagatttagccaggcacagtggcttgttcctgtaatcccagccactcagaaggctgaggtgagaggtccacttgaggccacgatgttgagactagccgggacaacatagcaagacaattgtctgtaaaaaaa

SEQ ID NO: 256038 - DNA, 605 bp, Homo sapiens
cttgaggccaggagttcgaggctgtagagagctatgattgcaccactgcattccagcctgggcaacagagtaagattctatctcaaaaaaaaaaaaaaaaaagctgtgaataaatttgggatcacaataataacaattggccacactccttttctaagcttccagattctcactggtaacattaaaatataatagtacctactcacagggtgctcagcacagggctcaatcagcataagttgtaattatattatagccaattaagaaagggagagagaaagagaaactagggagaaggaatagaatggaggaaaggggttgagattatgtcttgaaggttgggatggggagggctctatggagagtatgttgttgatgctactatgaagaactaatcattatttgggtcctggttacctgttatcactgaactttgtggtttttattagctcattgacaatttagaaacagttctttctatagcaggaaaacagattctcggtaattttaaacgtcgagagtttttttcatcacagtgactatgtttggatggtggaaccacgggtggattttcttttctctattttatacatttttaataatgg

SEQ ID NO: 256039 - DNA, 397 bp, Homo sapiens
gccattagattcaactcagttcaacaaactggtccctactgtgtgctagggtctgtgttaggcactgaacataatgcctggatacaatgaatcccatagggttcagcttctaccaagacaagaaagttatcttggggggggaaaaaaaagtaaaaagtacttgtcaaagaaacacatttttcctaaacaaaacttaacatcataaatctggagagaaaaatatccagtaataatatactctctgaatggaaaattcccacaataataacaaaaataacaatgatctgtatacttagtacagctctatttttgcttttcatctaatgatttcaaagagtttagcaaccactgctgagctaatccttagtactaaacttgactcttccatccttctttg

SEQ ID NO: 256040 - DNA, 487 bp, Homo sapiens
agcacaaagatggtggaattgggattaagaggaacaaagggagcccacatcccaatgagaaacattcaggatgtggaggccccttgctggtctccaatgaggtgtttttgtttcacttttggtgcccttcagcaggggcacctcctccaggtggaccaattgacatccaaggacacgtttaaatgttcaggtgccatggactcgatgtgttccttaaaattcatatgctggaaattaatctccaaagtgacagtgttggaatatgggccttttgggaggctccaaccacatgaatggattaatgtcaactataaaaagggcttgtgggagtcggttcactctcaagtccttctgccttatccgtttcaatgctggggacacagcaaggccccatcttggaaccagagaccaaatctattggcgccttgatcctgaactctccagcttctagaactatggaaataaatttatgttctttataaattac

SEQ ID NO: 256041 - DNA, 327 bp, Homo sapiens
tataaaaaagaaatcagatagttcatttttctctgaagtgatattatatgatgaaatctttttctcagtttgaagttttctacacatggagtttataaaatatcatgagatggatctaagtggatttaaaaaaatttcccaatcactaaccagttttagcaacatagtatatttaataatctattccttacacaattatggcagctgtataaatctagacactcataccatttaaacaattctaaaatattttaaaactctctattacgaaaatattctcaagatacaaaactagagtgagtagtataagaaaccccatacatagtg

SEQ ID NO: 256042 - DNA, 122 bp, Homo sapiens
ctatcaaacacctgtgaaggcaaagatcagctctgttctgctctacacggcctctgcagcagctagcagtacttagctctcagtagcacccactccaacagcaagttgtttagctgttcctt

SEQ ID NO: 256043 - DNA, 1053 bp, Homo sapiens
actgcctgtccaacctggactgacatcatccttgttattgatctttgtagccaaatataattattttaaaacaaacaaaaaagaagaatgtaagcagtataagactttaaaacacacaaatgaaaaatatacatgactacatgcttcagtgaactaaaactttcatctgtgatctttattttgcaacgttctgaagtaacattacagtcttttcagtgtgctgtgtcatttatatcccttactttatcctgggaatcctgtattgccattgagcatatgcaaattgagacatgtgcatagcttctccccgttgagcccatcagtggggaggagctatgtaccggggacatttggcaaagattttcatgagtctgttggatgtaacagctccttaagaaaacctcagtttaccttccctattttttaccatttgtaaaactaaggctcagtgatgtaaaatataacacattctgtgctgtggcataactgcagcttaggtttttatattcaagacaagcagaggtatagttgaaaaggtatgaacacttattatgcttcaagatccctttgttggtttagttgtggcattttagaacagcggacttgggactaaagcatctttctatctgggatcagtatttctaagttgcctttaagctgaataaacatttggtttttatatttaattgcttcgatgtgaaacactgcaatttaaaaaattacacatatgtaatacagtattttacactaaataatagtgactggcagtccattggccgaagaagtattatttttcagatattctgctctgtcatcagctgtagacactgacctggtatttatctggaaaggcttgctgtcaggggttcacagtgctgcttgtgggttatctccagaccctttacatacagcactttaggacagcgtgagtcacaggttgcactagaatttgcctttgaaattagacctaaactatgtggaactggaacccttgtacacaaagctctctatcatccaaatcctgctgaactctcttaggaaagaacagtttta

SEQ ID NO: 256044 - DNA, 501 bp, Homo sapiens
gataacaaccttgcaggacagttaacagatgcatgtgaagtgcctacctcatgccagacacacagtaagccacctacagaaaccccttatcttgacatgggaggtgttccacaaggtggcccagccaatctctgtggtcctaactctcattcctcacccacacattggccatccacttactattccccaaaaatgcctctgtgtactttccaaactcagcattttacttgtggctttcccccctgccacaatactccccccaacatccctgatgaaggttttcccaacccttgcaagatgggcttgaagaacccatccttcacaaaatgtgcccttcatcacatactctgagatccttccccaccaggccttaagtggcttgggagtgacactggtctgaatcatctccatccagaacattgccccatatagtgcctggcacagcacagatggcactaaaattttgttgatcaaatgaatgaatgaatgaatggttctaaa

SEQ ID NO: 256045 - DNA, 458 bp, Homo sapiens
taaggtttagactccaagtttaatttgaatatattagctaaaaggttccgttgaggaaagacgtgtggtttttgctgttacttttcatgatgtaggaatgaaaaaggagaaagtagaagcctgttgtgcggttggagaatggaaacctcgtatctattggctggtccagactcctcgtgacttactttgttccttgcaaagaaaaatgtgcccactagagatatattttggcccaagcaccaatttgtcatttcccctcctttactaatattttcatacattttattctttctgctagatctttcggctttttgcccccttagaaaaaggattgaatcataatgtaaaactttataaatttcaaatgtcgcttctctgatggtgagtgatgggacttgtgccatttaaatacaagattatctgccctctatttgtaaataaaatctgctgtacaatga

SEQ ID NO: 256046 - DNA, 699 bp, Homo sapiens
gcagaagaaatttttgacctgttcaggaaatctataatatctgcctacctattttgtaataactgggctggaccaggtatcagctgactgatctgatacggaagtcagcctgtgtaccacaccaatctaattaaaaccattggcttgcatgtctatgcagtctgtaatagaggagacaacagtctccttacaggggtaaacccaatttgaataaaaatcaattttacttgactttttcagctgttttgttgtttggaagtacttgcagcatgtatttttatcttcttttgcttattttttacctgtatagtggttggctaaaatttttgctagctctcctgaaaaatagagccaaatgttacagagtctgtaacaacatatttcatcatgagaaatgcattcttgttgacttggtttgactactttttcctgggctgcggagacagagataaagttaaccacctgggctgagtgtttgtgtggtcccttctttctttccctcctcaattatggtttttaatgagtggattctaaaaacttttttgatgttcttaatccatccatcctcttttcctagtactattaaatacattaagtatttttttttttaaacagaacttatcttatatctggatgatattttagtgcatcttggaatctatcccaggtatgtgcctgggcagaaagacatcaaggctt

SEQ ID NO: 256047 - DNA, 522 bp, Homo sapiens
cccacaaaggtggttttgacctgactgaccctgtgcaaggaggcacagtctcctcaccagcataagcacgtggcatcagatgcggagacagttttggacgtggatggatgtttacacactgagactccttcagtgtcccttcaagaaaatgtggacacaatgtctctgaagcctgttagtgaccatagaattaatttcactaatacctttcggtcaccgactcctgaaaagagaacacgtgaatatcatgagtccgttgaaaaaagacagtaagtgggcttgaaaaaacagaataaaagaaacacaagttttcattttgatcaaggttaaaaggatgcagttaaggaacagctgccttccacctgaatgagccactagatgctaaaacacttttgcttgtctgtaaacatgtgaatacaattaggtttatattactttgaagaaactattgtgttatctaaatttgtaacgtcacatttgagagactcagtgattaaaaacagctattttcactgtagttaa

SEQ ID NO: 256048 - DNA, 6313 bp, Homo sapiens
tgtttgctctgcagaatactttacctgggcaccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatgataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgctttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctgcaagttttatttttggaaatcacaagagctgcttttcttctcctccttctccaaagctgatggcatcatttaccttagctgtatggctgaaacctgagcaacaaggtgtaatgtgtgttatagaaaagacagtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgcatcagacaaaaatcagcttctttatcaatggcgtggagaaggatcatacacctttcaatgcaagaactctaagtggttcaattacagattttgcatctggtactgtgcaaataggacagagtttaaatggtttagagcagtttgtcggaagaatgcaagattttcgattataccaagtggcacttacaaacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaattttactccatattcccgtggcaatgtcacatttagcatcctgacacctggaccaaattatcgtcctggatacaataacttctataataccccatctcttcaagagtccgtaaaagccacgcaaataaggtttcattttcatgggcagtactatacaactgagactgctgttaacctcagacacagatattatgcagtggacgaaatcaccattagtgggagatgtcagtgccatggtcatgccgataactgcgacacaacaagccagccatatagatgcctctgctcccaggagagcttcactgaaggacttcattgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggaaggaactgtgagctgtgcaaggattactttttccgacaagttggtgcagatccttcggccatagatgtttgcaaaccctgtgactgtgatacagttggcactagaaatggtagcattctttgtgatcagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattgggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtttttatatttctccaggcaatgccactggctgcctgccatgctcatgccatacaactggcgcagttaatcacatctgtaatagcctgactggtcagtgtgtttgccaagatgcttccattgctgggcaacgttgtgaccaatgcaaagaccattactttggatttgatcctcagactggaagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaactccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacagctgttgcacactgctaaatcccaagaactatcttacactgtagaaggactgaaaccttataggatatatgagtttactattactctctgcaattcagttggttgtgtgaccagtgcttcgggagcaggacaaactttagcagcagcaccagcacaactgaggccacctctggttaaaggaatcaacagcacaacaatccatcttaagtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggtaagtgtgtttgacattgctttatttaggagacacgaagctccaaaatgttttctatattttcatatccctttacaatgaatttttattatacctacttagagaaatactaattcagccctttgatagcttttgcctgattgtttcagcatgtccatctttttagaattctggggaaaaaagtcaggtaagtgaaggaaaggaaaaataaaagatgaagatgaagaagcagccttattggatcaaagtatgtgctttgtatttgtctttttgtgaagtatgtgccaggacatgtttcttgaaatattattcactgtgttctctgagcaaatgagtttgcaaaatgccctcatgctattggagattctcagtatgcaccccgttactgaaactccaaaaagcattgtaagaaagctattcaactttgcttagctaatcatgcctaacagatatttgatgtaatgttttctttttctttctcttgctgtttccttcttctttttttcactgtgacaacttaatatctcatgttctatgaagaacattgtggggaaaactaatcccagggaaaagataacttctctaagccaggactatggtaaagcaagtgaggctcttgtttcggtcacaaaatttaaaggcactaaaaaactcagtgttaatgtaaattttaatgcaatatttttaaaaatgaaaatcaatgtgaaagcactataaaaatattatcaaaagcttaaataaagacagattgaactctgtaccagcacaatcctgcctcactggccttaccctcctcctggccttactagtaccgcaatattttggaagtcccatgacctctgtgacttacagcttctaatagcatgatttcaatatagctgtaaaaaaactctacttatggtacaccatttttccaatttttaaaaaaatttacaaagtataagatatatattattatgtaaactcataaagatgttcatttaatcatccatgagaaagtcattttggagcaaatagctagtctttaaaatattgcatatgtgaagacaatgaaatggaattcgagctataaaaatttgtattgttttatttttacttaaaatagtaaatagtttgcttttcattgagactggctgctgatgcaccttggtaatgaatcatgattatattctaactgagatatattgagattaatgcatgattaactactctctcagtacatcaaaatcattgcagagtattagaaattgaaccattgagctaaaaatgctcaacttctgctttatattcttaaaatggca

SEQ ID NO: 256049 - DNA, 185 bp, Homo sapiens
aacactgagtcccaacatgacaccattctctggtggcaggttggttacatcggactgcttttttctcactgaaatagacactatggatatggatttgccttccttatacaaagtgctgccaccaaactaccctgaaaagtaatccctgaaaggtctgattatttattttccccactgtaacgtat

SEQ ID NO: 256050 - DNA, 433 bp, Homo sapiens
gcctcagcaatatggaaacattaatgttgtccattcttggaaagataaattaatatcattgttaattatagggtattgtataaatatttggatttttataactttgttaaagtagggagtcaaaggttgtttctcactaaagtggatgataatagactgttactgggcacctacattgaataactcaaggagaacaatcatatcatccacatggacaaatcctttgtgtctaaaatacatcaaattcaatcctcactattagtataacagcaggagaaactaaaagtatgacacgtggacttgaacctgtgctgttttcaagcatgcaatttgacttacttcttccttaatgtataaattagatgaaggttcagaccatgctttgttttgtttataatctctgaatatttctaccttctctgccatggtgttt

SEQ ID NO: 256051 - DNA, 207 bp, Homo sapiens
ctccctgatgttataattgcaaccatattttgtaaggtttaaattagttggatagggtggctctttaatgacaatcaattctgagctacttagttaatgcaataatatactatttattattattattttatgttcttcattaaacttagttgaaaatttgtcatcactgatacgcatgatgaaatttaggtagttacccaggtgttt

SEQ ID NO: 256052 - DNA, 428 bp, Homo sapiens
cacatgcagaaatatttaattctgtctaggacagtaagagaaagcttttttggaatttgttttatttgagtctcagcaggtaaagaatggagacaggataaggcatttgaagccaaaaaaaaaaaaaggatgtacttgaagaaggtagagagagagatgctggcacaccttgaaacctgtccgccatccagcccaggtggagggcagggcacttaatcctagtagcagcatctttggaaagtagggaagtccagagtcatttttccatcttacagaagagagagtggaggttcagagtacttaagggttaggcctggaagctcctatttaaggagctaaatcactgaccttgaactgaaggcttccagcttctggtctagggatttaaccacctcaccaaatgcttcttttttctttggctatgtaga

SEQ ID NO: 256053 - DNA, 454 bp, Homo sapiens
ctaatagtgctactgggctatgcagcaactgcaatgggaagccccatgaaacacaccaatagacaaatgctcaacaaacatgataaaatacaagagcagcacacgataagactcatttttccattcattttgacaagggtaatttagttttaattactaatgataatatatattgtctactagtaaatgtctggtggtgaattttgtgaacttttcatcttaggatatcatagtactcctgaatttgttcgttaaacctttgttgcaagccagaagaaaatgagcaagtttgtgaattgagaaggaggcataaataagctcctactgtagcaactatatatggtactttgaaaattagagaacaagatacagtggccttttaaaatatttttattcaattggaatactataatttcaaaattaataaattgaatggccatattcaattctgtct

SEQ ID NO: 256054 - DNA, 357 bp, Homo sapiens
tctctgaaaccacatgattatttatgagctacgtgcaacttactgcattctttttgagctagcaataaaaataatccacataatcatagagcctatgtggcattggactttaactgctgggatagcatgtcccacgctatgttcccaggaaccagggatgacaaggacaggacattattgcatccactgcctccagccctgtgccccctgcccatggccggccaaccactgaacttgctctggctgagcctgacaccacttcagaatccttcccatcagcattgctggcagcctctaccaactgggaaacagaatgggaatctattttgatcccttcttgaaagctagtcctgagga

SEQ ID NO: 256055 - DNA, 379 bp, Homo sapiens
cccacaacagccccccagccacccccaacctggcctccagcatctctctctgccgagtccttgcctctcccccgaggagagcggagcctccaatcagggcctgggaaagcaatttttcaatctccaactgcaaacactaataccgctgaagctaattttacagatttccacttcgaggccttgcctttgtcccagaatccctcagcccgggagattagcagtttagagactggaaaaaataagggagacgtcaaagccgccaggaccagtcaaagtaatatgcctgcgaccggcacatggacttttatttcttctccctccacgctccagagctgctcctgcggcgtggagagataaatattttaaatagcgacacttt

SEQ ID NO: 256056 - DNA, 309 bp, Homo sapiens
ggcctcagtgttcagatctaggaaatgggggcatagattgaagcctgggtaggctcgagcctggtttagccatcctggccccttttctgcatggggcccggggacctgccctggaggtttgaggagagggttcagtgcggtggtcttccccatgccgcagtggacattgggagcccccttggggcaaatggcctgtgtcactcaccactgggctggcccggactctgctccccaggctggttcctggcactgactggcataaggccaggctgcctgggtactcagctcccatgctggccacaggggctc

SEQ ID NO: 256057 - DNA, 468 bp, Homo sapiens
caggtgtaaatgtttcagtttttcaggagtctgctgataagatgtaaactaggccattccactgtctaataactttgccgaagaacaaataatcatgatagttacttagaactatttgcagtcaggagatgactagaaggcagacagtggcagagcagcccacatccctgctcactttgtggtatactatgacccgcattttccttatagatgatgtaagcactgttacaaagggaatgctcagggaggtatggttaaataacagcacctgaaggagttatctccttgaggggatctttgaggtccaggaacttactatgatgaaatctgtctttctcttatcaacctgtattgggtctgtgttccttatgtattttcagtaatgataatctaaactaactcaggaagcctgtaaaatagttatattcccctcattgtgtgtttttatatttacctgtaatcccctct

SEQ ID NO: 256058 - DNA, 191 bp, Homo sapiens
  misc_feature (183)..(185): n is a, c, g, or t
  misc_feature (188)..(190): n is a, c, g, or t
ggcacttgatgtacattcgcgttccatcttcgtaaaaagcctgtggaataggtaggtattatcttttatagatgtggaaatgtaggcttcgttattttaatagcttgtcgaagctttacacaggtagtaagaggcagatttgaacctaggcattctgattgcaagtaattccctttcattatnnnacnnng

SEQ ID NO: 256059 - DNA, 363 bp, Homo sapiens
atatctgtattagggctctctagagaaacagaatagatagatagatagatatagatacagatacagatagataatagataggtatttcaattcaaatgttatttagaatgatcaaaatatttggaaatttaacaaaaaggttgactgtttgaaagcttgtttaggccaggcacggtggctcccagccgtttgggaggccgaggcaggtggatcacctgagatcaggagttcgagaccagcctggccaacatggcaaaaccccatctctactaaaaatacaaaatttagccgggcgtggtcgtgtggtcgtgagcacctgtaatcccagctactcaggaggctgaggcaggagaatcatgtgaa

SEQ ID NO: 256060 - DNA, 706 bp, Homo sapiens
gacagcctgacgtatggtcgggcggacagttagaatgagcgaatgcgtggatgatgtactaccagtctccgaccaccaccagttttccctagccggaaactagtagcaaagcttccccgagaccgctctaaagctgcagttctccagacggccgccggaagagggcgctgcggatcgcctcggtctgcaaccttcagaccccaagtcctaggcagcgagggagaattcagcctccctcaagtcccagaaaacattgggcctcggagattccccctccacccttccctcacacccaccccaatggcctggggtcgatactgcggccaccggaaactgcctgggacaagtgttggggatgtgggggagacgggctgtggtgggaggttggagaggaggaaaggagcggaggagggaaccccagcgctgctggcaagcccgcgggaaactcgaacacccaaggcccacgggctcccactgttgggactgagatttgttggggaacagagggcagaaagagctataggtttcgactacctaaagctgaatgaggctgcacaggtcctggggcgaaaacagccgcgccgccacaaggatgcttcgggaatctgtcctttaattatcaggagcagctgcgaaacttaccttagcgcagcacgaaccctagagcgcccccgagggtgtccctgccccttccgacgggggcgtc

SEQ ID NO: 256061 - DNA, 290 bp, Homo sapiens
gctaagctattctattgccaaagtagttaaaatcttattttgttcaacctaattctgaaaaggcaaaggttatagtgaacccagcaagtctttctcccactttgtagtctctcacctgtggaagtcatggctggcatttattcatttctttcacttgtgagttttccctttgccatcgttctgtccttcaacattcattgcaaatattttacagtgcccacactatgctgagcactgtgctaagccctgaagatgcagcagtgcataatgatcccttctgtcgtcttctc

SEQ ID NO: 256062 - DNA, 738 bp, Homo sapiens
aaagctaacatccaactaacaggaattccaaaagataaaagagagagataaagcagaagggagaaactattcaaataatatcacaagcaaaatggtcagaattgaaataaagttgtccatttgaaagggccctggagagcaaagcacaacaaatgaatttaacacccacatcaaggcaaaccatcatgagattttagaatcaagggatcaaagagaagagccagaaaatttcagacaggcaaaacaggtgacatagaaagacaggatcaataatcagaatggcatcaggtttcttattagcaatgctggaagttgcaagacagtgaactaaattaatttccaaactctgcatttatacttaccaaatatttatgcagttgtgaggattaaggataaaattttttttccagacatgtacaatttatatatatatatatatagtgtctctcaattgaatcccagtaaggtaggatatatatatatatatatgtatatcttctataaactcttagtcaggaggctactggataatgtggtaaaccaaaatgagatagtaaagcaagaaagaggtatacatgtaatccccaaaacaggacccaacacaggagagatgtcaagcttcaagggaagccttggaagctgaaactaaccagaactgatggaatcaggggaatggatatttccaggagggtttccccaagaaagtaaaatggacttgataaattacccaatgtgcct

SEQ ID NO: 256063 - DNA, 289 bp, Homo sapiens
gacgacccctgcctcacatcttccctctctgccctatgctgggtggggctctgggcacttcacacacgtgggttgctggagcctggacttgaggaagcctgactccagcactgctggccaccagggtcccaggcatccttgccttgtcacttccctctggctttagctcagatgcgaaggtgctgtcatctgcgacccctctaagggaggctccccagggaggcccgaggggcagtttaatgaggaaacaacgtggccaacacgtgtctcccggggagcagtcagggcc

SEQ ID NO: 256064 - DNA, 427 bp, Homo sapiens
gcaggacccctagcaatggggcacggtggcctgtccccagaacttcagactgatggctgtcctggagaaggagctgggttttctatggatgccgacaaagctgggccagactgcagggtgccaccagtggaaatgatggctgttgtcttcctgagagtgagagagccctgtgggcttcactgtgatgggtggttcatggcatgactgccagagcaagactgctggcttcagtggctgtgtgccttgggacagatgacatagctcctttgcctcaattttctcatctgtaaaatgtgcatggtactagaacctaaggtgactgtgaagatcaaactaattaattcagagaaagtgcttggaaaaaactgattgccagctcctctggcccagaggactcaataaacattagctatgatcactttttctc

SEQ ID NO: 256065 - DNA, 295 bp, Homo sapiens
accatagtgggtttataacttagtttaactagccccacagaggactcaaactatgaccctgacctcaaaagcacaggttcccaccaatcatttatgtgttggcacccctataaaccttggcagtgcctgaccattggccaactaagttcatgctaacatttctgttctaaacatgggagtttaccaaaccacgcttttcctcagagattctttgtctctgaaaagacaaagaactattctccttaagaagaaaagagcaaacagtaggctgaaactacattcaatatatttgaaa

SEQ ID NO: 256066 - DNA, 146 bp, Homo sapiens
cccctcaagcctctcacctagccactcattgctcagtcatcagccacatgatatgctagccatcacgacagcctggtccctggctaggaggcccctcccatcatgttggccagctcctgctcatccttcaataccctttctgctgc

SEQ ID NO: 256067 - DNA, 611 bp, Homo sapiens
gcttgatgttcccctgagcagcatgatgcttctgtatttcatactcagaaggcaaatgatgaatagatagttaatcaggtaaaataggatcaaaatgcagtagaggttttaacaatctcattctgcctttcctttttagaatcttatgagatatagtgctccattgagagagaaggacatggggggtgagagcaagagagagtagtctattatcttactcgatttcctgatgcagtggttaacaaaagggggcctttttatattagatatgtgaatcacagatgaagcctaaggtggtgtcagaaggaaggtttgggctttgtgaaacagagaaggaagttattttacgtggatctgcggcagaagatttaaaaggaggatcctcattgttcctttccaattgccattctatccaggagggatggaagtgaacaaaggcaagcagagtaatgatagccttattacaacacagactgaagagacagcttctgaaggcagacagtaacacagcttatggagagacatgggcaggactaaccatagtagagtaacagtcctttgaatgccacttgtgggagaattgggaaatatttctcacatctgtgtgtcaa

SEQ ID NO: 256068 - DNA, 402 bp, Homo sapiens
tagcataactcttgaatctctacatagggattcagaatacagctttactgagacttattagacttccagccctttgcccttgaagttaacaagattagcattctgcaggatatcttttggggaaaactgctataggtaaataaatggataacatttcaaattagacacaggtgtttaatattaagcgctatgacaaaggcagttacaaagtactaacatgtaaagagtttttttctaagcatagacatttatttcaatcagctgttttaaatttctccacatatttgtgaagacaatgtgatcaatgtctacacctcacagattagaaaatgaagcaacaggccgggcacagtggctcacatccataatctcaatactttggggggctgaggagggtggatc

SEQ ID NO: 256069 - DNA, 536 bp, Homo sapiens
ccatgaactttaaacagtgattgcttcaaaatttccaagagccatactctccctccagctgctgtgtgtgtgtgtgtgtgtataaatgcacactattttaacctaaaatggtgccctgtggctgccattctctaactcttgcatacttaaacatttattcttggtcaaattaaaacctcatgcatttccaaagatataaatgccttgcctggagaagttagatcttgcaagtctcaggagggccgagatggtttgtcttatgcctatagctgtttatgtcccaccagtgggtgtttgtttcattaggtgccgtttccagccaaatgttctcattcttcacatcttcaatgttgagtagcaaacagaagaacatccttcttagcataatattgcttcactggactgattgtgaactcaaaatacctcttgtttcttgtgaagggtttgccttttgtaaacaatataagatcacttttggtcaaccaccctgtctgaatttatctgggctgctataataaagtatcataaactggaag

SEQ ID NO: 256070 - DNA, 454 bp, Homo sapiens
ggagtttgagaccagcctggccaacacagtgaaatcccatctctactaaaaacgcaaaaattagccaggcgtggtgtgcgtgtctgtaatcccagctacatgggaggctgagtcaggagaattgcttgaacccaggaggtggaggttgcagtgagccaagattgtgccactgcactccagcctgggtgacagagtgagactcagtctcaataaaaaaatttaaaaaaattaaaaaaacctatatgtgaactcttgaaaatgctaacttataatatatgatagttaaaaacatcatggcaatatgatgagatttacttcattttatattttaaaatagcttttttatcaggatggaaaataagaggatgattggctgtgataagaattcacaaccttattgaagatcacagtgtcaaggtgccaaatcttttaacaggaacctgctaaatctttt

SEQ ID NO: 256071 - DNA, 451 bp, Homo sapiens
catatgttcaacttgtgtagataatgccaaattgttttccaaagtagttccattatttcacaatactatcaggagtatatgagagttctgttattccacattcctgtcaactcttactatggtcggtctttctaattctagccattttagtgagtgtataatagtatctcactgtggttttaatttgcatttccctaatgactaatgaggttgaacctctttcatctgtttactgaccatttaaatattctctttttgaagtgttttctcaagtgttttgcccatttttagttgtgtttttgtatattattagtaagagttcctaatattatctatatacaagttatctgttgattataagcattaggactattctctgtctctctgtggtttgccatttcacttttctaatggcatcttttaataaacagaagttctttgtttcaatgag

SEQ ID NO: 256072 - DNA, 417 bp, Homo sapiens
cgctgctgtgagccccaaggcagagagacgtcgctgcggttttggggttggcatcctgtcctctgtgcgcccctttttcctgggatgagcggttagcggaggggcgatcggcccatgacgccctctggtggcggaggaggccaaacgctggaggctcggctggtttctgggctcccaggtcctggagggggtgcagctggcgagagggaacgaactgcatgggccagggtgggtctactgcagggacagataggtgtcaaaccccccaagacggattttaatctttggttaagtgagaacgtgaactctagaggcagcctgctgggtttgaatcctacccacgtcactttgtaactgtgatcttgggcaagttactcgacctctctctgcctcagtttcatcaaatacaaaacaagg

SEQ ID NO: 256073 - DNA, 371 bp, Homo sapiens
aaatgcagttcaattatatactgcagcttgaggtgagatagaagtgaagatggcttaacacgtgaagtgggtaaaaaaaatgtgtaattgaaacagtatgatgttgatgaggcagtgtgtgaggctgtcaggaggcattataataagctgatgaacgagactagcttcctagttctgctgtatgcaaatgttccattatttttggtggaggaaaggaacctggcatattaattggctttgtttttagagatgcaggtgaagccttttcattttgctttctgaaaagaaacttgcaatatgtccttaaattatgtttaattttgagtgtcgacttacaaagaaataaaaactcttcatttttaaaaaattta

SEQ ID NO: 256074 - DNA, 321 bp, Homo sapiens
aaatattcttatattggacatacaaaaatgtcatgctaaattcttcaattataataagttagcatatcattattttgcatcagttgagacacaaaattatcaacagccctttaattgcactctaaaaataaaactagagttcatttttatcagcttcctattttctgagagtaattttaaattaaaaaatatataactttgaaatggggggaaatctctccctcataggatttcatggcaacactgacttctgaaagactaggatagttattcaaatgtagggagtgtgagcagttcattctgaaatccccaactgagctg

SEQ ID NO: 256075 - DNA, 406 bp, Homo sapiens
gcactcttcatccaacaagatgtgctggtcccacttgctacactaaatgctctcccagcacagtctgagtcagtcaaaattcttgatcttggggccgggcacggtggctcatgcctgtaatcccatcactttgggaggctgaggcaggtggatcacttgaggccaagagtctgagaccagcctggccaacatgatgaaaccttgtctctactaaaaatacaaaaattagccgggcatggtggtgcgcacctgtagtcccagctactcaggaggctgaggtaggagaatcgcttgaatccaggaggtggaggttgcagtgagccgagatcatgctactgcactccagcctggccaacagagcgagactctgtctcacaacaaaaacaaacacacaaaagaaacaaac

SEQ ID NO: 256076 - DNA, 443 bp, Homo sapiens
tgtgacatactctaagctttaatttatttttcagtaaaatgagaatgacaatagcagctaatatatagactgattatgatgaataatggtgtaatacattaaatgtcccagcacaaagtcaagaacataagaggtccctccttcggattaaggagcgagatcaggcccaaactccattgagggcaatagaaaaggagatgaatggagaaaaaccaagaaaagtatgtgttttacttggttctaaattgatgttttcagttttgcttttggaacatgtatttaaactcttgaagacttgaatggaaatgataactttcctacattctgctagagacagctctctgcaatgcagccagcagctgctcgtagcagtcctgttctgtgcaaataccatagtctccatccatcaactgagcaccatcaagttttcaaagcttgccttg

SEQ ID NO: 256077 - DNA, 399 bp, Homo sapiens
cagcagaaatctatctgactgttttggaagcttgaagtctgacatcaaggtgtcagtacgtttggttccttctaaaagctgtgagggaataacctgttctaggcttctctccttggcttctccttggcttctccttggcttctgtgtctcttcccatagtctggcctctatgcctacctgccactgaatccaatcaggtatcagggattcgggcccaccataatggccttattttaacataagcacctctgtaaagaccctatcttcaaataaagtcatattctgagggactgggcattagaactccaatatatcttttttggaaggacacaattcaacccatgtcagcatctcagagttctttagccttttacattctgaagatattttggctccttc

SEQ ID NO: 256078 - DNA, 537 bp, Homo sapiens
tgagatttgacaggtagaggattttttaatggaatgaataagacaaaataggtttttattttctttagtagtgttttgtcctttcatttataaagggaaaactggattccttttagtaatttagatccatgtgctgttaccgggtcaaaggaagcggtgaatgacggaagccacagttgaggcagtcagcggaaacacagaaacaagggcacagacagtgggaacatccactgaaactctaaaagtgaatgtgaatttattccctgactgaacttggaagatgagtatgtctgcatataccacccacttgcagatgcaattataccagcaactgagagatggaggaaatactataaatctgttttaaatattatgatccttagggacatactggcctgttggccttgggcctatgtaatttctgataatgttttctttggattattgttatctataaaactttgtgattatgtggaaagattaaagtacattatagtattaacttacatttctgcttttttttaaaaaaaaaatttt

SEQ ID NO: 256079 - DNA, 499 bp, Homo sapiens
  misc_feature (332)..(332): n is a, c, g, or t
gatctatattactattttaatgtacttttaaattatctttatgaatattttattgagaattttggctctcatatttaaaaatgaaattgtctgtaatactttcccactctccggcacctgagtccatggctttggcagccatagtgatcatgaacttccggctatgtcctagagtcatttatctccgaggatgtcaggaggaaccccaaaatgtcatcaagacactggctacaggtctaaactccaataaaatccagctgggttacatcaattcagacatctggataaaagggtgaaaaaattttttgtttgcggggggcaaaaaaaaaaanaaaaaccccccccccaaattgtgttttaaccccaaaataatacagaattatgcatgccaggaaaaaaaattatactgcctaaaagctgcaaccttcatgacatcaaatctattttaacactggctggttatgtgaggaaaaggctaataaaaaaaaatcttgccgta

SEQ ID NO: 256080 - DNA, 946 bp, Homo sapiens
actttccaactatttgtatcttttgttctaaagtgtctcttctgtagacagcgtatagttgctcatgtttaaaaaacaacggaatttcctaatctcttaaaaatttaatataattgtcatatggctgggtttatgtctgtcattttcctatctgttttctatatgtcttattggttcctctgttcatctttaactgccttcttttgtgttaaacagatcttttcggttattctattttaattctttggttgttcttttaatattttttgaattgttttcttactggtggtcctagtgtttataaaatacaacttaaatgatcacagcctccctcagattaacaatatatgtgtaacatggccttttatatgacttgaaatcaatttgagagaagcaattctattgctcagtccagatttccaaaagatactgaagccatcatcaatccaggcatgtttataaaagggactgtgagcctgagataggagacagacactacacactaacaattctgtcacacttggacacaatgacaccatcaccacactaagtcatagagaccaggatacaggaacgatgatccagccacatggctgactaccattatcattggaatgttatagttccctaagaagaatattctctggacaaaatgcttactgtgagaattcccactggcctgtgagcatggaatggtataattatttctgatactttctgtcatatttcaagggcaatgtttaaactctttcatatgacattcacattttggtctacatgacctgtggaaatggagtaaaaatatgggaagatgagaaatatacatgtccatttgtcaaatatgcataagaaaggaggcttcactatgtatctgcatataaaatgtactaattcattactctactaggatgtctctgatattattcaaaatataaattgtgcaaaa

SEQ ID NO: 256081 - DNA, 427 bp, Homo sapiens
aagagtacttgttgcctttttggtgataaaattgtctttattgacatagtataaaattgtcaaaattgtttttttccagcttattttcttctacttcaaatggaaatacccatttcattgcattattaaatgaaatggtattaataaaattcttagtgcagtactaagaattacaaatataagcctataattctctcgtctgtggctaagcagtcttgccctagtttctcttaacatttgatttttttttccttcaccatcatgctttttaaatttgaatgttatataggacttgagtttctacttgtttttagttctctatatttcagtttcagaaaatagtctggatttaagtctagataattttctggttagagtaaaatcatgtgtggttgtatttgagatagactactacacttaaaagcaa

SEQ ID NO: 256082 - DNA, 246 bp, Homo sapiens
aggcaggagaatcgcttgaacccaggaggtggaggttgcagtgagctgagatcgtgcgaagactccatctcaaaaaagaaaaaaaagaatgtacaaagtctttttagtgatctatccactttaagtagtatatgttagccctaaagcatattatgttctgttaaattatagccttttctgccttttttttaggttgacttaaaatctgacactaataaagttaaaatattacatttttagaaatat

SEQ ID NO: 256083 - DNA, 655 bp, Homo sapiens
gtataataaactgtctctggtgattattcaccccctgagccttagactcctgttttctactgccacgagtttgccagtctagttcagggacggttgcctattcagagcaaatcaaaaccaagcttttagggtcactagctggacttagaatcaaaagagatacagaaatatctttattctattttttctgttctatatattaataagaaaagaatttaaaaggaattaatcttgaataagttcaggttagtgaaaaaggagagagttagctttggatgaaaagattcttaagagacataacaaatcaaatgtattgtggaccttgtttagatcctgatttaaataaaccaattgtgagacacattttgaggcagttggggacgtctgaatatggactgattggtgttaatattgttagtgtgataatgactttttggttatgtccatattttgtgtgaatgccgattgcagtatgtataagtaaaaagaggaatttaacaaaatgaagtatgtataggtgagatgagtgacatctgggattgctttacaatatttaagcaaagtaaaaagacatatttgaagcagctgtgacaaaatcttgataacttttaaatctgggtgatgggggttcattttattatttcttttgttatat

SEQ ID NO: 256084 - DNA, 417 bp, Homo sapiens
tttaaaagaaagtaaaataagagggatgaggtatgttatatttttaaaaatgggtatattgcaaagccatctaagataagagaatcattgagggaggaaacaatgcagctattgggattaagatcatttcaagcctaggaatcagtggatgtaaaggccccgaggcaggagcatgctgggcttctgggagaaatatcagcgtgggcaaaacagagtccaggaagagtgatggtggtggggctaggagtggggagtagagcatgtagggcattggtagtcatgatagtctttacattttacattgattgagacaggaagactgaagaatgtttatcagagaagctaaatgatgttgctggttgtttttttaatctaccgttttgttgaggacagattaaaggacaaagattaaaacag

SEQ ID NO: 256085 - DNA, 255 bp, Homo sapiens
gggcacagtcaatgactatggagaagaatcagtgtcaaaccatagttctgcttttagcttcctatttctttagtacaaaatagagataatcataatttgcctctatcatcctgatacctaccctgcagaatagtagtgggagttaattgggagtatggatgcaatgtgctcaccatactcctgacatagaagatactcaatcaatagcagacatcactaacacgcattcaatacttttttaaattgttaagttct

SEQ ID NO: 256086 - DNA, 474 bp, Homo sapiens
atcttccactttgacctcttattcctcattggcagaaagccgatctcccttgtaggaagatggaaagtaccagaacttatcctcctagcctcccttgcagctagggcaaggtcatattacctgactgtgcccagtgagttccttgggacagtttgctcatgagttttgggaaaaattttcccttagtaaaggagactcaagggaagaaaagccatttctccttttcactggcctggttgggtctgcatatgatgctgggaaccgcttttgctatcttgtaattatgaagagaaacataagtcatcctgaggaaggcagggaagaaagatgacaccattggaattctccaacttcttgatatctcagggaggataaatacagtttctcaatgtttcggttttaaattatatgccctgttacttgaagcaataagatactgaaccgttttttcaataaactttttgagtatatgct

SEQ ID NO: 256087 - DNA, 536 bp, Homo sapiens
atgtaccctaggaaatatagaaaaaaaatgtagatgaatattaaccttgaaatgaggaaagagaactttctaaacagaaatagaaaggaaaaaccaataggtttagctttataaaaataacttcttatagattagaaaatgctgtaaagaaaatctaagagatgactgttaaatggggagagaatatttgcaacatttaatatataaagtgttttatcaatcaatgtgatttaaatggctaaaaatcttgaaaaaaatgcaggcttactaacaactgaaatgaagtgaattaaaattgtgagaccctgttgttttatataaaaaaacatgtaaaaatagaccatttttacactcctaaaatcaagagtttgaggatctgggactcttaagtgcagttatgggaatgaaacgattagagcctcatctaatcaaagcacatgtatgcttttgtccagaaattctgagaatttaaggatggtatcaaaagcgtacataaagttttaactcagagtacgtttgctggagcgttctttgta

SEQ ID NO: 256088 - DNA, 346 bp, Homo sapiens
aaggccaaagccagtcattctcttagcaatccactttgaagttttatttgcccttcatgttctggtaaaaatctcaccaaaggattgttttcaatctaagtaaataactcgttagagcacactttcaaatatcttctgtgatttgttttttttttttcgacagctttctggttatgcttaagactgttttgcctagttacaaaaggaggaagaaaacactctaaggcacgacaacctagagaactgggcgttgtccaagctttggggaagcaggccatttttcagtagaccagttgctgctaagcgttttctgacccacacacccacaggtagtgcacacactgtc

SEQ ID NO: 256089 - DNA, 428 bp, Homo sapiens
tacagattgacgccaaccacatttcctcagagcgaaggaactcgtgtttggttacctaggtctcacttgtgttttagtgcagagaattaaacatgtgtccaggcgccctccttactgtaccagatctgcctgtaaaaccatgaactggtttgtagcaaaacctgcctcacactttaagtggagttatgttgtgtttgtgacgtgtgcctggtgcaatagaatcagtgctttgaaaggagtctctctgcctcctgcctcaacccctccaggattaactaagaagagtgattgtcccagaaactgcggtctattgtgtatcatttcatggggattttatatcagtaatcccgtgagtgcttttcggtgtaccgtggatgtctgatgaatggccacattttatagcatattatataaaggcatttattgtg

SEQ ID NO: 256090 - DNA, 663 bp, Homo sapiens
aaatgggacagcatcaagagtacaaacgtgtacagtggaattttcaaaggagagaagagagagaaaggggcattaaatacatatccaagagactcaacaaactccaagtatgataatctcagagagccacacttagatatatcatagtcagaggatcaaaagccaaagacagacaatcttgaaagaatcaagagagaagtgatggatcacattcaaggatcctcaataacagctgatttcccatcagaaaccatagcagccagaaggcagtaaggaaacataaagtgctgaaagaaaggattattaaccaagaattctacatactacaaaactgcccttcaaaaactgaaagataaattaagacaaacaccgagaacatctgttcctaacagacctgtccaacaagaaatactaaagggagtccaggctcaaacaaaaggacaatagatagtaactcgaatctgtatgaagaaatgaagactccagtaaaggactagaaaagaaaactatacaggtaaccacaaaagacaatataaatgtagtttttgtttgtagctcttttcttctcctgattaaagagacaatggcaaaaaacagtaattttaaaactgtgttgagcttgtaatatataaataatgtaatttgtatgacaataacacaatg

SEQ ID NO: 256091 - DNA, 426 bp, Homo sapiens
ctgctctagtcacacaactggaaactgactagtctacgcatggccaaagcttgaggagtcatcatcaaatgagtagatgtacatctagttcttctatttgtctacctataggtgcactcataacattttaatttatttcatgtgttgtcatcgttatcctctgtattactctgagaaagaagatgttacctgtttgtgaaaaagagggtcacagagtatgtgtgaaccaatacttcatttgagacagcctcacatggagaatgcaatgagccattctcttctcacatacaggtaaattggaagttgaatatgacatttactgcagtttgatcactaagcataagacctttctttaaaaaaaattatgtaagcaaatttcttctttttcaaagggtttttaatacaatgtttatgcttcattatggc

SEQ ID NO: 256092 - DNA, 590 bp, Homo sapiens
ctgctctagtcacacaactggaaactgactagtctacgcatggccaaagcttgaggagtcatcatcaaatgagtagatgtacatctagttcttctatttgtctacctataggtgcactcataacattttaatttatttcatgtgttgtcatcgttatcctctgtattactctgagaaagaagatgttacctgtttgtgaaaaagagggtcacagagtatgtgtgaaccaatacttcatttgagacagcctcacatggagaatgcaatgagccattctcttctcacatacaggtaaattggaagttgaatatgacatttactgcagtttgatcactaagcataagacctttctttaaaaaaaattattgcactccagcctggaccacagagcgagactccgtctcaagaagaagaagaaggagaagaaggagaaggagaagggaaaaaagaatcctcatcattaatgcaagtggaaggaaactcttcaccaaagaattgatcacatcatgaaaggtgaaatcattacggaattgcttaaatatataatttgaatctggatttaaaaataataaatgtaagttttttcttta

SEQ ID NO: 256093 - DNA, 273 bp, Homo sapiens
gcccagggaacatgagatccaatggtctaggacaacactggggatactgaagtcttgggggaaagcaatcgggagccaggggctctggaagcgagggaaacgggtgtggaaggacggaccctggaagagcatggggcctgggggcccaaaggaggaggaatgaagcggcactagggagttgctggggacaggaggcctttcacctgagccagcactgtcagttgaaaaggcaagaacgcaacagctcttcactggagtttcttgcctccagat

SEQ ID NO: 256094 - DNA, 151 bp, Homo sapiens
tctgggtgccaaggacccaaggcccagaaaactgcatgcagagttgttggaaaaaagtaaaacagtgattcctgttttgttgttttctaactcactaaaaacttgcccagatagtccattaaaccagcataccagttttctcagcatgcta

SEQ ID NO: 256095 - DNA, 241 bp, Homo sapiens
ccctgagcgatgattaaccatagccaccagagtgtggtaataaattctagaaagtggactcatacagagcatgatttagttaaaagtctttcagttaagtaaggtatgttagaagacgcaacacataccttcaggctaatgcctgcccagctaaattcttagcctgttttcaaacaaacaaacaacaaactttctgcaattatgtatactatacaaattcacaagttaacatgtgtgatgc

SEQ ID NO: 256096 - DNA, 298 bp, Homo sapiens
tttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccc

SEQ ID NO: 256097 - DNA, 236 bp, Homo sapiens
gggtggagaatgggagggaatgattgtttgataactatttcttctatgattgttggcatggtttagttttttcttttatccgaagttttggtaaaaatatatttttcagtcccagctactctggaggctgaggcacaaggattgcttgaatccaggaggcagaggttgcaatgagctgagattgcaccactgcactccaacctgggtgatggcgtgagacagtctcaaaaaaaaaa

SEQ ID NO: 256098 - DNA, 376 bp, Homo sapiens
tacctatgtacacacacaatcctctcacatatgcacattcacacttacacacatacatgcattacacaaacttacatatatgcatacaaatataggttaaggaaactttttcaaggctcaaaaagatctaggccatggtgagacagaacacagttgtgtttttactgaaacccctcgtgatagtgcacacatgaacacacatgcacacaagccccaaagctgagaatcatttgccatcacttcctgctcccctgtcagagtcagcgcaagaggagaaaaatcggaattctttccctgtctcaaaagtaaaagggacaaattagtttcttgtcagtgcactgcaataaatacattgtcatttttatcccccagtgaa

SEQ ID NO: 256099 - DNA, 351 bp, Homo sapiens
ggccatatgtccaaaagtcctttgttcctgaatattctgggtaaaggtatcacctgtaaaaactttagtaactgagaaaaataagcaattactctaacaaagccttcaaccaaattatgaatatgcaaataactattgtgccttcaatgtctgttttatcctaaattaaaatgcacaggaaacagaatctttaaaaagttagttgcagccgggcgcagtggctcacgcctgtaatcccagcactttgggaggccaaggcaggtggatcacctgaggtcgggagttcgagaccagccctggcaacatagaccagcagctctacaaaaaattaagaaaatacctggggcatgg

SEQ ID NO: 256100 - DNA, 346 bp, Homo sapiens
ggccatatgtccaaaagtcctttgttcctgaatattctgggtaaaggtatcacctgtaaaaactttagtaactgagaaaaataagcaattactctaacaaagccttcaaccaaattatgaatatgcaaataactattgtgccttcaatgtctgttttatcctaaattaaaatgcacaggaaacagaatctttaaaaagttagttgcagccgggcgcagtggctcacgcctgtaatcccagcactttgggaggccaaggcaggtggatcacctgaggtcgggagttcgagaccagcctgatcaacatggagaaaccccgtctctactaaaagtacaaaattagccag

SEQ ID NO: 256101 - DNA, 460 bp, Homo sapiens
acctagtgtaaatgacgacttaattggtgcagcacaccaacatagcacatgtatacatatgtaacaaacctgcacgttgtgcacatgtaccctagaacttaaagtataataaaaaaataaataaataaaaagaatcactctaacgagctgcaaggtaaaatccttggagaaggtgtgtgccgacttgatcaatggatcaaaggaaaagaatctaaagtgataggaccagtttgaatgcctaccaagactttgagaaacattacaagaaaaacttcttatgaaggttctgagacatggtattgtttccagatgagaatccataagtgactcattgacttccacagtctttctgagattgttaagcagattacttccatcattattgagccaggagttgaggttgaagtcaccattgcagatgcttaagtcaactattttaataaatgattaccagttgttt

SEQ ID NO: 256102 - DNA, 383 bp, Homo sapiens
tatgaatacattgttatttattagtaaacaaaacagcaaaaataaactgattttctttggtccaaaaggcctagtttgattttataactaaaattctttctcttcactagaagtcttccgattgtagttgggcacagtcttacagaacgtaagcgagcgccagtgcagcttctactcatgtccagctactcctcagcctcctttagcaggggcaggaggagccaaaacctcccatgttggtaaagatgctccatgagggcagaacccaccaacccagcagcactgcagttaacacctgcactcatctgagattcccatgctgtatctgacagctgtctaaaagcccacacagtatttacctaaggaaacagcatggctctgag

SEQ ID NO: 256103 - DNA, 374 bp, Homo sapiens
ccaggctggccttgaactcctgagctcaagcctccaaaagtgctgggattacaggcatgagccaccgagccgggcccctgtctattaaattctgtgtgtagttgttgaaagtgtgtctcacctcattggtctgcaaggctcatgagtacagggactgtgtctgttttattcacagcaatatccccagtgcctgagacagtgcctggcacatagtaaatgctcaagaaatacatgtaaaggggtgaatcgtttccccagaaatcccctcggctggaactgggaaacctgccacttctctgtccacagcagctacatgtccctccccaggggttctgcgctgcttaccatatgtcttattgaaaagctcctggacc

SEQ ID NO: 256104 - DNA, 620 bp, Homo sapiens
  misc_feature (15)..(15): n is a, c, g, or t
  misc_feature (43)..(43): n is a, c, g, or t
  misc_feature (48)..(48): n is a, c, g, or t
  misc_feature (65)..(65): n is a, c, g, or t
  misc_feature (69)..(69): n is a, c, g, or t
  misc_feature (81)..(82): n is a, c, g, or t
  misc_feature (99)..(99): n is a, c, g, or t
  misc_feature (126)..(126): n is a, c, g, or t
  misc_feature (141)..(142): n is a, c, g, or t
  misc_feature (158)..(158): n is a, c, g, or t
gggatgggggcggtnacaatttcacacgggaacagtggaccangttancccaagttttataggantcantatagggaaagnnggaacgctgcaggtacngtccggattccgggtggatattattantagccgttctagaannagtggatctgccattntcaaacaggctgtgggtgttgctgctggcctggcagcccgagggacagcagagagaaaaggacagaaaagattagggtagttcctgtcatcacagtggtatgaaggctggcctctaagttcacggactggatatttcagctctgagcactaattctaaaatctatcacttactcctaccttcacctccagtttcaaatctactccgacactgacttccctaactctggtggtagcaatggctaacactttgtaaggtggacactaatctaagcatattttccctattttacaaaccaggagactaagggctaggaagcttcacgaaggcagtaagtggcaaagcttggatttgcacccaaatattcggtgtctttaaccacttggatgccagattatagcaagtaggagccatttctaggacctggcagaggttagcaccctcaccatcttcagtgtgatat

SEQ ID NO: 256105 - DNA, 500 bp, Homo sapiens
agagggcagagggcagagcaagtggatggagtcagcggggagattacctgtgggtgttgctgctggcctggcagcccgagggacagcagagagaaaaggacagaaaagattagggtagttcctgtcatcacagtggtatgaaggctggcctctaagttcacggactggatatttcagctctgagcactaattctaaaatctatcacttactcctaccttcacctccagtttcaaatctactccgacactgacttccctaactctggtggtagcaatggctaacactttgtaaggtggacactaatctaagcatattttccctattttacaaaccaggagactaagggctaggaagcttcacgaaggcagtaagtggcaaagcttggatttgcacccaaatattcggtgtctttaaccacttggatgccagattatagcaagtaggagccatttctaggacctggcagaggttagcaccctcaccatcttcagtgtgatat

SEQ ID NO: 256106 - DNA, 210 bp, Homo sapiens
  misc_feature (17)..(17): n is a, c, g, or t
atggtccaggtaagagntctgcccttgttcccaacatgccaaggaaaacaagaccctttagttactatcttttttcagaagccttctgtcaaggtggcccatggtatttcacctcttccctagcctttttttgttgttcttgtctagacaggatcacaccactggactccagcctgggcaagaagagcgaatatttcgtctaaaaaaaaa

SEQ ID NO: 256107 - DNA, 415 bp, Homo sapiens
aaagaaacattaagagacaggaagaggcttttggacatttaaaatgggattatggagataaaaattcaacacaagggtcaaaagataaagttgaggacatttcccagtaggcagaataaaaagaaaaagagaggccgggcctggtggctcatgcctgtaatcccagcactttgggaggccaaggcaggcagatcacgaggtcaggagtctgagaccagactgaccaacgtggtgaaaccccgtctctaccaaaaatacaaaaattagccagacatggtggtgcgctcctgtaatcccagctactcaggaggctgaggcaggagaattgcttgaacccgggaggcagaggttgcagtgagccgagattgcaccactgtactccagcctgggtggcagagtgagacttcacatcaaa

SEQ ID NO: 256108 - DNA, 500 bp, Homo sapiens
accatacaatgttggcactggcaggggttttaaaaatcatccattccagtcatatttactaaggatcagaaaggggaagtgatctgccaaaaatcccattattaactaatgggaactccagaactccttactttttctttttgagatagagtttcactctgtcgcccaggctggagtgcagtggcacaatctcagctcactgctagctccgcctcccaggttcacaccattctcctgcctcagcctcccaagtagctgggacgacaggcgcccagcaccacacctggctaatttttttgtatttttagtagagatggggtttcaccgtatcagccaggatggtcttgatctcttgacctcatgatccacccacctaggcctcccaaagtgctgggattacaggcgtgagccaccgtacccggcctaaaataaaattttcaaactagaatcaggtttattatgctacaccatacaatgttggcactggcaagggggtttta

SEQ ID NO: 256109 - DNA, 714 bp, Homo sapiens
ccggaagcccgttcaaactgtataagggtgatcagctatcacggagaaggctttagcaagtcggggccagtggcgcaatggataacgcgtctgactacggatcagaagattctagaagcccatggaaacaaggcgatgacggcgcttgagggtgaccagacctcctcaatcattccatcagccacccaggactcaacagcagaacctcagaggactcagctgaaagaggttttcactcgagcactaaccacagagaaatgggaagtgccatcctgctgtcatacgcagccgatggctgggtaggactaaatgcccttctgtggtgagatgaaccaagacggcagatgggggaataacatcagtgagagagagattacgaatggatccttgtattgcagatcaaactgggttgtctcttctcaaaccacccaggcagtttctgaatgtcccaagataggggtaggagaaaagaaaaaaaagacaaaacaggagacggtgggtaagaaaacctaaaaggcacaatgaggcaaaggcctaagatggaggctggctttgggatctgaaatccggccacaatcctccttgttttacctcaagtccaagaattgtcaaaaagaaaacccagaagggctattcattctaaattttaaaatcttttcttcctggcctaccaagtccttgtgttttctttctaggcgcccataaatacaaccc

SEQ ID NO: 256110 - DNA, 2115 bp, Homo sapiens
  misc_feature (871)..(871): n is a, c, g, or t
  misc_feature (1477)..(1477): n is a, c, g, or t
ccatggaatccatggagtcacagtcaagcactcctggagggatctgggtgccggcatctccagccagccctgtgatagagatctgaggagttccccttagagcttctcaaggaaatccttgatgcaataagccgcacacttagggaagctgttctctccagacagggtacaacttgagaaatggtttcaaaatgttttgacatgttcctgaatggcaggtctatgggagaacagaacgggggctgtggtatgtttgaggctttctgtgacctaggggtaggtgtcaggaaagcttccaaactctccctagaggccaagccagggctgcctgagaggctggacagtgggcactcaggccccactgggcagggacaccagtgtgtcatgcttgttgtcacacttggcttatttgctcttctccaccaggaattctgtggggcaggggattgcacactgcacacatcacagctgctcatccagggttcagggagcacaggtgttgtggcacttgcttcatcttgagtggcacggagcacagagcagcccctgtggagtgtggaaacaccaaaccctgagtcaccactgactgttgccctgggcatagaaccccaggtgaaggcacttaacactggttatccctgtgcatccaggaagctgaatggcggccaaagaaaaaagttacaatgcagtcaggctggaccagagaattcctgcatgtgcaagtttgtgcgtgtgtatgttttggaagtcaagccagatgtcgtctttcctcatgtgacatttggtatcttttttccacagcagtgttccattatgttctagttcttgaaagaggcagtgaggcaacaagtgtacgacgaaattgatttgngaaatgatttatgtgtattatagtcttctcttagaggatcacaaagtatattagcatattaaaggctctgagaagtcctgtaataaaggagcctggttgattgaatgattgtggaactcattgtgggtggatcattcgcatactggatggaatggggtgccaggctgactgtgcagagggtgattagtccctgaaatgtagataggggccacctagagaatggtggagcgtcggacatggatgggtgaactgaccaactgggctatgcatttcagccccaaagcacttaaagcataaggtagattgtaagatcctggagttcacctgccttaaacacctcctttcataggagaaggacaccaaggtcgttagagaagaactgagttactcatgatcaccagtcagagctcttggctgcaccacatagatgccaatgttggatacctagggagaatgagatttgatggaaggatatggagaaggccactgaacccactggaagactggagaaccgggtccagaaaacaagcagaagccaagggaaagtgggctgctgagagcatagccagatcatgccacgaaatctgattagcccacttcagctanggcccatgatgcatcagaaatggacccatggctctctgtgttcttcccagtgggtacaggtgattggctgagcacagactgcgttcccctccctggctgttagggtctgggagaacaggtgggaggcttttgtggcttctgcagcagaagcccggagcccatctctcccaacgactcacacaggaaggaagcccccatctggttgggggcagaatgaggttacaaagcccatctcctgtcttgcagttcagattatgcagccaagggtactcttttacataagtgtttaaaatcttgatttaatcagcaacatagaccttgcagcgttcctgcttccatgatagaaggatatgaactatttgaaacattcgcaactactgctctccttggggattcctaccctccttccattctttactcactggcctcatggtagagtaactagagcagaaatgcagagcgagagagaaacaaatatgcagctttcgaaacccatggcagagacaatagtttgagagtctcaaaatcttgcctttcgagaatccgagtcctgacacacagaaatcaggaggactagtgtatggtttgttaagctactttttcccacctacccagtctacattaatgactccctgagc

SEQ ID NO: 256111 - DNA, 1839 bp, Homo sapiens
  misc_feature (595)..(595): n is a, c, g, or t
  misc_feature (1201)..(1201): n is a, c, g, or t
tagttgagatggggtttctccaggttggtcaggctggtctcaaactcccgacctcaggtgatcagcccgcctcggcctcccaaagtgctgggattacaggcgtgagccactgcgtgcccggcagcagatgaactttcaattggagcaatggaattctgtggggcaggggattgcacactgcacacatcacagctgctcatccagggttcagggagcacaggtgttgtggcacttgcttcatcttgagtggcacggagcacagagcagcccctgtggagtgtggaaacaccaaaccctgagtcaccactgactgttgccctgggcatagaaccccaggtgaaggcacttaacactggttatccctgtgcatccaggaagctgaatggcggccaaagaaaaaagttacaatgcagtcaggctggaccagagaattcctgcatgtgcaagtttgtgcgtgtgtatgttttggaagtcaagccagatgtcgtctttcctcatgtgacatttggtatcttttttccacagcagtgttccattatgttctagttcttgaaagaggcagtgaggcaacaagtgtacgacgaaattgatttgngaaatgatttatgtgtattatagtcttctcttagaggatcacaaagtatattagcatattaaaggctctgagaagtcctgtaataaaggagcctggttgattgaatgattgtggaactcattgtgggtggatcattcgcatactggatggaatggggtgccaggctgactgtgcagagggtgattagtccctgaaatgtagataggggccacctagagaatggtggagcgtcggacatggatgggtgaactgaccaactgggctatgcatttcagccccaaagcacttaaagcataaggtagattgtaagatcctggagttcacctgccttaaacacctcctttcataggagaaggacaccaaggtcgttagagaagaactgagttactcatgatcaccagtcagagctcttggctgcaccacatagatgccaatgttggatacctagggagaatgagatttgatggaaggatatggagaaggccactgaacccactggaagactggagaaccgggtccagaaaacaagcagaagccaagggaaagtgggctgctgagagcatagccagatcatgccacgaaatctgattagcccacttcagctanggcccatgatgcatcagaaatggacccatggctctctgtgttcttcccagtgggtacaggtgattggctgagcacagactgcgttcccctccctggctgttagggtctgggagaacaggtgggaggcttttgtggcttctgcagcagaagcccggagcccatctctcccaacgactcacacaggaaggaagcccccatctggttgggggcagaatgaggttacaaagcccatctcctgtcttgcagttcagattatgcagccaagggtactcttttacataagtgtttaaaatcttgatttaatcagcaacatagaccttgcagcgttcctgcttccatgatagaaggatatgaactatttgaaacattcgcaactactgctctccttggggattcctaccctccttccattctttactcactggcctcatggtagagtaactagagcagaaatgcagagcgagagagaaacaaatatgcagctttcgaaacccatggcagagacaatagtttgagagtctcaaaatcttgcctttcgagaatccgagtcctgacacacagaaatcaggaggactagtgtatggtttgttaagctactttttcccacctacccagtctacattaatgactccctgagc

SEQ ID NO: 256112 - DNA, 345 bp, Homo sapiens
ccttgaataaatctttataatttaaaacacaaatcatccaaagaaaggactcagttattctctgagtggataagtcaagagcaaactagaagagcattctcatctctaccccggtgaccttcatttcagcatttcggtgctattgcttccccatttcccagtggcaggtctgaggcatcatctcaggccccttagtcaaaaacttgtcctacatcagtgcctcatctgggcatggtggctcaagcctgtaatctcagcactctgggaggccgagacaggtggatcacctgaggttaggagttcgagaacaacctggccaacatgggaaaactccatctctactaa

SEQ ID NO: 256113 - DNA, 248 bp, Homo sapiens
ttcttttttcttttcccattaaaccaagcacttttaaattaaaactgacttcgtggtgggttgggaagaaaaattatgccattcacaaatgctcaaccagcatatgtaacgtttatacaccaaaatgactactaatgaagaaaacaaaacaaacaaaatcatttttccaaatcagctctgaaacattatttttgtttttgctgctgctgttgttgttgttgttgttgttgttgttgttgttgttgttt

SEQ ID NO: 256114 - DNA, 471 bp, Homo sapiens
aggctggtctcaaactcctgacctcaggtgatccacttgcctcggcctcccaaagtgctgagattacaagtgtgagccaccacgcccagcctctcccctttaaatttgatcttggccttgtaacttgctttggccaatgggacattagtaaatgtgatgcagtcagaggtttggtaataacctatgcatcaggacttacatcacttgctgctctatggagttgagaccaccaagtaaagcatcctgggctagcctaccggaggatcagagaccatgtggaacataaatgaatcatcccagttgagccctgtccgcagatcaaccagcctaccaacttccagacacgagtaaagccatcctagactatatccaaccccagtcaggctgacacagaccataagaattgtacagataatccacagaactgtgataaataataaagatgtttgtaattttaatacataaagagtg

SEQ ID NO: 256115 - DNA, 140 bp, Homo sapiens
cccagctttcatgcaattctcaccaagtccctgacccaggctggcagagacccctctctggtggaacatgtttaggtggaggaggggtataaccagcaagaggggtggaggctacagtagtcctgagggatggcctaggc

SEQ ID NO: 256116 - DNA, 711 bp, Homo sapiens
caggggcccaggcagggactgacgttagagtcaatactccacagctgtttgttgaatgagtaggtaacagcatggctggctggtcctggtgcagaaagtcttgggaggcctcagtttgcatcgtgcttctgtcatcagccagctgtgtgattctgcacaagtattttaacctctctgggcctcagtttccccatctgtaacttgggggcctacctcaaatggttcctggtgaagagtaacaagaccataccctaagttccagttgccttttcctctgcctttccaccttcccctccagcccctccaagtctcttttgttaagacagggtctcactctgtcacccaggctggaatgccgtgatctcggttcactgcagcctctatctcccaggctcaagtgaaacccaccacagcctcccaaagtgctgagtgctgggattacaggtgtgaaacactgcaccagctacatgtagaactttgataaagactggctttcaccgtgtatgagatggggagccatcttcagttctaatgcagctgggactacaggtgcgtgccaccacacccggctaattggtatttgtgtttttttttggttggtttctgtttttttgtacagacggtttctctcatgttggccaggctgggctcgaactcctggtttcaagtgaacctccacttggcttccccgtgctgagattacaggcgtga

SEQ ID NO: 256117 - DNA, 166 bp, Homo sapiens
gcccctccctccctcctacccccttcccaatatttggtttcacagctgtagttaaagcttgggatttggttatttttccccctcccaggaatttttttttcttgtttttcttttcctaggtgtgagggttggatggggagggtccccagcacccccggctgcacag

SEQ ID NO: 256118 - DNA, 433 bp, Homo sapiens
atgaccatggggaaggagaaaggcgtgcttggcatgtgtgccctgaaaagacgggacatacttattcatagagataacacttgttccgatgaagtcagaggcctggtgggagtagcctctttcacagggcttcaagggattgtggatattgtgcctgagaggaaggtgaggcaaccatctactccctgatgtgtgaaaatgaaggaacacagaggggaaaggagaggcagggacccaatgccagggaccgttccttactctgatgtgtgcacagccaccaaagctggcccttttcttccagcctcttgccatccctctaaaagcttgaattagcagaggcagttaagcaggaggtagaggagtgtcagaaccagacctttgcttccttccaaacagccaggcccacagccccagcccccctggggttgggagc

SEQ ID NO: 256119 - DNA, 509 bp, Homo sapiens
taagtgacatcttctttggtttcttccagcgtcaacatgtggtagatctaatttgaaatgagttccagagctgaggcaaggctatgatagaacacaaggcaaacagctgaaaactgtagtcaaaaggcagggaagctgagaaagtgattcaaagaagcccatctgaaatcggaagcaacagggacgcttttagggaggtcctgggtgcttcagaacacgggccttcagctgagacctctccaactgcctggaccctggctgctggcagaccaagttgctcaacacccagaattaacttgggactggagtccccatgtgaggccacgacaggaggcacacagcaggacctctcagaagggcctggaggggaaagatccctcagctccagcctgtaaagaaggtgcactgggatgcccacacaaagaggattcccttggcagcaaggaaaaccattagccctgtgctgtttatagatagcagagaataaagagaaataagaagcactgttc

SEQ ID NO: 256120 - DNA, 448 bp, Homo sapiens
acaatgattactttttatcttagcactgggctgcctagaactgaatcacagctctgccactcgctagctctgtggcctttgacaagtcccttagccttcttgggcctctgttcctcattagcaaaatggaggataacaataatacttttctcgtaaggtcactgtaaggatttaatatattaaaatatgtgatatatttaaaacacttcctggaatatagtgagctctatataagcaatggctattatcatcattatcaattttactgttactactatgtttatgctatgtgtgcccatatcttatctgctataatagatttgagcctttgaaggcaagaactgtacctgattcatttttcattttccccagtgagtagtaaaatgcattcacatagtatgtgctcaataagtatttgtgaagttaataaataaatgatcaaattaat

SEQ ID NO: 256121 - DNA, 276 bp, Homo sapiens
ggggattacagttcaacatgagatttgagtggggacacagagccaaaccatatcaagggttttgaaggggatctgttttcctttctctgtacacattgctgaattctgccattggtacaaaaggcagagtggtttaatgaaaaggttgttgatatgataggaggcccatacttcactcatctcccttcactcatctagtctctctcggagtctgcttttcccatgggggggcgaaggggagggaggtaggcaggcccttcaccgcaaatggcttcc

SEQ ID NO: 256122 - DNA, 688 bp, Homo sapiens
acaaaattcaacttaaagtagattgtaaacttcagtgggaagactaaaactttagaactcttatgggagaaaatacaagagtaaatctgtgtgaccttatgttagacaatggtttcttagaaatagcaccaaaagcacaaatgaccaataaataaataaattggattttatcaaaattaaaaatgtttctgctgaaaatggtaccgtcaataaagtgacaagacaatcctgataatgggagaaaatatttgcaaatcatatatctgataagagatttatatctagaatatataaagaactcttatattttgctatggtctaaaagtttgtgtgctcccaaaattcatatgttgaaatactaccccccgccaagattatattattaagaggtggggcctttggaatatgattaggtcatgagggttgaactctcatatatgggattagtgtccttataaaagaggttagaggccgggcatggtggctcatgcctgtaatcctagcactttgggaggccaaggcaggtggatcaactgaggtcaggagttgagaccagcctggccaacatggcaaaaccctgtctttattaaaaatacaaacttaacctgggatggtggcacacgccctttccaggttctttggagtactggagaagggttccctggcccccggaggtgtcggtgccggc

SEQ ID NO: 256123 - DNA, 686 bp, Homo sapiens
acaaaattcaacttaaagtagattgtaaacttcagtgggaagactaaaactttagaactcttatgggagaaaatacaagagtaaatctgtgtgaccttatgttagacaatggtttcttagaaatagcaccaaaagcacaaatgaccaataaataaataaattggattttatcaaaattaaaaatgtttctgctgaaaatggtaccgtcaataaagtgacaagacaatcctgataatgggagaaaatatttgcaaatcatatatctgataagagatttatatctagaatatataaagaactcttatattttgctatggtctaaaagtttgtgtgctcccaaaattcatatgttgaaatactaccccccgccaagattatattattaagaggtggggcctttggaatatgattaggtcatgagggttgaactctcatatatgggattagtgtccttataaaagaggttagaggccgggcatggtggctcatgcctgtaatcctagcactttgggaggccaaggcaggtggatcaactgaggtcaggagttgagaccagcctggccaacatggcaaaaccctgtctttattaaaaatacaaacttaacctgggatggtggcacacgcctgtaatcccagctacttgggagactgaggaagggaatctcccccattgggttggtcccccg

SEQ ID NO: 256124 - DNA, 524 bp, Homo sapiens
tagatactacattttttaattatttattttataacttatttatttataactttttaattatttaattgaaaggcatgagatttccaaccctcccttctctccaagaagcaaacccccaaattgtcccaatttttttcttccctcccacaaaaaccttatcactttatccaaaaaaaagcttgttagaaatacttaagacagctacaaagttgaaggcatccatcatgcctttgaggagaatggagttttgattgtctaaagtagtcccgtgtttaaaagaagacataccttgtacatgactgaaaataaatggctccttttaaaattcttaacattaggaaaagacaccccctaggtcagctccaagagatcattagattcagtttaaggcccaaagcaaacctaataatgaatattattatatggcatgtattacctttattcatatatcagaatagacagttatctttgataaggcctgctaaatgtattaccttctggatgttagaagtctttgatgttta

SEQ ID NO: 256125 - DNA, 356 bp, Homo sapiens
cgaggggagcctaaaagccaaagccacgtcttccaccggtggcacaagcaccttcctcgtgtcctccttggttgctgcgcagccctgggcctcctgctcctgttcgtttccaggggcctctgcccttcccgcggtgtgcacagccccaggttctgccttgagacctctcccctctgcagtggaaagagtgccggctctaagtcacagacctagcttcagttcctggctctgctctttcctgccaatgtgactcaacctctcagcattagtcccacactgtaaatgggcttgagtgttcttccaatatgggagtatgggattcaataaaatctccctacagcacacccagtaaaaaa

SEQ ID NO: 256126 - DNA, 446 bp, Homo sapiens
ttaggtgacctgggggcaatagtgtgaccaaagagagcagactggccacaggctgagtctggccccctctgtgtttgtgtttgacccaggtggtggtttagaaactgaaaaatgtgtgtgtgcatataaaccagatttcaacatctcttgagaagctggaggatccagccccagtgggcaccagtcccgaaggcacctgcagtagtgggagctaaggagagctgcctgtgagagtccagactcctcctgtcccctggttcccactcttccctgcgacctccccaccccagtggactcctgtcctttgcccaccaggcctctggaggctttggagctcgccacgcttgagttagcctttccttgggagcagataaccaacagatacagacctcatgatacaattcaatgattcaatctcttaaaggtgtacttttaaaatatatata

SEQ ID NO: 256127 - DNA, 395 bp, Homo sapiens
gagacggagtctcgctctgtcacccaggctagagtgcagcggcatgatctcggctcactgcaagctctgcctcctgagttcaagcaattttcttgcctcagcctctggagtagctgggattacaggcattcgtcaccatgcctggctaatttttgtatttttagtagagacggagtttcaccatgttggtcaggctggtctcgatcccctgaccttgtgatccacccacctctgcctcccaaagtgctgggattacaggcgtgagccaccacgcccagccatttcgtttttttaaaatgaggcttgcacacctattaagttggtttcataatctgtcatttgaaaatcctgtattaggtgttaagaccctttcccccactcccactggggagggc

SEQ ID NO: 256128 - DNA, 241 bp, Homo sapiens
tagtgtctccaatcgcgtgctgtgttaaattttaactttataaccaaccatcatttgctacttccatctaaccaagccagtttccttatgatgcacacacttgtgtttagctcacaatttgttctacatgcttgcttatttattcattcagcaagtatttattgagccccaactgtgcactagctgctgtctcaggtgctggggagacaggaagatcaaaataaaacccctgccttcaagt

SEQ ID NO: 256129 - DNA, 312 bp, Homo sapiens
acgagcttattcgtggttggaataaattaaaagaatggcctttataagaaagattcagaatctgtatgaagcaaatgactaggtcagtaggtagacagatttttccccatttttgtattggagattttcaaatgtatacaagagtaaagaagatggaaaatgactcccttgagcccgtcgcccagcatcaatatgtatccacatttcgctattcttgctttatctaaccgtctcacttatctcaaaaccacaatatgttaagataagtgaactgaagacctgaataaatgcaaacatcttatgcaaacatac

SEQ ID NO: 256130 - DNA, 365 bp, Homo sapiens
ggtgagatccttcatcttaaataacaggacaagtgttatctattgtgcgtgtgttggtatacacgtttttcttcatgattagcaacttaaaatattccggaccatttgtatggcctttaacaaaaaatcaccttattactgaaatttcagggtggcggcgggtgctgctgattgtttaccattaaatttttacaagtgttctgactcctggcggatgccaggttcttaatgctgttaagtcatgaatcttctttgagaaccaggaaagctctgcccgggaaaatgtacatgcagtttcagataatttatggacttcctgaaactcatcctctgaaccctgttccccaaatcaaacatttaactta

SEQ ID NO: 256131 - DNA, 767 bp, Homo sapiens
cagattcaagggatcatcccagctgggcctccccaagtgctgagattacaggcgtgacccagcacctggcctggtttttcttttaaataaggttaatacctatttatgagtgaaatgccctttatttttatttggtaaatttcctttgcatgaggtaaatttaatttttatttggtaaatttcttttgcatgaggtatacacacagaagcacattaatctttgtctctgattatagctattcttaaatcacaaaaagacattcaaatatttcatgagtgaagtgaatacttcataggaggaaatcctggtatatcttataggaagagtactctgtaaaagtgcttgtctgttttataggtgaatttgccatgtgatgttgatcacagacacattttataaacgccaaaaattaagaaacctctcacgttgccattcaaagataaaatatacaacacataattccttaaattaaaaacaagggtggccgggcacagtggctcatgcctgtaatcccagcactttgggaagccatggcgggtgtatcacctgaggtcaggagttcgagaccagcctggccaacatggcaaaaccttgtctctattaaaaatacaaaaatattcgcagggcgcggtggctcacgcctgtaatcccagcactttgggaggccgaggcaggtggatcacgaggtgaggagatcgagagcagcctcatcaacatggtgaagccccgtctctactaaaaatagaaaaattagttgggcacggtg

SEQ ID NO: 256132 - DNA, 356 bp, Homo sapiens
ttttgtgtgacctccacacattaaaaaataatacaatgttataaaatacctttatttcaataaaaatgttcatgcctttaaaatatgatttattaatatttgttcctacttctcttaaatttacagatataagaagaatctctgcattaatatcatatcattttatgaatggatgtttaacaaagatacttttaagacataggttcagttattcttgaaataatatttagcctattttataataatttcaattggctttgccattctgcccacctcagtttttaaatggttcttaagagtgagatccactcagagaagaatgaactctcattttaaagaagcctgactgagttttc

SEQ ID NO: 256133 - DNA, 414 bp, Homo sapiens
ggcctgtgaagtctcaagtcttaggtttttaaaaaagaagcatctaccttaagagagggaaggataaaccatagaaagtccaatccttatcaacaagagaaaaagggaagaagaaaagtttggattttataaaaattgaccaactacagacgagataatgaagacatccatctttctggaattcttttgtaaagactgaaatatctagtcaataactttccagtgacaaaagaggttacaccagtagtccttccattcagttcatacttttcatatggatgaacataatttataacttctccataaattagaacttctccaattttgccggatatccggaatccactcagtaacaccactctgaattccttcctgtacctcaaagacagaaatgaaagaacctggctcattaaa

SEQ ID NO: 256134 - DNA, 728 bp, Homo sapiens
tttttttctaaaaatattgattttttttggtttaaagtaaaaggtaggggctttctttgaaatctgtagttcctaggatgatttaatttctcaatttcaaaaaggtgtgtgttgagatatattaaaaccaatcataaacaggttattttaaaaacactctatttcaactccttcagatcaaattccactattgggtcatatttaaaataaaattacagacatctgttttatgaaaagttagttattgaggtgggaaaccatattctcttaatcaaagcttggagtgtttcttgaaatgcacatattgaacaaaaagcacttcagtaaaccacacaaactgcaaaacttgatagccatctagagctgttagagaattgatcctttttgataactggattgtttttcaaatgactgggattttgcccatttgtctcagtgatgaattgtttggtcacaaggaagagaaattcactgcaactgagttgggccacaaataataaataaaggatgacttggaggacactaggggactccaggactgaaattccccggggttctctggagggagtggggttggaccttcaaagctatttaggactcaggcctgagcctgaatcttggcttctcttgagaatgcttatcttctctcatgcctacatgtctgcccgagaactatgacaacctgctagcctaatcacacatcccatggtgcaaacacaaatgtcccg

SEQ ID NO: 256135 - DNA, 256 bp, Homo sapiens
catgcctgagtcagattcccttattattcacacttttctatgagaaaattgaggcttaaaaagttaactaacattcctgaagtgacacggtaaacaactaagggagtcaggatctatgcccaggaagatctgcaccacagtcagaagttcctggtccctaagctctgatcctgtaaatcatgtttttgtttattccccaacactaacctcactcctttactattcagtgcagggtgactttcctgactaggaaatt

SEQ ID NO: 256136 - DNA, 235 bp, Homo sapiens
ctggtagtatttgataatcccccgtccctttagctattctaggcctgtttagttgtcgggcgttgtcggactgaattgctaaaaataacaaataagcgggaggtggttctaaggccagccctggctactgtctgtaatctgtttaatttagttcctggggagaaagggcaaaaagaacatggtgccattctcattgaatggattttttgtttaaagtgctcatgagagcattgtt

SEQ ID NO: 256137 - DNA, 445 bp, Homo sapiens
gacagcatgtggccacttgaaaacaactcagtttttgccgcagttcctagacaacatttttgccctgttgggtttttgcaactgtagccataaacaagttctagaaaattgggagagaataaggctttctcgttggtaacatggcagaaaacaatatgatatcattctaagtgaaatgagccctaggttactaatgaatgctccatcagtagcaattgaagcaggtcacagttgagggatacgattacatttcacatttggccagtgcttagtggcctcattgctgtataagtgtgaaggtctgtggtcctggttgtctgagagaaagtgagtagtttctactccatctgccagggctttggacactcaaattgatgttccttccataaacatcttctgtggtgtgaccaagtgtaagaggtggagctgagcactgtgggggatg

SEQ ID NO: 256138 - DNA, 498 bp, Homo sapiens
ccagcctcgagattaggtgaaccccaaacaaccttttacaatgtaagtgaaactgctctgtgtgtggaaacgaggggcccaacgtgttccctgcccaacgcttctgagccgcctcccaatacgctgccctaagcatttcactgagtcagggcaagatgtggcccagcgaaacctctagttctgataacaagcatgtgggctcatgtgttatcagtgcagcagagaatgtcactgggacttccagacggaggctataaaacgttcccccacttaagccgtttgcgtttcagcctcccagctagcaaagtaagcagttctgtgtgccagtcatgcttagctgcttgattctaggcagagccttgcaaatctgggcaggaagagaaatatcgatctccacaggtccccctcatctcctccattgactgtgtagacttgacaatcattgcggggcctccgttgctatattccattgtctgggctccggctgtaacccacatc

SEQ ID NO: 256139 - DNA, 506 bp, Homo sapiens
gagaaacaagttctttggaaccaaaattataagaaaagcagggacagactttcagatccagattcttccctgaacctctctcctcccatccctgcttggcagggagctgacatgtcagctatcagtgccaagctgctctggaccttgagagaagggctccatttaaggatagcaaaacctctttcatttggagcccttgcagagaagcacagtataaatgagtgaaaaacctaaattagataatttttaaaagaatggtagcttcattattttcaagtacacagagtaacttaaactcagtcatgaagtgttcctttgtagaagcccttagggactttccttaatgagtagattataattattggtaatcagcataaacggttctctgcaatgcatgctttgaaagcaattgagcatattaagtgattttgatgttccacagggcaattttgtttacagcatttatctgctcagtatataccctttatagctataaccctctgctt

SEQ ID NO: 256140 - DNA, 322 bp, Homo sapiens
taaggtggatgggatagtggtgggaggagatggaaagcatttcaggcagagtgggaagatacaggactggccttatttatgaagccctttctctctctctcaggattcctactctgttgccttgggaatttcacttatcagacatctggtctccccaactctagtttaagtgtcttaagaataaagatgcttgtcatttccttgggattccttaggaaattactagaaagtagcaggcactattaagtacatacgtattgaaagatcaccttatatcctataaatatgtacaattattatttgtcaactaaaattaaaactt

SEQ ID NO: 256141 - DNA, 1147 bp, Homo sapiens
aagtcagatattgacattgcagtttggataagtaaagagtaggatttgccgtatggactcctttcctagcatcatctgggctaacaataagggaatataatgtggccttcatagagctgtgatatttaaaaaactatttaagggctttggaaacaaaaacaaccagattcattttctggttttgccacttactgtgactttgggcgaaaaaatataaccactgtgagcctcaattttctgatctgttaaatggggataatacaagtacctcacaggatatgtagaggtttcaaatgtaaaataatgtataagagagaaattatataaaatagtgcctgccatataatttgtgctatacaaatcgtagttgctatcatcccttatttacttgctccctatttggttgcaaaacaggattataatgattttttgaattgcccagctattcagctatcaatttctcagcaattcgctgtcccacttccaaacccagtgaactgagaggaaagttacctgatatagtttaacttcttggattaatgggaatgctaacagaagacattaaatatatgaacaaaaatatttggggaaaggctttttcaaataggccagtaatcagattcctgcatagactacttaccttgggtgtatttttaattctgggttattttcttttacaatagattttattttttcatagtagattttatttttcattgatgaccaaagtatgttcctgcttctgcattgtcctcagctgacagttgtgagattaaggaaatggcagggaatttacaaatgaaatcaccaacctgattcacctgaactgtccctgctatctaggcattacaggcaatgctttaccttgatttatgcctctgcccttgggatgggtgctattatcccttctgtttttccagtgaggaaactgaggcataggacaagtatgtgccagaacccaaaagcctgattctgaaatccatattctgtaactcttcatagcttggctgtatttattttgtcagtgtttatttttgtttttcacattttgggagtataacagaaagccaaatgagtctcagttatatttaattaagttgtcagaagttgatctttgaatccttttggaggttaactattttgaatt

SEQ ID NO: 256142 - DNA, 680 bp, Homo sapiens
atacatatagatttgttctaattcagaaggtggaagcctcttaattattaggatcctatgattaagattgaaatggtggtgttgtttaagttgcatgctatgaagttagaaaaacctttgataatttctttgagtgttgttccaataagtgacaaaaaatatgattactgcatcttctgtcctttatgtattcctaatttattaatcttttcctactttttgttgacagccaagcaatttattacatagtagtatgtattgcctaatatgcaaatacaactatatgaggcagtcatatttttttaaatagaatccctactgtttttgtagtggggaaattggtatagctgtctttaaaaaattgcagggaatagtatctaggcatgacaatataaaataatatgaatttgtgtttttatcttcagcttacaccttttgcccttattggtttagcttctggtgtgaatacaaacataagagcatacgatgactgtttttaacgaaacttgagaaagattgatgaggtggtcatagagctaaggaccaattttacccacataactggttcacctttatacagtaaaaagaaagcatgcaaaaataagttatttcattaagcatgtttacataaatgcctgctatgttacaaaatcctaaaagactaaagttgacaggttttt

SEQ ID NO: 256143 - DNA, 817 bp, Homo sapiens
gcctattgactgcattaaaactgtggttattgttgagtgtttgcttcaaaagctgtttggttttaaaagcaagtaagagtttctttggcactaaagaaatttcagtatctgggcggatcacttgagctcaggggtttgagaccagctgggcaacatggcaaaaccctgttattacaaaaaaaaaaaaaaaattagaaaaaattagtcgggtgtggtgacatgcatcttttatcccagcctccagagtagctgggattacaggtgcacaccgctgcactcggctgattttttgcatatttaatagagaagaggtttcaccatgttggccaggctggtcttaaactcccaacctcaggtaacccactcacttcagcctcccaaactgctaggattacaggcatgagccaccacgcccggcctgaaaagtttttaaagaatgaaactcaagtattttctcattcatcatccattggagtttaaggtgattttatttctatcatggaaagaatagccacttggtcatgtattgaggagtaataaatggtccctgatcagctcaacgttttttcccctcatatatttctgctttatgcctgtactaaaatagtgtctagagtgcgtgattaacaggaaaagcattagcagtaagtttcttctatcacatgctgtcccttatgcctcccctccctcttcccactcccttgttcctcttccctgtcacacacacatttattttggaatccgaactttcgagatgaaaagcagtttactttcataaagtagcatgacacatcatgcctgacttgaagtaaagaaa

SEQ ID NO: 256144 - DNA, 1747 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256145 - DNA, 779 bp, Homo sapiens
ctgtgtggggtttctggaagaagtcatgacttcagggttttaattctatttctgccaatgacttaaggtcagtcactgttttctgggccagttaagctttctagggccccttttctgctaataaggatatagtttagtgaataaggagcgtttacaatactgcttctgtaattccagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256146 - DNA, 666 bp, Homo sapiens
  misc_feature (32)..(32): n is a, c, g, or t
  misc_feature (35)..(35): n is a, c, g, or t
  misc_feature (42)..(43): n is a, c, g, or t
  misc_feature (45)..(46): n is a, c, g, or t
aattcgcgggccgcgtcgactacggctgcganagncgacagnngnngctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256147 - DNA, 647 bp, Homo sapiens
tagctagtagagctgggtgtgaatcggccgaggcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256148 - DNA, 643 bp, Homo sapiens
  misc_feature (40)..(40): n is a, c, g, or t
cagtaactataacggtccggtttggtagcgaggctgggtngctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256149 - DNA, 1790 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaaaacaataaaaactccagggggggccggtcccaattgctctata

SEQ ID NO: 256150 - DNA, 783 bp, Homo sapiens
  misc_feature (32)..(32): n is a, c, g, or t
  misc_feature (35)..(35): n is a, c, g, or t
  misc_feature (42)..(43): n is a, c, g, or t
  misc_feature (45)..(46): n is a, c, g, or t
aattcgcgggccgcgtcgactacggctgcganagncgacagnngnngctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaatgtttcttgagtctcctgtgtatatttcttttccacagttggctgagtgccttcgtgagagtacaaggcccgaagggtagtgatggtgctaaactcaacatggatttggctgagctc

SEQ ID NO: 256151 - DNA, 672 bp, Homo sapiens
  misc_feature (492)..(492): n is a, c, g, or t
  misc_feature (496)..(496): n is a, c, g, or t
  misc_feature (507)..(510): n is a, c, g, or t
  misc_feature (512)..(512): n is a, c, g, or t
  misc_feature (514)..(515): n is a, c, g, or t
  misc_feature (518)..(519): n is a, c, g, or t
  misc_feature (521)..(521): n is a, c, g, or t
  misc_feature (523)..(526): n is a, c, g, or t
  misc_feature (537)..(537): n is a, c, g, or t
  misc_feature (541)..(541): n is a, c, g, or t
  misc_feature (586)..(586): n is a, c, g, or t
gcctactactactaaattcgcggccgcgtcgacgcagtattaatacagtatttatttgtcttttctctgtcaaaccctgagccaaccacgttccccaggctgcctggggaggtataggaaaaggaacacacggggccaaccagacgcgggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatgaggctcccaaacacagttccaatcccagccccagaaccagccaccccaactgtgggcagccccagctccaatgaacttgggctgctgtgttcgatgttcccttgaaatgggcgctggttttggaagctgcggctagagacaagtgaggtaagggggacatgagactgccaagctgctgagnctcncatctgcagtnnnncngnncgnncngnnnnactgcagatgngagnctcagcagctgtgaggtgctcttgaccaaggagggagtggagacnaacttggagcaggcgaacattcttcagggggctgaggagctgtggcaggagagctgctcccactgcagagaagacagagagggggc

SEQ ID NO: 256152 - DNA, 618 bp, Homo sapiens
tttgagacagtttccctcttgttgcccaggctggagtacaatggcgcaatcttggctcaccgtagcctctgcctcctggattcaagcaattctcctgcctcagcctcctgagtagctgggattacagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccagagccagcatctccctatgttgcccaggctggactcgaacccctgagctgaagtgatcctccccactcggtctcccaaagtgctgggattacaggcatgagcactgtgcctgttcaaacaacttaaataaaccatgtctaaagaatgacc

SEQ ID NO: 256153 - DNA, 355 bp, Homo sapiens
attcgcggccgcgtcgactttttttttaaacatcttattaatacagtatttatttgtcttttctctgtcaaaccctgagccaaccacgttccccaggctgcctggggaggtataggaaaaggaacacacggggccaaccagacgcgggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatggtcgacgcgggcgcgaatttagaacatagtagtcctacctgctaat

SEQ ID NO: 256154 - DNA, 377 bp, Homo sapiens
ccaaggccatgggctttaggtggagatggaggacacttaatacactgtatgctatagtgctccagcttttgccactggcagcacatgcccctgtgcactgctgctaactggtattacttggcctagtctactgacttcagttggaagcatttagtcctaggaagatgatctccttggggcagcaagaatagactagggcctcagcctggtcaatatggtgaaaccctgtctctgctaaaaatacaaaaattagccaggcgttgtggtgggcgcctgtagtcccagctactcgggaggatgagacaggagaattgcttgaacccgggagacagaggttacagtgagccaagatggtgccactgcattccagtctgggc

SEQ ID NO: 256155 - DNA, 209 bp, Homo sapiens
ttggtaggttagcagtattaaatggtttttcaaagtatgatggatttattggcacataaccctatggtaagttgaggagcatctgtatatatttcccttgttgagtgaggcaaatgcttctgaggcttagatttcttcttgttctcagactttgctttaaggaaagaacgtctacttccgttgggccagtaagggagcatccaaccgtg

SEQ ID NO: 256156 - DNA, 1936 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256157 - DNA, 1813 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256158 - DNA, 639 bp, Homo sapiens
gcctactactactaaattcgcggccgcgtcgacgcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256159 - DNA, 631 bp, Homo sapiens
cccactgcagagaagacagagaggggcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256160 - DNA, 729 bp, Homo sapiens
tttgagacagtttccctcttgttgcccaggctggagtacaatggcgcaatcttggctcaccgtagcctctgcctcctggattcaagcaattctcctgcctcagcctcctgagtagctgggattacagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256161 - DNA, 2200 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaaaaaaaaacaaaaaaaaaactcgaaactagtcctctcgtaggacggagggtacgtgcgtctagagaccgcatatcccagggatttgacgaaggcgtgtcgcgctgcagtgcaatgtaggccttaggcaagcctaagggttggaccggatagtacggaccgggagcgcatggggcccaacccacgccggggtcggaccccggcaagttcccagggagggccgaggaccctaaacctccggggctggacccagcggggcatggcacg

SEQ ID NO: 256162 - DNA, 2149 bp, Homo sapiens
  misc_feature (2137)..(2137): n is a, c, g, or t
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaaaaaaaaacaaaaaaaaaactcggggggctctctttgccgggggggggaacacacgcggtcctgacatgggcccttggtcatagcttgtttcctgacccagctttctttgtccaaaggtggtaaatctcgccaggtcccccctatggggagtcggtattaattcggataaagccaggtaacctgccttgttccgacaacggnccacgacctaaa

SEQ ID NO: 256163 - DNA, 2028 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaactttgctgcggccgattaggctactggccattcccctttaggagcggatcaatcaatgcccgcgtttaacacgcggacgggccggcgtccct

SEQ ID NO: 256164 - DNA, 2053 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaatgtttcttgagtctcctgtgtatatttcttttccacagttggctgagtgccttcgtgagagtacaaggcccgaagggtagtgatggtgctaaactcaacatggatttggctgagctc

SEQ ID NO: 256165 - DNA, 2011 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaaaaaaaaaaggaccaaaaaagcaaaacaaaaaacaccatcaaacaaacaacacacaaaacaaacaaaacaaaacgg

SEQ ID NO: 256166 - DNA, 907 bp, Homo sapiens
  misc_feature (40)..(40): n is a, c, g, or t
cagtaactataacggtccggtttggtagcgaggctgggtngctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaaaaaaaaacaaaaaaaaaactcgaaactagtcctctcgtaggacggagggtacgtgcgtctagagaccgcatatcccagggatttgacgaaggcgtgtcgcgctgcagtgcaatgtaggccttaggcaagcctaagggttggaccggatagtacggaccgggagcgcatggggcccaacccacgccggggtcggaccccggcaagttcccagggagggccgaggaccctaaacctccggggctggacccagcggggcatggcacg

SEQ ID NO: 256167 - DNA, 963 bp, Homo sapiens
ttggtaggttagcagtattaaatggtttttcaaagtatgatggatttattggcacataaccctatggtaagttgaggagcatctgtatatatttcccttgttgagtgaggcaaatgcttctgaggcttagatttcttcttgttctcaagagctataaaaggatatagcaaggttggatgctcccttatggcccaaaggaagtagactttctttccttaaagcaaagtctgagaagcaagagaaatggtgtggttctttaatttagactttgctaaaaggaagaatgatccaaaactctaacgtacatgtgaagatggaaaggccatgagaggaaagaaaatcttgtctgatgatgtaacaacgtggcatagttctgaaactcctctccagtcttccttgaccttcctgcccctgtatgtcattcctgctaggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256168 - DNA, 1121 bp, Homo sapiens
  misc_feature (138)..(138): n is a, c, g, or t
  misc_feature (1006)..(1006): n is a, c, g, or t
agtgacagtggaaacagaaagcctattagccaacattttaagccagaacttgaagttgctactgacagcaatcttctcaggcaagtagcaggccatgccaggtgaaaataatttaaaatgttatgctatttcaaatanaatttgcctgtcacagaattaagaaaaagtgagctcagccaaatccatgttgagtttagcaccatcactacccttcgggccttgtactctcacgaaggcactcagccaactgtggaaaagaaatatacacaggagactcaagaaacatcttattaatacagtatttatttgtcttttctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaagtattaatacgaaaaaaacaacaacaaaaaaaacaattttggcgccctcgccccgaaaatttnaacccattgttggggcgcgccaagaaggcaactgccacggtcggagaccggcacacagggggggtcccaaaaagcgcggcggcgtgacaaccgggtgggccggctccggccccac

SEQ ID NO: 256169 - DNA, 865 bp, Homo sapiens
ccaaggccatgggctttaggtggagatggaggacacttaatacactgtatgctatagtgctccagcttttgccactggcagcacatgcccctgtgcactgctgctaactggtattacttggcctagtctactgacttcagttggaagcatttagtcctaggaagatgatctccttggggcagcaagaatagactagggcctcagtcttacacttcttgaccacacctgaatcttaaaggcatttgaagtctacatcctacgttaaaaggttctacttgccagcattttagggcgttaaacaattttctgtttgggggagaaacaatgggatttggcagcttaaagggttttaaatggtacaaaagttaccaaagcaaaaaactttaccttctacctgcctctttttcacagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256170 - DNA, 2257 bp, Homo sapiens
  misc_feature (2077)..(2077): n is a, c, g, or t
  misc_feature (2081)..(2081): n is a, c, g, or t
  misc_feature (2092)..(2095): n is a, c, g, or t
  misc_feature (2097)..(2097): n is a, c, g, or t
  misc_feature (2099)..(2100): n is a, c, g, or t
  misc_feature (2103)..(2104): n is a, c, g, or t
  misc_feature (2106)..(2106): n is a, c, g, or t
  misc_feature (2108)..(2111): n is a, c, g, or t
  misc_feature (2122)..(2122): n is a, c, g, or t
  misc_feature (2126)..(2126): n is a, c, g, or t
  misc_feature (2171)..(2171): n is a, c, g, or t
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatgaggctcccaaacacagttccaatcccagccccagaaccagccaccccaactgtgggcagccccagctccaatgaacttgggctgctgtgttcgatgttcccttgaaatgggcgctggttttggaagctgcggctagagacaagtgaggtaagggggacatgagactgccaagctgctgagnctcncatctgcagtnnnncngnncgnncngnnnnactgcagatgngagnctcagcagctgtgaggtgctcttgaccaaggagggagtggagacnaacttggagcaggcgaacattcttcagggggctgaggagctgtggcaggagagctgctcccactgcagagaagacagagagggggc

SEQ ID NO: 256171 - DNA, 1861 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggagaactatgggaggtggagacggctccttcacatggcaaagaggatgagaaaggctaccatcagacaaaagagccccatggcctccgagagggcgagcggccgcgaatttagtagtagtaggcagc

SEQ ID NO: 256172 - DNA, 2019 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaactggtaggtcctgccattaagctctaacatcaagcagctgaatactttctccctcattgagccttcctccattatcatccctctcccgatgataaaccactggaatatacctaagtaaaaaaaatggtggctttctttaccaagggcttcccagagacacaaacaagcaacccccaggtttctgaagcatccccataaaatacatcagaaggcccttcccttacctgtcagcaccacgggcacaggaaccatttccttttttccctaccagcctgcgtcctgtgcctggccagaagctcataaaaccaaaacagggcaatgtcc

SEQ ID NO: 256173 - DNA, 1791 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgcaggaccctctctgagcacagctcttctctacgcattttggcttgctctcggagccatgggctctttgcttaggtagctgtcaacctttgcatgaagggcgttcactcatagttccggc

SEQ ID NO: 256174 - DNA, 670 bp, Homo sapiens
  misc_feature (490)..(490): n is a, c, g, or t
  misc_feature (494)..(494): n is a, c, g, or t
  misc_feature (505)..(508): n is a, c, g, or t
  misc_feature (510)..(510): n is a, c, g, or t
  misc_feature (512)..(513): n is a, c, g, or t
  misc_feature (516)..(517): n is a, c, g, or t
  misc_feature (519)..(519): n is a, c, g, or t
  misc_feature (521)..(524): n is a, c, g, or t
  misc_feature (535)..(535): n is a, c, g, or t
  misc_feature (539)..(539): n is a, c, g, or t
  misc_feature (584)..(584): n is a, c, g, or t
attcgcggccgcgtcgactttttttttaaacatcttattaatacagtatttatttgtcttttctctgtcaaaccctgagccaaccacgttccccaggctgcctggggaggtataggaaaaggaacacacggggccaaccagacgcgggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatgaggctcccaaacacagttccaatcccagccccagaaccagccaccccaactgtgggcagccccagctccaatgaacttgggctgctgtgttcgatgttcccttgaaatgggcgctggttttggaagctgcggctagagacaagtgaggtaagggggacatgagactgccaagctgctgagnctcncatctgcagtnnnncngnncgnncngnnnnactgcagatgngagnctcagcagctgtgaggtgctcttgaccaaggagggagtggagacnaacttggagcaggcgaacattcttcagggggctgaggagctgtggcaggagagctgctcccactgcagagaagacagagagggggc

SEQ ID NO: 256175 - DNA, 1190 bp, Homo sapiens
  misc_feature (1010)..(1010): n is a, c, g, or t
  misc_feature (1014)..(1014): n is a, c, g, or t
  misc_feature (1025)..(1028): n is a, c, g, or t
  misc_feature (1030)..(1030): n is a, c, g, or t
  misc_feature (1032)..(1033): n is a, c, g, or t
  misc_feature (1036)..(1037): n is a, c, g, or t
  misc_feature (1039)..(1039): n is a, c, g, or t
  misc_feature (1041)..(1044): n is a, c, g, or t
  misc_feature (1055)..(1055): n is a, c, g, or t
  misc_feature (1059)..(1059): n is a, c, g, or t
  misc_feature (1104)..(1104): n is a, c, g, or t
gtcacatgtagtcccccctggggataagaaattagtggcgctgcgcgaagagatcacgaattgcccgcaggagtggccgcaggagtatttttcgtaggcgcgacgacgggcatcattagtgcgccgcgtcatgtggtggactccaccctgtagtaggacaccgtgtgagagagtttgtttattatattgttcccctggtgaggagggcgctcgttgataaatcgcgcgcgggggggggtgggttggtggccccgattgtgtgtcgcgcccctgagatgcgtgtatatgtggtgtcgtctctgtcgcggatggtgttccccggggtggcgctcgatttttcccccgctgttgacgcgccgtgtggttgtagaaacgctgcgtggccccgtggccgctggtgttataattatacggcctcccctctttgtggggcccccttggtcccagagcggggggcgcgcggtggggggccccccggggggatcttttgggggcgcgcgcccccctctttttttttttttttttttttttttttttttttttttttttttttcttattaatacagtatttatttgtcttttctctgtcaaaccctgagccaaccacgttccccaggctgcctggggaggtataggaaaaggaacacacggggccaaccagacgcgggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatgaggctcccaaacacagttccaatcccagccccagaaccagccaccccaactgtgggcagccccagctccaatgaacttgggctgctgtgttcgatgttcccttgaaatgggcgctggttttggaagctgcggctagagacaagtgaggtaagggggacatgagactgccaagctgctgagnctcncatctgcagtnnnncngnncgnncngnnnnactgcagatgngagnctcagcagctgtgaggtgctcttgaccaaggagggagtggagacnaacttggagcaggcgaacattcttcagggggctgaggagctgtggcaggagagctgctcccactgcagagaagacagagagggggc

SEQ ID NO: 256176 - DNA, 881 bp, Homo sapiens
  misc_feature (701)..(701): n is a, c, g, or t
  misc_feature (705)..(705): n is a, c, g, or t
  misc_feature (716)..(719): n is a, c, g, or t
  misc_feature (721)..(721): n is a, c, g, or t
  misc_feature (723)..(724): n is a, c, g, or t
  misc_feature (727)..(728): n is a, c, g, or t
  misc_feature (730)..(730): n is a, c, g, or t
  misc_feature (732)..(735): n is a, c, g, or t
  misc_feature (746)..(746): n is a, c, g, or t
  misc_feature (750)..(750): n is a, c, g, or t
  misc_feature (795)..(795): n is a, c, g, or t
ttcccccaatcctaaaaaccacggttaaccctggcgtttaaccggaatattaataaccgacccccccttataaggggagacccgcgccaaatatttaccccctttggaccaaaaaaactctggggtccaaggaaaccaacctatatgacccacatgggcccaatttccaataacaccctctttttcccgcccccccgacaaaaaaaagcccccgagatttttttttttttttttttttttttttcttattaatacagtatttatttgtcttttctctgtcaaaccctgagccaaccacgttccccaggctgcctggggaggtataggaaaaggaacacacggggccaaccagacgcgggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatgaggctcccaaacacagttccaatcccagccccagaaccagccaccccaactgtgggcagccccagctccaatgaacttgggctgctgtgttcgatgttcccttgaaatgggcgctggttttggaagctgcggctagagacaagtgaggtaagggggacatgagactgccaagctgctgagnctcncatctgcagtnnnncngnncgnncngnnnnactgcagatgngagnctcagcagctgtgaggtgctcttgaccaaggagggagtggagacnaacttggagcaggcgaacattcttcagggggctgaggagctgtggcaggagagctgctcccactgcagagaagacagagagggggc

SEQ ID NO: 256177 - DNA, 567 bp, Homo sapiens
attcgcggccgcgtcgactttttttttaaacatcttattaatacagtatttatttgtcttttctctgtcaaaccctgagccaaccacgttccccaggctgcctggggaggtataggaaaaggaacacacggggccaaccagacgcgggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatgtagaaggagaagagaaaagactgaatttctagttcacacaaagaaaaggataaatatctaagatgggctcagggagaatccccctcttcaagattatctcacataataaagaagcttttagggtaacaccatcatgcccaaattcttgccctgattccccaaaggctctacaggaactgaatgaagggggagcaggcaatctaaaatcctgtaacatggcccaggtatttggcccttaatcgaggggaaccgagctcg

SEQ ID NO: 256178 - DNA, 1668 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctctctcctgccacagctcctcaccccctgaaaatgttcgcctgctccaagtttgtctccactccctccttggtaaagctattaaagtcaaccttcaaaattcttagctctataagatgcttaataaacactgattgaattggagggttaagatgcccgggacataaacatagactcctttgctttggggatggtttaagacccttacattgattgactgattgactgattgattgactggagacagggtcttcctctgtcgcccagcctagagtacagtggtgcgatcacagcacactccaacctccacctccagcaattctcctgcctcagactcccaagcagatggaactacaggtgcatgccaccactcccagctaattttgcatttttagtaggcatctgtagtcccagctactcgggagctgaggcaggagaatggtgtgaacccagaggacg

SEQ ID NO: 256179 - DNA, 368 bp, Homo sapiens
tgctgttcagaggatcccgaggtgacagctggacagcacagagggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256180 - DNA, 731 bp, Homo sapiens
  misc_feature (551)..(551): n is a, c, g, or t
  misc_feature (555)..(555): n is a, c, g, or t
  misc_feature (566)..(569): n is a, c, g, or t
  misc_feature (571)..(571): n is a, c, g, or t
  misc_feature (573)..(574): n is a, c, g, or t
  misc_feature (577)..(578): n is a, c, g, or t
  misc_feature (580)..(580): n is a, c, g, or t
  misc_feature (582)..(585): n is a, c, g, or t
  misc_feature (596)..(596): n is a, c, g, or t
  misc_feature (600)..(600): n is a, c, g, or t
  misc_feature (645)..(645): n is a, c, g, or t
ttatacgaatcagctcgtaccctctatagggcctagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatgaggctcccaaacacagttccaatcccagccccagaaccagccaccccaactgtgggcagccccagctccaatgaacttgggctgctgtgttcgatgttcccttgaaatgggcgctggttttggaagctgcggctagagacaagtgaggtaagggggacatgagactgccaagctgctgagnctcncatctgcagtnnnncngnncgnncngnnnnactgcagatgngagnctcagcagctgtgaggtgctcttgaccaaggagggagtggagacnaacttggagcaggcgaacattcttcagggggctgaggagctgtggcaggagagctgctcccactgcagagaagacagagagggggc

SEQ ID NO: 256181 - DNA, 628 bp, Homo sapiens
  misc_feature (448)..(448): n is a, c, g, or t
  misc_feature (452)..(452): n is a, c, g, or t
  misc_feature (463)..(466): n is a, c, g, or t
  misc_feature (468)..(468): n is a, c, g, or t
  misc_feature (470)..(471): n is a, c, g, or t
  misc_feature (474)..(475): n is a, c, g, or t
  misc_feature (477)..(477): n is a, c, g, or t
  misc_feature (479)..(482): n is a, c, g, or t
  misc_feature (493)..(493): n is a, c, g, or t
  misc_feature (497)..(497): n is a, c, g, or t
  misc_feature (542)..(542): n is a, c, g, or t
catacggtcctgattatttgcttatattgttttgcccaatgacactgtagagtctaaagttgcagagtctgtaattggcgctcgtaggaagccaaccagacgcgggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatgaggctcccaaacacagttccaatcccagccccagaaccagccaccccaactgtgggcagccccagctccaatgaacttgggctgctgtgttcgatgttcccttgaaatgggcgctggttttggaagctgcggctagagacaagtgaggtaagggggacatgagactgccaagctgctgagnctcncatctgcagtnnnncngnncgnncngnnnnactgcagatgngagnctcagcagctgtgaggtgctcttgaccaaggagggagtggagacnaacttggagcaggcgaacattcttcagggggctgaggagctgtggcaggagagctgctcccactgcagagaagacagagagggggc

SEQ ID NO: 256182 - DNA, 317 bp, Homo sapiens
attcgcggccgcgtcgactttttttttaaacatcttattaatacagtatttatttgtcttttctctgtcaaaccctgagccaaccacgttccccaggctgcctggggaggtataggaaaaggaacacacggggccaaccagacgcgggagaactatgggggtcaggagttcgagactagcctggccaacatggtgaaaccccttctctactaaaaatacagaaattagccaggcatggtggcagatgcctgtaatcccagctactcaggaggctgaggcaggaaaatcacttgaaccctgaaggcggaggttgcagt

SEQ ID NO: 256183 - DNA, 528 bp, Homo sapiens
ttcccccaatcctaaaaaccacggttaaccctggcgtttaaccggaatattaataaccgacccccccttataaggggagacccgcgccaaatatttaccccctttggaccaaaaaaactctggggtccaaggaaaccaacctatatgacccacatgggcccaatttccaataacaccctctttttcccgcccccccgacaaaaaaaagcccccgagatttttttttttttttttttttttttttcttattaatacagtatttatttgtcttttctctgtcaaaccctgagccaaccacgttccccaggctgcctggggaggtataggaaaaggaacacacggggccaaccagacgcgggagaactatgggggtcaggagttcgagactagcctggccaacatggtgaaaccccttctctactaaaaatacagaaattagccaggcatggtggcagatgcctgtaatcccagctactcaggaggctgaggcaggaaaatcacttgaaccctgaaggcggaggttgcagt

SEQ ID NO: 256184 - DNA, 184 bp, Homo sapiens
tctaaaatcctgtaacatggcccaggtataatcatgaccttcactaatggttcacccatctcattaccacaaattaagacctcttggcccagacacttaatatccagggcccaaataggatggaagggtctatctagagcagtgttttcaaactttaagcagaactccaatatagtaaacatct

SEQ ID NO: 256185 - DNA, 854 bp, Homo sapiens
  misc_feature (32)..(32): n is a, c, g, or t
  misc_feature (35)..(35): n is a, c, g, or t
  misc_feature (42)..(43): n is a, c, g, or t
  misc_feature (45)..(46): n is a, c, g, or t
  misc_feature (687)..(687): n is a, c, g, or t
  misc_feature (723)..(723): n is a, c, g, or t
aattcgcgggccgcgtcgactacggctgcganagncgacagnngnngctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaacaaaacaaaaaaaaaaaacanttgtggggcgcgcggccggaaaagtttaaacacatnggtgggcggggccagtgaggaacaggccaggggccaagaaccggccagcaggggggttcccaaaaacggggccgggctgaacccagggggggctgtcaacggcacacccccccgcacggggaaatacaaag

SEQ ID NO: 256186 - DNA, 757 bp, Homo sapiens
tagctagtagagctgggtgtgaatcggccgaggcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaaaacacacccaaaaaaacaacatttttggggcgcccgcggtaaaaaaatttgggcccagaaaagtttttaacacccatcgtgggggccggcgggcaccaaggtatggaacc

SEQ ID NO: 256187 - DNA, 871 bp, Homo sapiens
  misc_feature (646)..(646): n is a, c, g, or t
gcctactactactaaattcgcggccgcgtcgacgcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaacaaaaanaaacaaacaacaacacacacaaaacgtgcggcgcgggccgcgctagagagaagcttaagcacaactggtggggggcggggccccaggggaacgagaacttggccacgcgtggcccaagcagaccgcgctccacaagcggggggtcccccaaaaaaaagcggggggacacggcgcgtaacacaccacaggggtcggccacgggctacaaaggcaggccgaaccccg

SEQ ID NO: 256188 - DNA, 943 bp, Homo sapiens
  misc_feature (138)..(138): n is a, c, g, or t
agtgacagtggaaacagaaagcctattagccaacattttaagccagaacttgaagttgctactgacagcaatcttctcaggcaagtagcaggccatgccaggtgaaaataatttaaaatgttatgctatttcaaatanaatttgcctgtcacagaattaagaaaaagtgagctcagccaaatccatgttgagtttagcaccatcactacccttcgggccttgtactctcacgaaggcactcagccaactgtggaaaagaaatatacacaggagactcaagaaacatcttattaatacagtatttatttgtcttttctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256189 - DNA, 2078 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaacaacaaacaaaacaaacaaaaaaaatttttggggcgccggccccaaaaagttttaaaccacctcgttggggcgcgccccccaggtctttacccactggccaacgggtcacaaaaactcgggccagaatcgggtggggttccc

SEQ ID NO: 256190 - DNA, 1979 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaaaacaataaaaactccagggggggccggtcccaattgctctata

SEQ ID NO: 256191 - DNA, 2114 bp, Homo sapiens
  misc_feature (1999)..(1999): n is a, c, g, or t
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaagtattaatacgaaaaaaacaacaacaaaaaaaacaattttggcgccctcgccccgaaaatttnaacccattgttggggcgcgccaagaaggcaactgccacggtcggagaccggcacacagggggggtcccaaaaagcgcggcggcgtgacaaccgggtgggccggctccggccccac

SEQ ID NO: 256192 - DNA, 1979 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctctctcctgccacagctcctcaccccctgaaaatgttcgcctgctccaagtttgtctccactccctccttgactttgctaaaaggaagaatgatccaaaactctaacgtacatgtgaagatggaaaggccatgagaggaaagaaaatcttgtctgatgatgtaacaacgtggcatagttctgaaactcctctccagtcttccttgaccttcctgcccctgtatgtcattcctgctaggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256193 - DNA, 1867 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256194 - DNA, 2154 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatgtagaaggagaagagaaaagactgaatttctagttcacacaaagaaaaggataaatatctaagatgggctcagggagaatccccctcttcaagattatctcacataataaagaagcttttagggtaacaccatcatgcccaaattcttgccctgattccccaaaggctctacaggaactgaatgaagggggagcaggcaatctaaaatcctgtaacatggcccaggtatttggcccttaatcgaggggaaccgagctcg

SEQ ID NO: 256195 - DNA, 2054 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctctctcctgccacagctcctcaccccctgaaaatgttcgcctgctccaagtttgtctccactccctccttgactttgctaaaaggaagaatgatccaaaactctaacgtacatgtgaagatggaaaggccatgagaggaaagaaaatcttgtctgatgatgtaacaacgtggcatagttctgaaactcctctccagtcttccttgaccttcctgcccctgtatgtcattcctgctaggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaaaaaaaaaaggaccaaaaaagcaaaacaaaaaacaccatcaaacaaacaacacacaaaacaaacaaaacaaaacgg

SEQ ID NO: 256196 - DNA, 2054 bp, Homo sapiens
gtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgcagatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcagctctcctgccacagctcctcaccccctgaaaatgttcgcctgctccaagtttgtctccactccctccttggtcaagagcacctcacagctgctgagccgtccgctatctgcagtggtgctgaaacgaccggagatactgacagatgagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccagagtctgactctgtcacccaggctggagtgcaactgtgtaatctcagctcactgcaacctctgcctctcgggttcaagcaattctcctgcctcagcctcccaagtagctgggattacaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagaa

SEQ ID NO: 256197 - DNA, 1083 bp, Homo sapiens
  misc_feature (903)..(903): n is a, c, g, or t
  misc_feature (907)..(907): n is a, c, g, or t
  misc_feature (918)..(921): n is a, c, g, or t
  misc_feature (923)..(923): n is a, c, g, or t
  misc_feature (925)..(926): n is a, c, g, or t
  misc_feature (929)..(930): n is a, c, g, or t
  misc_feature (932)..(932): n is a, c, g, or t
  misc_feature (934)..(937): n is a, c, g, or t
  misc_feature (948)..(948): n is a, c, g, or t
  misc_feature (952)..(952): n is a, c, g, or t
  misc_feature (997)..(997): n is a, c, g, or t
cgctggctgtggtgtgtgtgtacgtgtgcggtcgctcttgtggtgtcgtggtgtcgccatgtgttcccgacgccgggcggcgtaatttgattatactcgacgtcctcgcgtgggcacccccgtgttggagttatgatacgcccgggtgatgtcccctctccggagctcctcctcctgggagttgtggtttcccgggaccacgctcccggcgttcccccccccgcgcgcgtttttttttattgggggagaggaactcccccgccccttgtcgccgggcccgcgggtttcctctgggaaccccccttgggacccactgtgtccccttacaccctggggccccgcgcggcgcccaaaccaacggtggcgtttcaaaaagccttttcgccggggccccgcgggcgcgggccacaacacatttttttttttttttttttttttttttttttcttattaatacagtatttatttgtcttttctctgtcaaaccctgagccaaccacgttccccaggctgcctggggaggtataggaaaaggaacacacggggccaaccagacgcgggagaactatgggaggtggagacggctccttcacatggcaaagaggatgagaaaggctaccatcagacaaaagagccccatggcctccgagagggcaaagcccagaatggcgtaggagaagagctgttgcttcagagaagggttcctggcataaccaatgatgaggctcccaaacacagttccaatcccagccccagaaccagccaccccaactgtgggcagccccagctccaatgaacttgggctgctgtgttcgatgttcccttgaaatgggcgctggttttggaagctgcggctagagacaagtgaggtaagggggacatgagactgccaagctgctgagnctcncatctgcagtnnnncngnncgnncngnnnnactgcagatgngagnctcagcagctgtgaggtgctcttgaccaaggagggagtggagacnaacttggagcaggcgaacattcttcagggggctgaggagctgtggcaggagagctgctcccactgcagagaagacagagagggggc

SEQ ID NO: 256198 - DNA, 785 bp, Homo sapiens
gtcacatgtagtcccccctggggataagaaattagtggcgctgcgcgaagagatcacgaattgcccgcaggagtggccgcaggagtatttttcgtaggcgcgacgacgggcatcattagtgcgccgcgtcatgtggtggactccaccctgtagtaggacaccgtgtgagagagtttgtttattatattgttcccctggtgaggagggcgctcgttgataaatcgcgcgcgggggggggtgggttggtggccccgattgtgtgtcgcgcccctgagatgcgtgtatatgtggtgtcgtctctgtcgcggatggtgttccccggggtggcgctcgatttttcccccgctgttgacgcgccgtgtggttgtagaaacgctgcgtggccccgtggccgctggtgttataattatacggcctcccctctttgtggggcccccttggtcccagagcggggggcgcgcggtggggggccccccggggggatcttttgggggcgcgcgcccccctctttttttttttttttttttttttttttttttttttttttttttttcttattaatacagtatttatttgtcttttctctgtcaaaccctgagccaaccacgttccccaggctgcctggggaggtataggaaaaggaacacacggggccaaccagacgcgggagaactatgggaggtggagacggctccttcacatggcaaagaggatgagaaaggctaccatcagacaaaagagccccatggcctccgagagggcgccgctcgcgatctagaactagt

SEQ ID NO: 256199 - DNA, 3174 bp, Homo sapiens
  misc_feature (1279)..(1279): n is a, c, g, or t
  misc_feature (1982)..(1982): n is a, c, g, or t
  misc_feature (2916)..(2917): n is a, c, g, or t
  misc_feature (2922)..(2922): n is a, c, g, or t
ctgtgggagtttgctctcttaaactcccacgttccaacctcagccaagctctccgggcagccacacttccctttgccagctgtgaccaccaatactgccaccaggggggtctgcaggacctgcagggccacactcattggcacctcggtgacttcacttactctggtcaccctgctgtctctcccaggcctcctccctcacagaccttctagggaaaggttctctatcatggtcaactttgagccgtgtatattggccacaggcatccctccttctattagggcgccatactgctcacttattattgcctaaaacctgctcccttgtaggctttctttacagggctctagcggattcttagagatagtagacagctcactggtaaccacagttcaaatgcaaaccaaccaattcacagccacaccctcaccactggctttattgggctcgaactccaggccacacccacctaccctaatcaccccatagccatgggtcagacacctaaagacaacccctgtgtcccagagcccatggaaatgacccaagccagccaatcctaagcctgcttaccctgcctggccccttctttcctgtgaaaatcacaataaaaacattttttaaaaaaatttaagttccagggtacatgtgcaggatgtgcaggtttgttacataggtaaacctgtgccatggtggtttgctgcacctatcaacccatcgcctaggtattaagcccaacatccattagctattcttcctgatgctctccctcccccaaccccactcctcacaagccccagtgtgtgttgtttccctccctgtgtccatgtgttctcattgttcagctcccacttacaagtgacaccatgcggtatttggttttctgttcctgtgttagtttgctgaggataatagcttccagctcaaaactcttgacagttctccccctctccctctgcctcctgcccaaccctggggctttcccaggtaactccctgtggcatgtggagtccccatggatctgtgagtaacaaaccatctttgcaatagcagtcatttcctcatcttggccttaccataccacaataagaataaaacctgttaaaacagagagaacagagggagaaaggaaggagaaaaggaaaatgaatgaagaaggaataaagaatgagtaattaaatgaacaaatgataagttacttaaaatctgctttttcttaggaggagaaagaactaacagagatgcagaagtcctcttctactcgggctggggatatgcntgagaaagacacgcgtggatgccgtatgagctctcgttctgaatgcggaaatctgacctcccaccggatactcagttcagggggctcctggaccctccagctgctcctctactcatcgctccctcactcagaaaaccagcagagaagtgaacttcctcaaatgactgacggtaaatatccagcatggagctggattacaaaactgtataaactgtaaatagcatcacgctattcccttttaaagaagtgtcagtgcttttattcattaagattcagatgctatggagggggcagatgcgccttctcccctcctggatcccaaataaaacaccccgtatggaagcagatggctttgtgtaaatcagatgacagtttacggagtgagacggcctcatcggaacggcattacaagtatcatcttttgaggggaaatggggttaatcaagtccagctttaattggaggtcacatttgcatgtgaaattctgggtccctgtaaggactgcctgggtccctgggtcatcaggccagtaacctctccaccattttctttccagagggagccccaggtaatgcatgagaaaggaagtgttataagaagccaagaatgggtgccccccaccccccaaccaagagccagttctgttaacacagcagagagccctccccaggtctcaaagtctccctgcctttgctgccacagntaagagggggtggttttgctcactgcaaaccacataacagaaacaacacctgcttgggcacttaaccctggaacgggaaagctgaaagtggtttctgtttattttgatctcgagcgtaaaatgaagagcaatcatgtccctggagtctcggcagaggacaaacaaagctgatggaggaagacaaagtctgctttttcaggatgcttcatgggaggctggggtgttaagcgctcctcagcctgcctgtgtgatctgagaaacggggcgggggcaggtggggcgggggcagtggcatcaggtgcctgcctcccgccgagggtattcaccattcaaagcacaggcgcgaagagcaaacagctaccagacagaatcctttaggtctaggctattcctttcctttgaaccagagacaggaacagaacaccttagcccagcctccctgcaacattccaacacttgaattgtaggatgggagtcccaatttcccagacatcagggcaatattctcccatttccttacaacactgggtcaatgtaaaggttaaaaatttaaataaatataaataaataggagatcaacatcctcctttcttgggaaaattcagacaatgctacacaaaagtttggaagacgagatatctaaagatcacccagaaaaaagatataggagcatgctgttttcattaggtttcttcaaaaatcagtggtatgatttcacagtattttgtttcatggaatatattcacgatatttgtttcatggaataaattcatgatatttgtttcatggaatatactggatatctgtttcatggaatatattcacgatatttgtttcacacaatatattcatgatatttgtttcatggaatatattcacgatacttgtttcatggaatatattaggtatttgtttcactgaatatattgactgnnactcngaatcctaacatgcaatgtctttcttcaaaagacagtgtcatgcattccttacagtggatttatcaattaatgctgagtccccagccaagtgataagtcataccatctctcttactccttttttcttaatccttaaaaaaaaaattaggtccgccctcagcctttatattccaattcttcattccacactcctgactttttcccaagttattcaaggatggaaaagcgtatcatctccaagctagctctttc

SEQ ID NO: 256200 - DNA, 553 bp, Homo sapiens
ccctcagatccccacaatacccttgaaacataaagaagagattttaaccccctctctttgcatattgagaaacccagggaaatacagcgtcttacacgggacagtagaatcagcgttcaggagagcagaaaccaacgccctgttctcttggctcccagttctctttgtaatcagattaaaaaccctcttcactaagtacttagatacatgtgctggaaaggaagaagtgcttcccatctaagaaatagtctttaaaataagaagaatctagatattaaaaataaaatttgattaggaagtgatatgttcagacagtcgttgatataagcaacttacattctattctgttatctttaaggtgtgtgttaatattttgctaatgtaagcccttaggcccaggaactgtgtcatatacatgcatatactttataaataatttaacacagcatttcccaaccattgtgtgcaaactcatttggtgtgatcagttgggtggagtgtcacaagtaatttgttattaataacagtttttgtattgtgtggatattaaaag

SEQ ID NO: 256201 - DNA, 755 bp, Homo sapiens
caactccattctattgcattacccagtccaccaatcctagtccctttgggcacccagaatgccaatctccaaccccttcctctcccctaccaacccctcattcccaaaggtgcttttaaaaccacatgtctcaattttgagttttgacagcatgatccctgaccacattcgtataaccaaccccctgacccccttccattattaggactccctcagcagaaacacctaggtcaccagagaaggcaggaaacgtggggcaattcattgaggggcagtgaatcacctcggttctctctctgcatcccctgaagatcctcagccccagaatatcaatccaaagcctctgagaccacattagaagccagttctgaagaagacaggtgtgactggagtctgggaatacttaggacaaagccattgcgtgggggtctagggactcactgggagatcaagagccactggctgacatccctgtggccctgggatagggaggagcgtcaggaaagagcagggagtctccatgcagtactggggttgggcggactgcactcttgggcttaaaaggcactttctcttagtaatgtaacccacacccagagttttctattctacattttatgttttagatttaatttcttttgttttgtgtattcaatcacaaaattttaattggtatgtttgttggttgttagttggctgaacacagagtagttgcctattttggtcatttagtaaactctacctaaatgctaaca

SEQ ID NO: 256202 - DNA, 355 bp, Homo sapiens
tccattccaccccaaacctcactggactcagactctcagggatacactataatgactgctaactttggtagcacctgcacctagtgtagcttcctaatgcttccgtgaatcccagggagaacactgtaaaatgatcatatgatcttttatttctcacttaattcattctgtgtcattccattggtttgtgaattgtgtcaatagatagaaagtttggactgtgggtgtctggaaatatatccaccccttctacattaattcttatgaaaaaatattttattcaccttttttactgtaagatgaatttcccagtaatgtaaccttgatgcaaataaatgctctaaccgttgtgcca

SEQ ID NO: 256203 - DNA, 354 bp, Homo sapiens
cttgaactcctgggctcaagcattcctcccaacttgatctcccaaagtgctaggattacaggcatgagccaccgcacccagactaaataatactttttaaagtgtcagtttgcttggataattgccctggatgtttagtttcaggaagtcactgtaacagatctgatcactataaataaattatattcaggtaatgatttaaaatatatatcagcaggcattgaatattcaggtataatgagttttaactgattataagaatgcttcctttgagatgattcaaagcttcccttgttggatttgctgctggaaatgcagtcaaaaagatttctttttttttttttttttttgaga

SEQ ID NO: 256204 - DNA, 728 bp, Homo sapiens
gaatgattaacattgaactcctggccagcagcactacatacattcttgaacaaagttgcctatgaacgtattttctctgtaagagaaatgtcagcttccttgcccttaggaggacggaacaacactatcctgtaggggtgagggtaacagaaaaattaccagcaaaaggaacaaaaatgcagaaaaggtggctctaaacagactggaaaaagtacacttgttaatagggagtacagaacataagagcagaacatcactttgttagaccccagtttttccccacttgtgcatgtctgcaaatgaccaaacggcactacaggtattgattgaagagttacagatacgttctagctggtagggaaattcacaaatatgaaatcttaataatgaggattaacttgatatacattagtgggcaagttgagattcctgaaattaaatgcaactgactgctctacatttctaaccctaagtattacgcatcaacatgagttcaagtggaagcaaaaataaatgattcctacaacatgcttcccagtaaatgtgtttttccacttaatgggtgatggaagaaaggcttaactactttacatcacaatgaaaattctgaagaaaatgcctatatcatttaagacctaaaggcataaatgaagaatataaaaaggtgacttgacaagggaaaacagaaatgaagtctcttgagaaaagttgtccaatgttatttttgt

SEQ ID NO: 256205 - DNA, 201 bp, Homo sapiens
cgtcgaccctagtaaacctcttgctcttggtatctgcttctggagcagctcaaactaacacaccaaagaagtgctgggtggtagagacaagccttttagattccttgtggcactggcctgcctgctctggagcccagctctggggataaggtcaagagaagcatgccctgggttggcagggagaacctggggcgtcttggt

SEQ ID NO: 256206 - DNA, 402 bp, Homo sapiens
caacacccacctatccacctacccacatgcatgctttggaggattttggaagagtgctgaatggcatgttataatttttcaattcgtttaaatatttaaaaagtgatagtcttttatgactgggtgcggtggctcacgcctgtaaacccagcactttggaaggctgaggcaggtggatcatttgaggccaggagtttgagaccagcctgagcaacgtggcaaaacaccattctactaaaattagaaaaattagccagatgtggtggcacaggcctgtgatcccagctactcgggaggctgaggcaggagtatcacttgaacccgggaggcagaggttgcagtgagccaagatcgtgtcactgcactccagcctgggtgacagagtgagactctgtcttcaaa

SEQ ID NO: 256207 - DNA, 658 bp, Homo sapiens
aatgcttgagaatagttcacaagtaagaattaaaatataggcccgttgttccataatgaaatcctataatttggccataaaactaatatttttaattatttgcataattggattagggagcaagggtaaagctgatagacttatttgaaaatattacttctgggtttagatgagaaagtgctagatacttcacacaagttagtagctagccccagaatcatctttttatcaaagagatgcagtagttttagtctcaggagtgatggtatatccacccagcagtttatcactcagtcccatctgccaatcctacttttacctatccctacccttcagtccccaccccacacctgagtttaccaaccccttcagaccctcagtgtttcattcccagcaggttctccctcttctccttttgcttcagttgttaatatgtagtgtccaacatcacaaagtcctttagcacaatcagaactaggaatttatttaaaatataggtatgtaatttacgtcagtgctagagagaagttttaatggaaacgttgtttctagctctccactgaacatttctacatggttgtcatgtaggcacctcaagcccttcaagtcctaaaatatatcagaatctccccaccaaatctccatctcctatgtcctg

SEQ ID NO: 256208 - DNA, 291 bp, Homo sapiens
  misc_feature (71)..(71): n is a, c, g, or t
  misc_feature (216)..(216): n is a, c, g, or t
cttggcctcccaaagtgctaggattacaggcatgagcccctgcgcctggcctgctatgtgtatattaatgngtggtcttgatcttgaactgaggctctgaaagggtatgacaaatactgacggccatctgccaactacagagctgtgaactgttcactcattaacagtttataaacaacaagataacatcctccaacttatcttcctgctctagcngaggtgggcagtgaggataactgttcaggtcccctctttggaggtctggtgtcatgagcatgagccctcctgcag

SEQ ID NO: 256209 - DNA, 366 bp, Homo sapiens
ggcttccagatcagctaaagtctcaacaagaatgaaaatgacacttcaaaggatttaagtgaagagagtgtcgtgaagattatttgtagagatgtgggatcggatgagaaacaccctgggaccagaaacagcagaagccctaatgcctgccgaagggcaagaccagggtgagctcctacccacagtatctggcgagagctggagccctgagacagggatggggcctactggcacttggaaagtgtactggggtcttagtgaactgatgtcatttcctcttctcttccccaggatttgagatttctaaaaacaacaacaacaacaacaacaacaacaacaaaaccctatacaaatctaaattagtta

SEQ ID NO: 256210 - DNA, 255 bp, Homo sapiens
atttatatttaaatctacctttgaattaccgattgtgactgaggtctcatgtggcttactggtgaatccagtagttgaggaaacgaaagccgtcacttctgctaactcttttaccaactcacctgctgtcaccttacacaaccccaactgtgtttcagctttggagtaatgaacacaccattttcttcctacttaaaagtccactcaggataatgattaagaaatacattgatgccgagtaataaatactttaaa

SEQ ID NO: 256211 - DNA, 508 bp, Homo sapiens
  misc_feature (6)..(6): n is a, c, g, or t
  misc_feature (313)..(313): n is a, c, g, or t
ggtgcntgattcactacaggaaatcgacaagagcgcgttttcgaccgttatctcgcgaaaactaagggacccgcgcatgcgtccctagcgaagccgcagccgtttccgccctggctggcggcgccgcggacgggcgcggcttctgcgcctgcgcccggcgtatcgtctcttttccgggtgggaggtggggccttgggtgtcctgagagcctgcaggtggcccagctctctgcggtgaggcggtcgcgctctgccgagtccacctgtttgcaaagccggtgcggccctactgtgtgcagggccggggcggggangcgcagcccgaacgtcacgtgccctcacatctgttggtgaccaaggttacttatgcattaacgtttagggacaaacgtggaaaatgcattctttggtgcccctggagacatcttgtgtgtgcagaaaacactactcagaagtttatgtgcgtttaaacatgtgatttaaataatacatgatttccaaagtaaaaa

SEQ ID NO: 256212 - DNA, 492 bp, Homo sapiens
ttgggcagtaggacagatgaggatggttatcttttaatcatcttttgaaataatactcttaacactttagattataaaatgtttagacatgtggaaagtgccttcagttgatcactgggagagactataaacatggatcaggatgctaagattatgtatcttgttttaaaaaaaatcattcttatttaaaaggtcttaatgtcaggccgtgtgcggtggctcacacctgtaatcccagcactttgggaggctgaggtgggcagattgcttgagcccagaaatttgagaccagcctgggcaacatggcaaaaccctgtctctacaaaaaaatacaaaaattagccaggcatggtggcgcatgcctgtagttccagctacctggaaggctgaggtggtaggatcccctgagccctggaggtcaaggctgcagtgagctgggatcatgccactgcactccagcctgggtggcagaccaggaccctgtctctaaaa

SEQ ID NO: 256213 - DNA, 628 bp, Homo sapiens
agcacaccaagtatagcaacatacaaggattgtataccatgaccaaatggatttatgcaagtttggttcaacatttgaaaatcagtttatgtaatacactgtgttaatagaataaaggacaaaaaccacatgatcgtttccataggagcaaaaaagcatttgacaaaatccaacaccctttcatggtaaaaacaaaaactcaggagagaacttcctcagcctgttaaagggcatctacaaaaacccatggctgacatacctaatggcaaaaaattgaaagcttctaccactaagatcaggaacaagacgagttcctgatcgtttctggaagtggcagtgccattgccacttctcttcagcatcgtattggaggttctggctagggcagttaggcaagaaaaagaaattaaaggcatgcaaattagaaaagtagtgaaactgttcacagatgggatgatcttatatgtagaaaaatctaaggaatctactataaaaaccagtaaactaataaataggttcaacaaaggttcagaatacaaggctaatattaaaaaatgagtagtatttctatagagtagcaatcaacaaaccaaaaattaagaaaacaattttatttataataggatca

SEQ ID NO: 256214 - DNA, 694 bp, Homo sapiens
actaaggatccctcccccagctccccacacagactccctagaacacaacctctttctccttatatccctctccttgccagcacttccagggtgtttacactaggggttggaaaacttcttctgtgacagtccagagaggaaatattgtaaactctgcagatcccacaatcacggtgataactcctcaaccctgctgttggggtggaacagcagccacagcaagaaatgcttggccatggctgtgttccagtacaatgttatttatagacactgaaatttgaattgcatgttactttctcatgtcataaaatagtattcttcctttggttctttttcaaccattaaaatgtgaaaatcattcttggctcctgagctgtacaaaaacagacagtgggctggatttggcccatgggccatagtttgctgactcctggtttatgtatctgagtagtgttggtctcttgcttagactgggagcttgagacaaaagccacatctaagcttccttacctttaaaccccgggcccacaccacagtgtcagaaaacataagaagtacaagaaataagtttaggccaggcacggtaatcccagcactttgggaggccgaggcggatggatcacaaggtcaggagatcgcgaccatcctggctaacatggtgaaaccccatctctactaaaaatacaaaaaatta

SEQ ID NO: 256215 - DNA, 762 bp, Homo sapiens
cgtggcagatgaatgtagatgccggttctggaggctcttctgggtagaccagaagcacccacctcctccgctcacaccctagggcacagccaccttcccctctgccctttcccctcccccaggctctgctgcactccactttccccagcacttccagggtgtttacactaggggttggaaaacttcttctgtgacagtccagagaggaaatattgtaaactctgcagatcccacaatcacggtgataactcctcaaccctgctgttggggtggaacagcagccacagcaagaaatgcttggccatggctgtgttccagtacaatgttatttatagacactgaaatttgaattgcatgttactttctcatgtcataaaatagtattcttcctttggttctttttcaaccattaaaatgtgaaaatcattcttggctcctgagctgtacaaaaacagacagtgggctggatttggcccatgggccatagtttgctgactcctggtttatgtatctgagtagtgttggtctcttgcttagactgggagcttgagacaaaagccacatctaagcttccttacctttaaaccccgggcccacaccacagtgtcagaaaacataagaagtacaagaaataagtttaggccaggcacggtaatcccagcactttgggaggccgaggcggatggatcacaaggtcaggagatcgcgaccatcctggctaacatggtgaaaccccatctctactaaaaatacaaaaaatta

SEQ ID NO: 256216 - DNA, 664 bp, Homo sapiens
ggagaaggggtagttaacctgcttaggtgaatcagggaacgcttcacagaggaagtgatgtttacgcagagtcttgaaggacagataacagcttgctaggagagaaggtgggcatgaggggagaaggaggaaggcatgttgtaggcacaggggctggctggtacacgcaaagtgtcaaaagcatggaagggcatgatgtctatgggaaactttagttcaatatggtctaagcaaaaagaaaggtagagaaattgaaagatgtggcttgtccagagtaaggcatatgcaagttataattcaggctccagaactcattagctatataggtgaccttgagtaagtcacttgatttcttgagtctcagtttcaacatctgtaaaatgaggtgggcaatacctgtgtcattgtgtggtgatgagtatctaagatgataacagccatcatagccaacactcactgtgagcttcctcggtgccagctcatacctcaagtgcccactgagcacatgggaagtgcttggtgaaagctgttatactgaggctgtgctgcaacatgtggacttcatttcttaagccgagatgatgagggaagttatctgatttgctgtttagaaggattacgcggaagcagatagttatcaatctatgtttcaatccattctgaa

SEQ ID NO: 256217 - DNA, 1680 bp, Homo sapiens
aggcgtgtggggcaggaccagtccttcagcggccgggttcgcgccgcggtcgccggctgcttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctagccagggccacgggggcccagcacgagagtcctcatgggcactcacagactgcgtgctttcatgtacttccagtgctggagcatggtatgaccagattttatcacagtgccatttgaagggaaaggagttcagacagacagacgtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcctcaagagcccctaattgtctcagggttcaaaggaagacactgacctttcccatcccggtagcttcagggaagatcatagttaataacgtctctcaacaaatgattacttctttgtttccttgtggcttcttgtctgtctgagtcaacgaatacacagacttactggattatagaagagaaaattcacatctgccttgttaatctaataaatataattacagccccttaaaaaaaaaaa

SEQ ID NO: 256218 - DNA, 1054 bp, Homo sapiens
aggcgtgtggggcaggaccagtccttcagcggccgggttcgcgccgcggtcgccggctgcttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaatcgaggggtggtgaattcgatccgggaatttcggaaggttgcacggatggattggagttacagttggggggacgaattcaagaggagagatcaaggctaacagggcggggctcagggggcggccggggggaattagggggtaatcaagaagcgtgaagggttcggtggtcgacttttctttgctcg

SEQ ID NO: 256219 - DNA, 1845 bp, Homo sapiens
aggcgtgtggggcaggaccagtccttcagcggccgggttcgcgccgcggtcgccggctgcttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagtatttcattttcttttaaaggtcaaatgtaacatttcacaatagatgtgatgcagaatttagctttgctagctgaagactgtagtatctcattatatttaatgatggctttgcctgagaagctgttttaagcagtctctcttctggtattttcttctgcaacaggagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctagccagggccacgggggcccagcacgagagtcctcatgggcactcacagactgcgtgctttcatgtacttccagtgctggagcatggtatgaccagattttatcacagtgccatttgaagggaaaggagttcagacagacagacgtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcctcaagagcccctaattgtctcagggttcaaaggaagacactgacctttcccatcccggtagcttcagggaagatcatagttaataacgtctctcaacaaatgattacttctttgtttccttgtggcttcttgtctgtctgagtcaacgaatacacagacttactggattatagaagagaaaattcacatctgccttgttaatctaataaatataattacagccccttaaaaaaaaaaa

SEQ ID NO: 256220 - DNA, 1581 bp, Homo sapiens
gggggccgcttgggtcccccccacccctggtccctggctgcttcccaccccgggctctctcctggcctcccacccccgcgcccggcttccaccatgacggtgatgtctggggagaacgtggacgaggcttcggccgccccgggccacccccaggatggcagctacccccggcaggccgaccacgacgaccacgagtgctgcgagcgcgtggtgatcaacatctccgggctgcgcttcgagacgcagctcaagaccctggcgcagttccccaacacgctgctgggcaaccctaagaaacgcatgcgctacttcgaccccctgaggaacgagtacttcttcgaccgcaaccggcccagcttcgacgccatcctctactactaccagtccggcggccgcctgcggaggccggtcaacgtgcccctggacatgttctccgaggagatcaagttttacgagttgggcgaggaggccatggagaagttccgggaggacgagggcttcatcaaggaggaggagcgccctctgcccgagaaggagtaccagcgccaggtgtggctgctcttcgagtaccccgagagctcggggcccgccagggtcatcgccatcgtctccgtcatggtcatcctcatctccatcgtcatcttttgcctggagacgctccccgagctgaaggatgacaaggacttcacgggcaccgtccaccgcatcgacaacaccacggtcatctacaattccaacatcttcacagaccccttcttcatcgtggaaacgctgtgtatcatctggttctccttcgagctggtggtgcgcttcttcgcctgccccagcaagacggacttcttcaaaaacatcatgaacttcatagacattgtggccatcattccttatttcatcaccctgggcaccgagatagctgagcaggaaggaaaccagaagggcgagcaggccacctccctggccatcctcagggtcatccgcttggtaagggtttttagaatcttcaagctctcccgccactctaagggcctccagatcctgggccagaccctcaaagctagtatgagagagctagggctgctcatctttttcctcttcatcggggtcatcctgttttctagtgcagtgtactttgccgaggcggaagaagctgagtcgcacttctccagtatccccgatgctttctggtgggcggtggtgtccatgaccactgtaggatacggtgacatgtaccctgtgacaattggaggcaagatcgtgggctccttgtgtgccatcgctggtgtgctaacaattgccctgcccgtacctgtcattgtgtccaatttcaactatttctaccaccgagaaactgagggggaagagcaggctcagttgctccacgtcagttcccctaacttagcctctgacagtgacctcagtcgccgcagttcctctactatgagcaagtatgagtacatggagatcgaagaggatatgaataatagcatagcccattatagacaggtcaatatcagaactgccaattgcaccacagctaaccaaaactgcgttaataagagcaagctactgaccgatgtttaa

SEQ ID NO: 256221 - DNA, 15789 bp, Homo sapiens
atggacagccagaacctggctggtgaggataaagattcacaaccggcagctgatggacctgcagcctctgaggacccaagtgccactgagtcagacctgcccaacccacatgtgggagaggtctctgtccttagttctgggagtcccaggcttcaggagactcctcaggactgcagtgggggtccggtgcggcgttgtgctctctgtaactgcggggagcccgctctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccacaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagctgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgcgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcgccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagactgagaaagtttcagaacctgaatgcccagccttggaacccagtgccaccagtcctctcccttccccaatgggggacctttcctgccccgcccccagccctgccccagccctggatgacttctctggcctaggggaagacacagcccctctggatgggattgatgctccgggttcacagccagagcctggacagacccctggcagtttggctagtgaacttaaaggctcccctgtgctcctggaccccgaggagctggcccctgtgacccctatggaggtctaccccgaatgcaagcagacagcagggcggggctcaccatgtgaagaacaggaagagccacgtgcaccggtggcccccacaccacccactctcatcaaatccgacatcgttaacgagatctctaatctgagccagggtgatgccagtgccagttttcctggctcagagcccctcctgggctctccagacccggaggggggtggctccctgtccatggagttgggggtctctacggatgttagtccagcccgagatgagggctccctacggctctgtactgactcactgccagagactgatgactcactattgtgcgatgctgggacagctatcagcggaggcaaagctgagggggagaaggggcggcggcgcagctccccagcccgttcccgcatcaaacagggtcgcagcagcagtttcccaggaagacgccggcctcgtggaggagcccatggagggcgtggtagaggacgggcccggctaaagtcaactgcttcttccattgagactctggtagttgctgacattgatagctctcccagtaaggaggaggaggaagaagatgatgacaccatgcagaataccgtggttctcttctccaacacagacaaatttgtcctaatgcaggacatgtgtgtggtatgtggcagctttggccggggggcagagggccacctccttgcctgttcgcagtgctctcagtgctatcacccttactgtgtcaacagcaagatcaccaaggtgatgctgctcaagggctggcgttgtgtggagtgtattgtgtgtgaggtgtgtggccaggcctccgacccctcacgcctgctgctctgtgatgactgtgatattagctaccacacatactgcctggaccccccactgctcaccgtccccaagggcggctggaagtgcaagtggtgtgtgtcctgtatgcagtgtggggctgcttcccctggcttccactgtgaatggcagaatagttacacacactgtgggccctgtgccagcctggtgacctgccctatctgtcatgctccttacgtagaagaggacctactaatccagtgccgccactgtgaacggtggatgcatgcaggctgtgagagcctcttcacagaggacgatgtggaccacgcacccgatgaaggctttgactgtgtctcctgccagccctacgtggtaaagcctgtggcgcctgttgcacctccagagctggtgcccatgaaggtgaaagagccagagccccagtactttcgcttcgaaggcgtgtggctgacagaaactggcatggccttgctgcgtaacctgaccatgtcaccactgcacaagcggcgccaacggcgaggacggcttggcctcccaggcgaggcaggattggagggttctgagccctcagatgcccttggccctgatgacaagaaggatggggacctggacaccgatgagctgctcaagggtgaaggtggtgtggagcacatggagtgcgaaattaaactggagggccccgtcagccctgatgtggagcctggcaaagaggagaccgaggaaagcaaaaaacgcaagcgtaaaccatatcggcctggcattggtggtttcatggtgcgacagcggaaatcccacacacgcacgaaaaaggggcctgctgcacaggcggaggtgttgagtggggatgggcagcccgacgaggtgatacctgctgacctgcctgcagagggcgccgtggagcagagcttagctgaaggggatgagaagaagaagcaacagcggcgagggcgcaagaggagcaaactggagggcatgttccctgcttacttgcaggaagccttctttgggaaggagctgctggacctgagccgtaaggccctttttgcagttggggtgggccggccaagctttggactagggaccccaaaagccaagggagatggaggctcagaaaggaaggaactccccacatcgcagaaaggagatgatggtccagatattgcagatgaagaatcccgtggcctcgagggcaaagccgatacaccaggacctgaggatgggggcgtgaaggcatccccagtgcccagtgaccctgagaagccaggcaccccaggtgaagggatgcttagctctgacttagacaggatttccacagaagaactgcccaagatggaatccaaggacctgcagcagctcttcaaggatgttctgggctctgaacgagaacagcatctgggttgtggaacccctggcctagaaggcagccgtacgccactgcagaggccctttcttcaaggtggactccctttgggcaatctgccctccagcagcccaatggactcctacccaggcctctgccagtccccgttcctggattctagggagcgcgggggcttctttagcccggaacccggtgagcccgacagcccctggacgggctcaggtggcaccacgccctccacccccacaacccccaccacggagggtgagggcgacggactctcctataaccagcggagtcttcagcgctgggagaaggatgaggagttgggccagctgtccaccatctcgcctgtgctctatgccaacattaattttcctaatctcaagcaagactacccagactggtcaagccgttgcaaacaaatcatgaagctctggagaaaggttccagcagctgacaaagccccctacctgcaaaaggccaaagataaccgggcagctcaccgcatcaacaaggtgcagaagcaggctgagagccagatcaacaagcagaccaaggtgggcgacatagcccgtaagactgaccgaccggccctacatctccgcattcccccgcagccaggggcactgggcagcccgccccccgctgctgcccccaccattttcattggcagccccactacccccgccggcttgtctacctctgcggacgggttcctgaagccgccggcgggctcggtgcctggccctgactcgcctggtgagctcttcctcaagctcccaccccaggtgcccgcccaagcgccttcgcaggacccctttggactggcccctgcctatcccctggagccccgcttccccacggcaccgcccacctatcccccctatcctagtcctacgggggcccctgcgcagcccccgatgctgggcgcctcatctcgtcctggggctggccagccaggggaattccacactaccccacctggcacccccagacaccagccctccacacctgacccgttcctcaaaccccgctgcccctcgctggataacttggctgtgcctgagagccctggggtagggggaggcaaagcttccgagcccctgctctcgcccccaccttttggggagtcccggaaggccctagaggtgaagaaggaagagcttggggcatcctctcctagctatgggcccccaaacctgggctttgttgactcaccctcctcaggcacccacctgggtggcctggagttaaagacacctgatgtcttcaaagcccccctgacccctcgggcatctcaggtagagccccagagcccgggcttgggcctaaggccccaggagccaccccctgcccaggctttggcaccttctcctccaagtcacccagacatctttcgccctggctcctacactgacccatatgctcagcccccattgactcctcggccccaacctccgccccctgagagctgctgtgctctgccccctcgctcactgccctccgaccctttctcccgagtgcctgtcagtcctcagtcccagtccagctcccagtctccactgacaccccggcctctgtctgctgaagctttttgcccatcacccgttacccctcgcttccagtcccctgacccttattctcgcccaccctcacgccctcagtcccgtgacccatttgccccattgcataagccaccccgaccccagccccctgaagttgcctttaaggctgggtctctagcccacacttcgctgggggctggggggttcccagcagccctgcccgcggggccagcaggtgagctccatgccaaggtcccaagtgggcagccccccaattttgtccggtcccctgggacgggtgcatttgtgggcaccccctctcccatgcgtttcactttccctcaggcagtaggggagccttccctaaagccccctgtccctcagcctggtctcccgccaccccatgggatcaacagccattttgggcccggccccaccttgggcaagcctcaaagcacaaactacacagtagccacagggaacttccacccatcgggcagccccctggggcccagcagcgggtccacaggggagagctatgggctgtccccactacgccctccgtcggttctgccaccacctgcacccgacggatccctcccctacctgtcccatggagcctcacagcgatcaggcatcacctctcctgtcgaaaagcgagaagacccagggactggaatgggtagctctttggcgacagctgaactcccaggtacccaggacccaggcatgtccggccttagccaaacagagctggagaagcaacggcagcgccagcggctacgagagctgctgattcggcagcagatccagcgcaacaccctgcggcaggagaaggaaacagctgcagcagctgcgggagcagtggggcctccaggcagctggggtgctgagcccagcagccctgcctttgagcagctgagtcgaggccagaccccctttgctgggacacaggacaagagcagccttgtggggttgcccccaagcaagctgagtggccccatcctggggccagggtccttccctagcgatgaccgactctcccggccacctccaccagccacgccttcctctatggatgtgaacagccggcaactggtaggaggctcccaagctttctatcagcgagcaccctatcctgggtccctgcccttacagcagcaacagcaacaactgtggcagcaacaacaggcaacagcagcaacctccatgcgatttgccatgtcagctcgctttccatcaactcctggacctgaacttggccgccaagccctaggttccccgttggcgggaatttccacccgtctgccaggccctggtgagccagtgcctggtccagctggtcctgcccagttcattgagctgcggcacaatgtacagaaaggactgggacctgggggcactccgtttcctggtcagggcccacctcagagaccccgtttttaccctgtaagtgaggacccccaccgactggctcctgaagggcttcggggcctggcggtatcaggtcttcccccacagaaaccctcagccccaccggcccctgaattgaacaacagtcttcatccaacaccccacaccaagggtcctaccctgccaactggtttggagctggtcaaccggcccccgtcgagcactgagcttggccgccccaatcctctggccctggaagctgggaagttgccctgtgaggatcccgagctggatgacgattttgatgcccacaaggccctagaggatgatgaagagcttgctcacctgggtctgggtgtggatgtggccaagggtgatgatgaacttggcaccttagaaaacctggagaccaatgacccccacttggatgacctgctcaatggagacgagtttgacctgctggcatatactgatcctgagctggacactggggacaagaaggatatcttcaatgagcacctgaggctggtagaatcggctaatgaggaggctgaacgggaggccctgctgcggggggtggagccaggacccttgggccctgaggagcgccctccccctgctgctgatgcctctgaaccccgcctggcatctgtgctccctgaggtgaagcccaaggtggaggagggtggacgccacccttctccttgccaattcaccattgctacccccaaggtagagcccgcacctgctgccaattcccttggcctggggctaaagccaggacagagcatgatgggcagccgggatacccggatgggcacagggccattttctagcagtgggcacacagctgagaaggcctcctttggggccacgggagggccaccagctcacctgctgacccccagcccactgagtggcccaggaggatcctccctgctggaaaagtttgagctcgagagtggggctttgaccttgcctggtggacctgcagcatctggggatgagctagacaagatggagagctcactggtagccagcgagttacccctgctcattgaggacctgttggagcatgagaagaaggagctgcagaagaagcagcagctttcagcacagttgcagcctgcccagcagcagcagcaacagcagcagcagcattccctactgcctgcaccaggccctgcccaggccatgtctttgccacatgagggctcttctcccagtttggctgggtcccaacagcagctttccctgggtcttgcagttgcccgacagccaggtttgccccagccactgatgcccacccagccaccagctcatgccctccagcaacgcctggctccatccatggctatggtgtccaatcaagggcatatgctaagtgggcagcatggagggcaggcaggcttggtaccccagcagagctcacagccagtgctatcacagaagcccatgggcaccatgccaccttccatgtgcatgaagccgcagcaattggcaatgcagcagcagctggcaaacagcttcttcccagatacagacctggacaaatttgctgcagaagatatcattggtcccattgcaaaggccaagatggtggctttgaaaggcatcaagaaagtgatggctcagggcagcattggggtggcacctggtatgaacagacagcaagtgtctctgctagcccagaggctctcggggggacctagcagtgatctgcagaaccatgtggcagctgggagtggccaggagcggagtgctggtgatccctcccagcctcgtcccaacccgcccacttttgctcagggagtgatcaatgaagctgaccagcggcagtatgaggagtggctgttccatacccagcagctcctacagatgcagctgaaggtgctagaggagcagattggtgtacaccgcaagtcccggaaggctctgtgtgccaagcagcgcactgccaaaaaagctggccgtgagttcccagaagctgatgctgagaagctcaagctggttacagagcagcagagcaagatccagaaacaactggatcaggtccggaaacagcagaaggagcacactaatctcatggcagaatatcggaacaagcagcagcaacaacagcagcagcagcagcaacaacagcaacagcactcagctgtgctggctctcagcccttcccagagtccccggctgctcaccaagctccctggtcagctgctccctggccatgggctgcagccaccacaggggcctccgggtgggcaagccggaggtcttcgcctgacccctgggggtatggcactacctggacagcctggtggccccttccttaatacagctctggcccaacagcagcaacagcaacattctggtggggctggatccctggctggcccttcagggggcttcttccctggcaaccttgctcttcgaagcctcggacctgattcaaggcttttacaggaaaggcagctgcagctgcagcagcaacgtatgcagctggcccagaaactgcagcagcagcagcagcagcaacagcagcagcagcaccttctaggacaggtggcaatccagcagcaacagcagcagggtcctggagtacagacaaaccaagctctgggtcccaagccccagggccttatgcctcccagcagccaccaaggcctcctggtccagcagctgtcccctcaaccaccccaggggccccagggcatgctgggccctgcccaggtggctgtgttgcagcagcagcaccctggagctttgggcccccagggccctcacagacaggtgcttatgacccagtcccgggtgctcagttccccccagctggcacagcagggtcagggccttatgggacacaggctggtcacagcccagcagcagcagcagcaacaacagcaccaacagcaagggtccatggcagggctgtcccatcttcagcaaagtctgatgtcacacagtgggcagcccaaactgagcgctcagcccatgggctctttacagcagcttcagcagcagcagcagctgcaacagcaacagcaacttcagcagcagcagcagcagcagctacaacagcaacagcaacttcagcagcaacagcttcaacagcagcaacagcagcagcagcttcaacaacagcagcagcaacagcttcaacagcagcaacagcagctacaacagcaacagcaacaacaacagcagcagtttcaacagcagcagcaacagcagcagatgggccttttaaaccagagtcgaactttactgtcccctcagcaacaacagcagcagcaagtggcacttggccctggcatgccagcaaagcctcttcaacacttttctagccctggagccctgggtccaaccctcctcctgacgggcaaggaacaaaacaccgtagacccagccgtttcttcagaggccactgaggggccctctacacatcagggagggccgttagcaataggaactacccctgagtcaatggccactgaaccaggagaggtaaagccctcactctctggggactcacaactcctgcttgtccaaccccagccccagcctcagcccagctctctgcagctgcagccacctctgaggcttccaggacaacagcagcagcaagttagcctgctccacacagcaggtggaggaagccatgggcagctaggcagtggatcatcttctgaggcctcatctgtgccccacctgctggctcagccctctgtttccttaggggatcagcctgggtccatgacccagaaccttctgggcccccaacagcccatgctagagcggcccatgcaaaataatacagggccacaacctcccaaaccaggacctgtcctccagtctgggcagggtctgcctggggttggaatcatgcctacggtgggtcagcttcgagcacagctccaaggagtcctggccaaaaacccacagctgcggcacttaagtcctcagcagcagcagcagctacaggcactcctcatgcagcggcagctgcagcagagtcaggcagtacgccagaccccaccctaccaggagcctgggacccagacctctcccctccagggcctcctgggctgccaacctcaacttgggggcttccctggaccacagacaggccccctccaggagctaggggcagggcctcgacctcagggcccaccccggctccctgccccaccaggagccttatctacaggaccagtccttggccctgtccatcccacacctccaccatccagccctcaagagccaaagagaccttcacaattaccttcccccagctcccagcttcccactgaggcccagctccctcccacccatccagggacccccaaacctcaggggccaaccttggagccgcctcctgggagggtctcacctgctgctgcccagcttgcagataccttgtttagcaagggtctgggaccttgggatcccccagacaacctagcagaaacccagaagccagagcagagcagcctggtacctgggcatctggaccaggtgaatggacaggtggtgcctgaggcatcccaactcagcatcaagcaggaacctcgggaagagccatgtgccctgggagcccagtcagtgaagagggaggccaatggggagccaataggggcaccaggaaccagcaaccacctcctgctggcaggccctcgctcagaagctgggcatctgctcttgcagaagctactccgggcaaagaatgtgcaactcagcactgggcaggggtccgaggggctgcgagctgagatcaacgggcacattgacagcaagctggctgggctggagcagaaactacagggtacccccagcaacaaggaggatgcagcagcaaggaagcctttgacaccgaagcccaagcgggtacagaaggcaagcgacaggttggtgagctcccgaaagaagctgcggaaggaggacggcgtcagggccagcgaggccttgctgaaacagctgaaacaggagctgtccctgctgcccctaacggagcctgctatcaccgccaattttagcctctttgccccctttggcagtggctgcccagtcaatgggcagagccagctgaggggggcctttggaagtggggcgctgcccactggccctgactactattcccagctgcttaccaagaataacctgagtaacccgccgacaccaccctcgtcgctgccccccaccccacccccatcggtgcagcagaagatggtgaatggcgtcaccccatctgaagagctgggggagcaccccaaggatgctgcctctgcccgggatagtgaaagggcactgagggatacttcagaggtgaagagtctagacctgctggctgccttgcctacaccccctcacaatcagactgaggatgtcaggatggagagtgatgaggatagcgattctcctgacagcattgtgccagcttcatcccctgagagcatcttgggggaggaggcccctcgtttccctcatctgggctcaggccggtgggagcaagaggaccgggccctctcccctgtcatccccctcattcctcgggacagcatcccagtcttcccagataccaaaccttatggggcccttggcctggaggtccctggaaagctgcctgtcacaacttgggaaaagggcaaaggaagtgaggtgtcagtcatgctcacagtctctgctgctgcagacaagaacctgaatggcgtgatggtggcagtggcggagctgctgagcatgaagatccccaactcctatgaggtgctgttcccagagagccccgcccggggaggcactgagccaaagaagggggaagctgagggtcctggtgggaaggaaaagggtctggaaggcaagagcccagacactggccctgattggctgaagcagtttgatgcagtgttggctggctataccctgaagaggcaactagacatcttgagcctcctgaaacaggagagccccgccccagagccacccactcagcacaggtatacctacaatgtctccaatctggatgtgcgacagctctcggccccacctcctgaagaaccctccccgcccccttcccccttggcaccttctcctgccagtccccctactgagcccttggttgaacttcccaccgaacccttggctgagccacccgtcccctcacctctgccactggcctcatcccctgaatcagcccgacccaagccccgtgcccggccccctgaagaaggtgaagatacccgtcctcctcgcctcaagaaatggaaaggagtgcgctggaagcggcttcggctgctgctgaccatccagaagggcagtggacggcaggaggatgagcgggaagtggcagagtttatggagcagcttggcacagccttgcgacctgacaaggtaccgcgagacatgcgtcgctgctgtttctgtcatgaggagggtgacggggccactgatgggcctgcccgtctgctgaacctggacctggacctgtgggtgcacctcaactgtgccctttggtccacggaggtgtatgagacccagggcggagcactgatgaatgtggaggttgccctgcaccgaggactgctaaccaagtgctccctgtgccagcgaactggtgccaccagcagctgcaatcgcatgcgttgccccaatgtctaccattttggttgtgccatccgcgccaagtgcatgttcttcaaggacaagaccatgctgtgtccaatgcataagatcaaggggccctgtgagcaagagctgagctcttttgctgtcttccggcgggtctacattgagcgggacgaggtgaagcaaatcgctagcatcattcagcggggagaacggctgcacatgttccgtgtgggggggcttgtgttccacgccatcggacagctgctgcctcaccagatggctgactttcatagtgccactgccctctatcccgtgggctacgaggccacgcgcatctattggagcctccgcaccaacaatcgtcgctgctgctatcgctgttctattggtgagaacaacgggcggccggagtttgtaatcaaagtcatcgagcagggcctggaggacctggtcttcactgacgcctctccccaggccgtgtggaatcgcatcattgagcctgtggctgccatgagaaaagaggctgacatgctgcgactcttccctgagtatctgaagggcgaggagctctttgggctgacggtgcatgccgtgcttcgcatagctgaatcactgcccggggtggagagctgtcaaaactatttattccgctatgggcgccacccccttatggagctgccactcatgatcaaccccactggctgtgcccgatcagagcctaaaatcctcacacactacaaacggccccataccctgaacagcaccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcagaatcgaggcatctacatgttccgaataaacaatgaacatgtgattgatgctacgttgaccggcggccctgccaggtacattaaccattcctgtgcccctaactgtgtggccgaagtcgtgacatttgacaaagaggacaaaatcatcatcatctccagccggcgaatccccaaaggagaggagctaacctatgactatcagtttgattttgaggacgatcagcacgagatcccctgccactgtggagcctggaattgtcggaaatggatgaactaa

SEQ ID NO: 256222 - DNA, 16614 bp, Homo sapiens
atggacagccagaacctggctggtgaggataaagattcacaaccggcagctgatggacctgcagcctctgaggacccaagtgccactgagtcagacctgcccaacccacatgtgggagaggtctctgtccttagttctgggagtcccaggcttcaggagactcctcaggactgcagtgggggtccggtgcggcgttgtgctctctgtaactgcggggagcccgctctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggagggtcctgctgggctcaccattggtgtgctgcatggtcggcaggcgtatgggggcaggagggcccacaactatgtggtgtggacaaggccatcttctcagggatctcacagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctggaggaggctcgctgtgcagtgtgtgaggggccaggggagctgtgtgacctgttcttctgtaccagctgtgggcatcactatcacggggcctgcctggacactgctctgactgcccgcaaacgtgctggctggcagtgccctgaatgcaaagtgtgccaagcctgcaggaaacctgggaatgactctaagatgttggtttgcgagacgtgtgacaaaggataccatactttctgcctaaaaccacccatggaggaactgcctgctcactcttggaagtgcaaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcgccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccagatccccttcctcctccactctcacccattatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagactgagaaagtttcagaacctgaatgcccagccttggaacccagtgccaccagtcctctcccttccccaatgggggacctttcctgccccgcccccagccctgccccagccctggatgacttctctggcctaggggaagacacagcccctctggatgggattgatgctccgggttcacagccagagcctggacagacccctggcagtttggctagtgaacttaaaggctcccctgtgctcctggaccccgaggagctggcccctgtgacccctatggaggtctaccccgaatgcaagcagacagcagggcggggctcaccatgtgaagaacaggaagagccacgtgcaccggtggcccccacaccacccactctcatcaaatccgacatcgttaacgagatctctaatctgagccagggtgatgccagtgccagttttcctggctcagagcccctcctgggctctccagacccggaggggggtggctccctgtccatggagttgggggtctctacggatgttagtccagcccgagatgagggctccctacggctctgtactgactcactgccagagactgatgactcactattgtgcgatgctgggacagctatcagcggaggcaaagctgagggggagaaggggcggcggcgcagctccccagcccgttcccgcatcaaacagggtcgcagcagcagtttcccaggaagacgccggcctcgtggaggagcccatggagggcgtggtagaggacgggcccggctaaagtcaactgcttcttccattgagactctggtagttgctgacattgatagctctcccagtaaggaggaggaggaagaagatgatgacaccatgcagaataccgtggttctcttctccaacacagacaaatttgtcctaatgcaggacatgtgtgtggtatgtggcagctttggccggggggcagagggccacctccttgcctgttcgcagtgctctcagtgctatcacccttactgtgtcaacagcaagatcaccaaggtgatgctgctcaagggctggcgttgtgtggagtgtattgtgtgtgaggtgtgtggccaggcctccgacccctcacgcctgctgctctgtgatgactgtgatattagctaccacacatactgcctggaccccccactgctcaccgtccccaagggcggctggaagtgcaagtggtgtgtgtcctgtatgcagtgtggggctgcttcccctggcttccactgtgaatggcagaatagttacacacactgtgggccctgtgccagcctggtgacctgccctatctgtcatgctccttacgtagaagaggacctactaatccagtgccgccactgtgaacggtggatgcatgcaggctgtgagagcctcttcacagaggacgatgtggaccacgcacccgatgaaggctttgactgtgtctcctgccagccctacgtggtaaagcctgtggcgcctgttgcacctccagagctggtgcccatgaaggtgaaagagccagagccccagtactttcgcttcgaaggcgtgtggctgacagaaactggcatggccttgctgcgtaacctgaccatgtcaccactgcacaagcggcgccaacggcgaggacggcttggcctcccaggcgaggcaggattggagggttctgagccctcagatgcccttggccctgatgacaagaaggatggggacctggacaccgatgagctgctcaagggtgaaggtggtgtggagcacatggagtgcgaaattaaactggagggccccgtcagccctgatgtggagcctggcaaagaggagaccgaggaaagcaaaaaacgcaagcgtaaaccatatcggcctggcattggtggtttcatggtgcgacagcggaaatcccacacacgcacgaaaaaggggcctgctgcacaggcggaggtgttgagtggggatgggcagcccgacgaggtgatacctgctgacctgcctgcagagggcgccgtggagcagagcttagctgaaggggatgagaagaagaagcaacagcggcgagggcgcaagaggagcaaactggagggcatgttccctgcttacttgcaggaagccttctttgggaaggagctgctggacctgagccgtaaggccctttttgcagttggggtgggccggccaagctttggactagggaccccaaaagccaagggagatggaggctcagaaaggaaggaactccccacatcgcagaaaggagatgatggtccagatattgcagatgaagaatcccgtggcctcgagggcaaagccgatacaccaggacctgaggatgggggcgtgaaggcatccccagtgcccagtgaccctgagaagccaggcaccccaggtgaagggatgcttagctctgacttagacaggatttccacagaagaactgcccaagatggaatccaaggacctgcagcagctcttcaaggatgttctgggctctgaacgagaacagcatctgggttgtggaacccctggcctagaaggcagccgtacgccactgcagaggccctttcttcaaggtggactccctttgggcaatctgccctccagcagcccaatggactcctacccaggcctctgccagtccccgttcctggattctagggagcgcgggggcttctttagcccggaacccggtgagcccgacagcccctggacgggctcaggtggcaccacgccctccacccccacaacccccaccacggagggtgagggcgacggactctcctataaccagcggagtcttcagcgctgggagaaggatgaggagttgggccagctgtccaccatctcgcctgtgctctatgccaacattaattttcctaatctcaagcaagactacccagactggtcaagccgttgcaaacaaatcatgaagctctggagaaaggttccagcagctgacaaagccccctacctgcaaaaggccaaagataaccgggcagctcaccgcatcaacaaggtgcagaagcaggctgagagccagatcaacaagcagaccaaggtgggcgacatagcccgtaagactgaccgaccggccctacatctccgcattcccccgcagccaggggcactgggcagcccgccccccgctgctgcccccaccattttcattggcagccccactacccccgccggcttgtctacctctgcggacgggttcctgaagccgccggcgggctcggtgcctggccctgactcgcctggtgagctcttcctcaagctcccaccccaggtgcccgcccaagcgccttcgcaggacccctttggactggcccctgcctatcccctggagccccgcttccccacggcaccgcccacctatcccccctatcctagtcctacgggggcccctgcgcagcccccgatgctgggcgcctcatctcgtcctggggctggccagccaggggaattccacactaccccacctggcacccccagacaccagccctccacacctgacccgttcctcaaaccccgctgcccctcgctggataacttggctgtgcctgagagccctggggtagggggaggcaaagcttccgagcccctgctctcgcccccaccttttggggagtcccggaaggccctagaggtgaagaaggaagagcttggggcatcctctcctagctatgggcccccaaacctgggctttgttgactcaccctcctcaggcacccacctgggtggcctggagttaaagacacctgatgtcttcaaagcccccctgacccctcgggcatctcaggtagagccccagagcccgggcttgggcctaaggccccaggagccaccccctgcccaggctttggcaccttctcctccaagtcacccagacatctttcgccctggctcctacactgacccatatgctcagcccccattgactcctcggccccaacctccgccccctgagagctgctgtgctctgccccctcgctcactgccctccgaccctttctcccgagtgcctgtcagtcctcagtcccagtccagctcccagtctccactgacaccccggcctctgtctgctgaagctttttgcccatcacccgttacccctcgcttccagtcccctgacccttattctcgcccaccctcacgccctcagtcccgtgacccatttgccccattgcataagccaccccgaccccagccccctgaagttgcctttaaggctgggtctctagcccacacttcgctgggggctggggggttcccagcagccctgcccgcggggccagcaggtgagctccatgccaaggtcccaagtgggcagccccccaattttgtccggtcccctgggacgggtgcatttgtgggcaccccctctcccatgcgtttcactttccctcaggcagtaggggagccttccctaaagccccctgtccctcagcctggtctcccgccaccccatgggatcaacagccattttgggcccggccccaccttgggcaagcctcaaagcacaaactacacagtagccacagggaacttccacccatcgggcagccccctggggcccagcagcgggtccacaggggagagctatgggctgtccccactacgccctccgtcggttctgccaccacctgcacccgacggatccctcccctacctgtcccatggagcctcacagcgatcaggcatcacctctcctgtcgaaaagcgagaagacccagggactggaatgggtagctctttggcgacagctgaactcccaggtacccaggacccaggcatgtccggccttagccaaacagagctggagaagcaacggcagcgccagcggctacgagagctgctgattcggcagcagatccagcgcaacaccctgcggcaggagaaggaaacagctgcagcagctgcgggagcagtggggcctccaggcagctggggtgctgagcccagcagccctgcctttgagcagctgagtcgaggccagaccccctttgctgggacacaggacaagagcagccttgtggggttgcccccaagcaagctgagtggccccatcctggggccagggtccttccctagcgatgaccgactctcccggccacctccaccagccacgccttcctctatggatgtgaacagccggcaactggtaggaggctcccaagctttctatcagcgagcaccctatcctgggtccctgcccttacagcagcaacagcaacaactgtggcagcaacaacaggcaacagcagcaacctccatgcgatttgccatgtcagctcgctttccatcaactcctggacctgaacttggccgccaagccctaggttccccgttggcgggaatttccacccgtctgccaggccctggtgagccagtgcctggtccagctggtcctgcccagttcattgagctgcggcacaatgtacagaaaggactgggacctgggggcactccgtttcctggtcagggcccacctcagagaccccgtttttaccctgtaagtgaggacccccaccgactggctcctgaagggcttcggggcctggcggtatcaggtcttcccccacagaaaccctcagccccaccggcccctgaattgaacaacagtcttcatccaacaccccacaccaagggtcctaccctgccaactggtttggagctggtcaaccggcccccgtcgagcactgagcttggccgccccaatcctctggccctggaagctgggaagttgccctgtgaggatcccgagctggatgacgattttgatgcccacaaggccctagaggatgatgaagagcttgctcacctgggtctgggtgtggatgtggccaagggtgatgatgaacttggcaccttagaaaacctggagaccaatgacccccacttggatgacctgctcaatggagacgagtttgacctgctggcatatactgatcctgagctggacactggggacaagaaggatatcttcaatgagcacctgaggctggtagaatcggctaatgaggaggctgaacgggaggccctgctgcggggggtggagccaggacccttgggccctgaggagcgccctccccctgctgctgatgcctctgaaccccgcctggcatctgtgctccctgaggtgaagcccaaggtggaggagggtggacgccacccttctccttgccaattcaccattgctacccccaaggtagagcccgcacctgctgccaattcccttggcctggggctaaagccaggacagagcatgatgggcagccgggatacccggatgggcacagggccattttctagcagtgggcacacagctgagaaggcctcctttggggccacgggagggccaccagctcacctgctgacccccagcccactgagtggcccaggaggatcctccctgctggaaaagtttgagctcgagagtggggctttgaccttgcctggtggacctgcagcatctggggatgagctagacaagatggagagctcactggtagccagcgagttacccctgctcattgaggacctgttggagcatgagaagaaggagctgcagaagaagcagcagctttcagcacagttgcagcctgcccagcagcagcagcaacagcagcagcagcattccctactgcctgcaccaggccctgcccaggccatgtctttgccacatgagggctcttctcccagtttggctgggtcccaacagcagctttccctgggtcttgcagttgcccgacagccaggtttgccccagccactgatgcccacccagccaccagctcatgccctccagcaacgcctggctccatccatggctatggtgtccaatcaagggcatatgctaagtgggcagcatggagggcaggcaggcttggtaccccagcagagctcacagccagtgctatcacagaagcccatgggcaccatgccaccttccatgtgcatgaagccgcagcaattggcaatgcagcagcagctggcaaacagcttcttcccagatacagacctggacaaatttgctgcagaagatatcattggtcccattgcaaaggccaagatggtggctttgaaaggcatcaagaaagtgatggctcagggcagcattggggtggcacctggtatgaacagacagcaagtgtctctgctagcccagaggctctcggggggacctagcagtgatctgcagaaccatgtggcagctgggagtggccaggagcggagtgctggtgatccctcccagcctcgtcccaacccgcccacttttgctcagggagtgatcaatgaagctgaccagcggcagtatgaggagtggctgttccatacccagcagctcctacagatgcagctgaaggtgctagaggagcagattggtgtacaccgcaagtcccggaaggctctgtgtgccaagcagcgcactgccaaaaaagctggccgtgagttcccagaagctgatgctgagaagctcaagctggttacagagcagcagagcaagatccagaaacaactggatcaggtccggaaacagcagaaggagcacactaatctcatggcagaatatcggaacaagcagcagcaacaacagcagcagcagcagcaacaacagcaacagcactcagctgtgctggctctcagcccttcccagagtccccggctgctcaccaagctccctggtcagctgctccctggccatgggctgcagccaccacaggggcctccgggtgggcaagccggaggtcttcgcctgacccctgggggtatggcactacctggacagcctggtggccccttccttaatacagctctggcccaacagcagcaacagcaacattctggtggggctggatccctggctggcccttcagggggcttcttccctggcaaccttgctcttcgaagcctcggacctgattcaaggcttttacaggaaaggcagctgcagctgcagcagcaacgtatgcagctggcccagaaactgcagcagcagcagcagcagcaacagcagcagcagcaccttctaggacaggtggcaatccagcagcaacagcagcagggtcctggagtacagacaaaccaagctctgggtcccaagccccagggccttatgcctcccagcagccaccaaggcctcctggtccagcagctgtcccctcaaccaccccaggggccccagggcatgctgggccctgcccaggtggctgtgttgcagcagcagcaccctggagctttgggcccccagggccctcacagacaggtgcttatgacccagtcccgggtgctcagttccccccagctggcacagcagggtcagggccttatgggacacaggctggtcacagcccagcagcagcagcagcaacaacagcaccaacagcaagggtccatggcagggctgtcccatcttcagcaaagtctgatgtcacacagtgggcagcccaaactgagcgctcagcccatgggctctttacagcagcttcagcagcagcagcagctgcaacagcaacagcaacttcagcagcagcagcagcagcagctacaacagcaacagcaacttcagcagcaacagcttcaacagcagcaacagcagcagcagcttcaacaacagcagcagcaacagcttcaacagcagcaacagcagctacaacagcaacagcaacaacaacagcagcagtttcaacagcagcagcaacagcagcagatgggccttttaaaccagagtcgaactttactgtcccctcagcaacaacagcagcagcaagtggcacttggccctggcatgccagcaaagcctcttcaacacttttctagccctggagccctgggtccaaccctcctcctgacgggcaaggaacaaaacaccgtagacccagccgtttcttcagaggccactgaggggccctctacacatcagggagggccgttagcaataggaactacccctgagtcaatggccactgaaccaggagaggtaaagccctcactctctggggactcacaactcctgcttgtccaaccccagccccagcctcagcccagctctctgcagctgcagccacctctgaggcttccaggacaacagcagcagcaagttagcctgctccacacagcaggtggaggaagccatgggcagctaggcagtggatcatcttctgaggcctcatctgtgccccacctgctggctcagccctctgtttccttaggggatcagcctgggtccatgacccagaaccttctgggcccccaacagcccatgctagagcggcccatgcaaaataatacagggccacaacctcccaaaccaggacctgtcctccagtctgggcagggtctgcctggggttggaatcatgcctacggtgggtcagcttcgagcacagctccaaggagtcctggccaaaaacccacagctgcggcacttaagtcctcagcagcagcagcagctacaggcactcctcatgcagcggcagctgcagcagagtcaggcagtacgccagaccccaccctaccaggagcctgggacccagacctctcccctccagggcctcctgggctgccaacctcaacttgggggcttccctggaccacagacaggccccctccaggagctaggggcagggcctcgacctcagggcccaccccggctccctgccccaccaggagccttatctacaggaccagtccttggccctgtccatcccacacctccaccatccagccctcaagagccaaagagaccttcacaattaccttcccccagctcccagcttcccactgaggcccagctccctcccacccatccagggacccccaaacctcaggggccaaccttggagccgcctcctgggagggtctcacctgctgctgcccagcttgcagataccttgtttagcaagggtctgggaccttgggatcccccagacaacctagcagaaacccagaagccagagcagagcagcctggtacctgggcatctggaccaggtgaatggacaggtggtgcctgaggcatcccaactcagcatcaagcaggaacctcgggaagagccatgtgccctgggagcccagtcagtgaagagggaggccaatggggagccaataggggcaccaggaaccagcaaccacctcctgctggcaggccctcgctcagaagctgggcatctgctcttgcagaagctactccgggcaaagaatgtgcaactcagcactgggcaggggtccgaggggctgcgagctgagatcaacgggcacattgacagcaagctggctgggctggagcagaaactacagggtacccccagcaacaaggaggatgcagcagcaaggaagcctttgacaccgaagcccaagcgggtacagaaggcaagcgacaggttggtgagctcccgaaagaagctgcggaaggaggacggcgtcagggccagcgaggccttgctgaaacagctgaaacaggagctgtccctgctgcccctaacggagcctgctatcaccgccaattttagcctctttgccccctttggcagtggctgcccagtcaatgggcagagccagctgaggggggcctttggaagtggggcgctgcccactggccctgactactattcccagctgcttaccaagaataacctgagtaacccgccgacaccaccctcgtcgctgccccccaccccacccccatcggtgcagcagaagatggtgaatggcgtcaccccatctgaagagctgggggagcaccccaaggatgctgcctctgcccgggatagtgaaagggcactgagggatacttcagaggtgaagagtctagacctgctggctgccttgcctacaccccctcacaatcagactgaggatgtcaggatggagagtgatgaggatagcgattctcctgacagcattgtgccagcttcatcccctgagagcatcttgggggaggaggcccctcgtttccctcatctgggctcaggccggtgggagcaagaggaccgggccctctcccctgtcatccccctcattcctcgggacagcatcccagtcttcccagataccaaaccttatggggcccttggcctggaggtccctggaaagctgcctgtcacaacttgggaaaagggcaaaggaagtgaggtgtcagtcatgctcacagtctctgctgctgcagacaagaacctgaatggcgtgatggtggcagtggcggagctgctgagcatgaagatccccaactcctatgaggtgctgttcccagagagccccgcccggggaggcactgagccaaagaagggggaagctgagggtcctggtgggaaggaaaagggtctggaaggcaagagcccagacactggccctgattggctgaagcagtttgatgcagtgttggctggctataccctgaagaggcaactagacatcttgagcctcctgaaacaggagagccccgccccagagccacccactcagcacaggtatacctacaatgtctccaatctggatgtgcgacagctctcggccccacctcctgaagaaccctccccgcccccttcccccttggcaccttctcctgccagtccccctactgagcccttggttgaacttcccaccgaacccttggctgagccacccgtcccctcacctctgccactggcctcatcccctgaatcagcccgacccaagccccgtgcccggccccctgaagaaggtgaagatacccgtcctcctcgcctcaagaaatggaaaggagtgcgctggaagcggcttcggctgctgctgaccatccagaagggcagtggacggcaggaggatgagcgggaagtggcagagtttatggagcagcttggcacagccttgcgacctgacaaggtaccgcgagacatgcgtcgctgctgtttctgtcatgaggagggtgacggggccactgatgggcctgcccgtctgctgaacctggacctggacctgtgggtgcacctcaactgtgccctttggtccacggaggtgtatgagacccagggcggagcactgatgaatgtggaggttgccctgcaccgaggactgctaaccaagtgctccctgtgccagcgaactggtgccaccagcagctgcaatcgcatgcgttgccccaatgtctaccattttggttgtgccatccgcgccaagtgcatgttcttcaaggacaagaccatgctgtgtccaatgcataagatcaaggggccctgtgagcaagagctgagctcttttgctgtcttccggcgggtctacattgagcgggacgaggtgaagcaaatcgctagcatcattcagcggggagaacggctgcacatgttccgtgtgggggggcttgtgttccacgccatcggacagctgctgcctcaccagatggctgactttcatagtgccactgccctctatcccgtgggctacgaggccacgcgcatctattggagcctccgcaccaacaatcgtcgctgctgctatcgctgttctattggtgagaacaacgggcggccggagtttgtaatcaaagtcatcgagcagggcctggaggacctggtcttcactgacgcctctccccaggccgtgtggaatcgcatcattgagcctgtggctgccatgagaaaagaggctgacatgctgcgactcttccctgagtatctgaagggcgaggagctctttgggctgacggtgcatgccgtgcttcgcatagctgaatcactgcccggggtggagagctgtcaaaactatttattccgctatgggcgccacccccttatggagctgccactcatgatcaaccccactggctgtgcccgatcagagcctaaaatcctcacacactacaaacggccccataccctgaacagcaccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcagaatcgaggcatctacatgttccgaataaacaatgaacatgtgattgatgctacgttgaccggcggccctgccaggtacattaaccattcctgtgcccctaactgtgtggccgaagtcgtgacatttgacaaagaggacaaaatcatcatcatctccagccggcgaatccccaaaggagaggagctaacctatgactatcagtttgattttgaggacgatcagcacgagatcccctgccactgtggagcctggaattgtcggaaatggatgaactaa

SEQ ID NO: 256223 - DNA, 379 bp, Homo sapiens
acagaagcttctttcttatttcatatagcagcatggggtggatgaataagtgtccatggacgctctctatgtagtcattcaagaacccaggtgggttggggctcttccatcttcaacagctgggttcctgaatgattgcatggaggagacaaccatggacgcttgttcatcagttcatcactagtagtcatcagtcaagaaatctaagaataagaatgccatggaggcagggttatcagataaaatgtagaacaacaatgctatatgtagaacatactagcactaaaatattattctgtatttacctgaaatttaaatttaactagattttccatattctgtttgctaaatatggcagcactacatgtaactatgtaag

SEQ ID NO: 256224 - DNA, 219 bp, Homo sapiens
cattatgtactatttacaattgattatatggcacattatacctttttatggtccctgacatgtcactactgatttaaaactaagaaaacttagagtgttgctttgaaccaggttgttacaaaatagctgctttatcacttatggaaaaaacattctgtccaactaacaaagcagagggatcttcaggaaaaagcacttatttttaggtttgacctgctg

SEQ ID NO: 256225 - DNA, 565 bp, Homo sapiens
agcctgtcttggcttattggactaaatgagaggctaagaagggaatgctgtcctatgtcagggcgttataggtaagtcatgaaattttctctaatgagatttacaaagggtggtctttaacaccagaaggtatagctactagttataaccagtattcaaaatgagctgggcttgaacctagtgaaagtgtcatagtttcatcaaagacctgtatgaccagaatagaaaattatacctatagggctaccagatgtccatagaaaggtaaatagaactttggttggacagggttaggatttaaaatcacactggtacactgtagaagtagaataaaggagagtgaagtctggtaaagacgatgctagacaagattatagtactaaacatagaaaacaattttgtacagtgatcagataggaaataatggctagtatacattccagcagaaaacataatttgtggacttgttaaattattttctgttctgttgttccatcatttcataattcagcctcctgtctgtcaattcttctttcagtggaaataaagccagtggagaaaccaa

SEQ ID NO: 256226 - DNA, 468 bp, Homo sapiens
agcacaaggctagacaaatagaccagtgggacagagcgtccagaaataaacccaaatgtatagaactatctagttgatgaaaatgatgtcattgcaatgtagtaaggaaatgatcgtcttttcaataagtggtatggaagcagttggatatccatattaaaggagaacatagaatattggtcccatcatgccatgcacacaaatcaattccagatgatcctagacctaaaaataaaaggtgaaagaaagcttctagaagatagcatatcttcctgtccttggtaggcaaagacagggtacaaaaaacaggatacaaaaaagcactgaccctaaagaaagactgacaaattgggctgcattaataggtttgcatcaaaatacaccgttaagagagaagggcaacccacagagtttgcaatacatctatctgagaaattataatgaggctataaataactcctatgtagc

SEQ ID NO: 256227 - DNA, 444 bp, Homo sapiens
cctaaaataagtcttctaagtaagtcattcacaataaacacttttactatcaatatgtgattttagacagttgcctttagtctcagtaatgtgatgatatttctaattcatacttgggagttacctaataaaaatcagtgaaaaggaggacagcttgtcatcattctggtgtttactctcttgtagcatgcacttctcatcatgtgtttaagccccagtgtagcaatgcagaatggggattgtattaagatgttcacactactattcagcaatacccataggttaaccaagcataaatttctatagtatgtaggtgtcaatgtacctaaaataataaatacacatattatgtaaatttaaatgagttattattttaatatatggagcatacatttaatatattttcaaaacttaaagtttttgttggaaaacttcacaaaatga

SEQ ID NO: 256228 - DNA, 501 bp, Homo sapiens
tgttcaataaaaatcattactttcactttaccacatattcacattttgaatatcctaacaagtccccaaacatccccatttctaaatccccttttacggaagtttagaacggggaaagtcacaaagccctaaggccttaagctgacttgagactttccgggtggtaggaggcttctgctttgttctctgtgttcgctaacgccttggggcagcagtgccaagtgagctgggaaggtgagtggtgtctttgttttgtagaacggaagaaatagtgtggatgccacggttttgcttttgttagagggctgtatgaaagctcagaattaccttaaattccaaattaattaggtcatcctgtaaaattacccttgctgaggcaccccttagaaggtttcaaggtggccctagggttagacatatcccacatgaagacctctggtccagtgttgaaaatttctgttatttttgtatgttaataaaatgttttcatcagtaaaaaag

SEQ ID NO: 256229 - DNA, 413 bp, Homo sapiens
attctggagtgtgttaatgtggtaatatacgtggaaggaccagcagggtgggtcactgcttccctgggtctgactcttagctgttagaataaaaaacaacatttttggcagggcctggtagctcatacctgtaatcctagcactttgggaggccaaggcaggcagatcacctgaggttcggagttcaggaccagcctggccaacatggtgaaaccccatctctactaaaaatacaaaaatcagctgggtatggtggtgagcgcctctaatcctagctacttgggaggcttaggcaggagaatcacttgaacgcaggagaatcacttgaacccaggaggcagaggttgcagtgagccgagatcatgccactgcactccagcctgggcaacagagcaagactccatctcaaaaaa

SEQ ID NO: 256230 - DNA, 441 bp, Homo sapiens
gcatgggaagaatgctctgggagaacagatgagactgaaggatgggaaggagcagaaacaaaggacaggtggcgaataaggaaggaagagatctgccatttgtgactcttcttaaggtcacagcaagaagccagtggggtcatggacagctaccatgggacagctactccccagcagctctgcctccttttctgcctcaaggaagcagggagaaatgtccagagcacggaaatagctcttcccagccaagcaccactccccagcaagcgtccccacctggtttgctttcatggctggcatttgacacagcctgatttatagaaactgagaaagtgaccgttctcaaattccctcttaacttgggatgcctcaaattcaattaaaaggagatgaacacagagtgggaagaacttggagaaataataaattcatatgaatgag

SEQ ID NO: 256231 - DNA, 284 bp, Homo sapiens
tagattaaagaaaacaaatataggtcagtatttgaaaaataaagctcacaacagttctttatgaccagaatcaaagtgtgtgtcctgttaaccaagatttgtctctcagaagtttgatgatctgttaaaaaatatatatattatcagtgtcaagtattttagtcccacctgtcactaatttaatgacggcattgcctaggaatttcatgagcaacaaaactgttgatttagcctcataattttggaacatattaaaaatattttcttgctatcaacacttagat

SEQ ID NO: 256232 - DNA, 436 bp, Homo sapiens
accaaacactggcaatgcggagaaaatggatcactcagacactgctggcaggcatgtacaatggcaggaccactctagaacaaagtatggcagcttcttacaaagtcaatgtgcccttatcatatgactgggagcaccactaggcaataaaaatgaattaactattgattcatgcaacaacttggctggatatcgggaattacgctaagtgaaaaacaccaatcccagattatatactggctggttccatttaggtaatactgggggcttttcatttttgttttctttttgttttgagacagcattgctttgtcacccagggtggagtgcagtggtgctgttatagtaggtagctggtcaggtctgagcagggcaggagagagcccctcacaaccccaaaccaggaatgttaggcaaccaccaggtgatggtcaag

SEQ ID NO: 256233 - DNA, 335 bp, Homo sapiens
ccttgttgctcacacttagcctgttcagggtgtctcttcaattagacgcatgcataacaccaactactcagggggttgaggtgggaggatcgcttgagcacaggagtcaaggctacagtgaacagtaatcctgccactgcactctggcctgggcgaccgagtgagattgtgtcccaaaaattaaaaaagaaagaaagagaaagaagagagagaaagaagagaaaaagaaaaagaaaagaagagaaagaacaaacgaatgaaaagaaagagaaagaaggaaagaaagaaagaaaaagaaagaagaaagagaaagaaagaaaaaggagaaaagaaag

SEQ ID NO: 256234 - DNA, 541 bp, Homo sapiens
tgagctgctgttcatgattcaggttggcatcaatcaaattggaagcacatgaattatacattattgtttctgagccacagttttttgtttttatctgctaaagacatgaagaatgggaacactaccattgcatctcccagccccagagaaggatgttcactcccatgttctcaccttttcttcatctttatttgatggctataactttgtcattcatattttttaaaaatcgtgggtggatgttttggatttttttaagatatacagtaaataccaacttcttaaattttccctcgctgcttccagaggaggctggtatattttttctctgttcaacaacgagagaagtatcaagttttaggctcccttcaaatcaagacagttcgtgtgtatctttgtggttcataatctgaaaacaaagcagattctgtgtgactgagatgggatcctaggggctggaaaccatcactgtttgcctgtactgtccttctcctgtcgtaccatacccttttcttttaataaagacttatgtgagtataaa

SEQ ID NO: 256235 - DNA, 375 bp, Homo sapiens
taaacagatcacattcctgcctgccaaggccacagcactgagatagtcccatccttctctcccaaccccttttcagggacctcagcacatttcataaaggtcccaatgatttccctgttgtatgctacactttactttcccttaggagtagtactccctgagggctagatccctgggaaccctgcagttatcttgggtccagctagcactgtactgctgctgctgtctgagtaggtgctgaggaatacctgcaagaactcccaagatgtggagcacaagagctgaggttcccagggaaagatacagtcccccagtggctgtgccctgacaatggcaacacaccacagtcacttgagtgtcaggggaaggcaagtg

SEQ ID NO: 256236 - DNA, 196 bp, Homo sapiens
gctttgactttttcagctaggaaatacattaaattttcttttatccagcattgccagaaaatgtagtcctctagttattttaatattcaggttaagagatggagctagcatatgtcacagatagatttcaagaaatgtatattgtatattgcatacatatgatttcgagaaattataatacaataaaatacactaa

SEQ ID NO: 256237 - DNA, 478 bp, Homo sapiens
catcacagattatagttctcagctaaaatttaagtaaaatgtaagaattagaaaacctctttctaataacctccactgttgtcatctctcttccaccctgatgaagctcaccaaattcaagtaaaacagtaacgtttaaaggttgagacattacaaacaacccatgagttagtttagaagtagttaaaagcaaactttgttttttaactagtagaaaaaaaattcctgattacatgattattcattttatggatgatattttactagcagccccaacggagccaatacctttaaatttgtttacctctgtcataaggaatacacaactgaaaagtttagtcactgcacctgaaaaagtacccatgttccctccttgaaaatatcttggatatctgttaatctcctggtcagtaagacctcaaaagtttaacctaagtactaacaacttacacacattaaatgattagcagaaattatt

SEQ ID NO: 256238 - DNA, 413 bp, Homo sapiens
agtgatcagtttacaggaaataaatgaaagaaggaccgacaaatgtcgccacaaagatatcgtcaccacatccaaattgtgggagattttatatgacaaatgacccatgtttttcctcaggaataaatagcataggggccaaaagggaaagggcattgctacagaggatcagacactcagctgccatttccagaaaatgcactgggtggactaaacttggatcctgatccaagcaaatcaacagcaaaggcacatttttgagataaccggggaaaactgaagacagacccggcgttaatagatgtgaatgcataaatatggatcttgctgaatgggataatgatattgccatcaggccaaagtagtaaagagcccttatcgtcgacgcggccgcgaatttagtagtagtaggc

SEQ ID NO: 256239 - DNA, 375 bp, Homo sapiens
tacatgcccactttattcttctaaaatttaccagtcagattagtcactccacccctcatgaagtagagtggggaaagtgatagaaagaggccgaggacgctacggtcattgagcttccgtcacatggaaggaaacatcgagaggagagaagagatattctccccaacagttggcaattctatcacaatgacagcaatgatagactcagaccaaaaagataaatagagtaaaaaattttatacttaataaacacattggcagtttaaaaatcttaacatgttaagtaagcatcagttttaaaaaagaaagattattgtgctggtatttggcaggcattacctgattgatgaaagcctgtaaatacaaatatcctgt

SEQ ID NO: 256240 - DNA, 826 bp, Homo sapiens
cattgaaatgaaggatcaagtgactgggtgtctgtgtaaaactcaaaaacagatgagagagtataattgagaaagctagagagttgggagatggtggtcaaagtggggtgaccgagtattatgttagggatagttgtctaatgtgatgggaaaaaatttcatggtttggtcatggaagttgtgtggctgagttttgaatagtactgaagattatggagatgataggtccaggatttgggaaggtgctgaataagtcatatacctagacagtgaagttgtccaaaatgatgacaagacttggagttgaaggaagaaaacaaacttccctgacacttttaaaattatgccaatagatagtacagaggagggtagcgagagaatagtgtcttactaggtgtatgcctctgcttgaccgatacagcagatgaattcacaaatgggaggtaaagcagatgttcagactacacatgcttcatctttacctcaaatatttcagaatatccatttcttcccctttcccccaaagaattctcgctgtactgagttactgtcactgtgtttgttagaatgggaacagaaaaaagaatacaaaccttaaggtagtttatgatgaaaaagtggaggcatctttacaggagaggtagtagaaagaaatcattaagaactacatcagccaccctgaggtatggaagatgttggaagaaatacagcatctattgttgagaggacaatacagttaaagatagatgtagaaacacaaagagaagagatggaggatataaggaagcattcttaatttaatgggggtttcagaaaacaagtagaa

SEQ ID NO: 256241 - DNA, 687 bp, Homo sapiens
gtccccggaaaaaaaagcagttgctgtgttttctactctgcttgttaacttagacactttttagcagattcatttgtaggagttggtgttcatttgctttatgacaattaaaaagattaattttgttcattgagtagtttatttgaaactgtagaatcattcttggaactacagaatagggaattattgattagttggagtttctgaagatgaaatttgagtttcgtaaggtagtctcaaaggacacttttgctttattgtccagaaaccaggagaggcaaacttgtttccaaagtagggcaagaggttttatttcaagttcagtcatcaggattattctctggaggttgtcagtacttttttacaaaccctagtcactttaaccctagggaataggtttctcttgttcaggctgtcttctttcttggatgaagagctctaccatcgtcactatattttagctcatttgtggaacgaaggactatcaaaatgtttcctgaaaataagtccagggagggccttaagagctttatgctttattgaatcgtctttcatttgacattttctttgctgtattttacttaacataggctatgattagattgataaaaagctaaaaaaaaatacaccaacatttttaacttgtggaatttcacagccgatttattacaacctattttatatgcg

SEQ ID NO: 256242 - DNA, 990 bp, Homo sapiens
tttataggtcctttgaaggaaaattctgtgggcaaataagattgtgatacatggtatttcagttttcccaaatgtggccagcccgatctggtcaaaaattttattttttaaaagctatagtgtctttttttcttaaatttgaggcaacatgcacaaaattggagatttgaaattaaagccaagatttgtagtttctctggaaagacctggcaagattggactggattgctatgtgaccagggtcccactagatggggctgcatcctctaatccccaaatccttatgttccctgcatgctcacctttgttacctgcctgacacctgtggggcttttaactttatggcaactgccctattctctggatccttcctgaggatttatgatgcgtaatactccaggaatctggttagctttgcttaacacatttccaaaacttgtttgaatgcatgagtacagtcactagtagcattctgtgcagtacaatgtatgggggcttaggagtttagggtagtatacaggattagggataggacttgagtctaatcctaactcttagcagttacactggatgacattagagcaaatggttctttacgtctacattttcttcatctgtagatgtaataatttccatatcaactatgatgtacagtgctaattccaatgaaatgttacatgtgagaagtctttgaaatgtaaaaaacactacagatactgaagcagtttggagaattaaaaaacactacgaaaacacagcttggtaaataattttttttttcttttgagacagagtctggctctgtcatccaggctagagtgtagtggcagaatcttggctcactgcactccaggctgggtgacagagagagactccatctcaagaaaaaaaaagcgagacagggtcttgctctgtcatccaagctggagtgcagtgatgtgatcatggctgactgcagcatcaaatttctgggcactcattatgaggggt

SEQ ID NO: 256243 - DNA, 759 bp, Homo sapiens
tttataggtcctttgaaggaaaattctgtgggcaaataagattgtgatacatggtatttcagttttcccaaatgtggccagcccgatctggtcaaaaattttattttttaaaagctatagtgtctttttttcttaaatttgaggcaacatgcacaaaattggagatttgaaattaaagccaagatttgtagtttctctggaaagacctggcaagattggactggattgctatgtgaccagggtcccactagatggggctgcatcctctaatccccaaatccttatgttccctgcatgctcacctttgttacctgcctgacacctgtggggcttttaactttatggcaactgccctattctctggatccttcctgaggatttatgatgcgtaatactccaggaatctggttagctttgcttaacacatttccaaaacttgtttgaatgcatgagtacagtcactagtagcattctgtgcagtacaatgtatgggggcttaggagtttagggtagtatacaggattagggataggacttgagtctaatcctaactcttagcagttacactggatgacattagagcaaatggttctttacgtctacattttcttcatctgtagatgtaataatttccatatcaactatgatgtacagtgctaattccaatgaaatgttacatgtgagaagtctttgaaatgtaaaaaacactacagatactgaagcagtttggaggttcggcgtgtgcagggtaccgagctc

SEQ ID NO: 256244 - DNA, 435 bp, Homo sapiens
ttttaatgtaagtttaagagataataaagcattgtcccctaactgtaacatttttaccaaaaatgtcaaggaaaggaagaagttcaatagaattcacagaaataatacttatctaaagcaactgcctttgaaacttaaaacagcaaacaagaaaacagaaaagtcagatgtctccttccagtgtctccccttttcatgtattgatactcaatagtttcttgcattctcaacaacagagaattgaacacagttttgtttgttaagtttgctgcatttttgagtgtagtttccattatcattttgaataaaacatctttccttaagcaaaaatgtttctgaaattattatgcaaatcaataggaaaatacaattttcttagagaaattctgtttttcacatttttcaggtttaaaaagcctaggctttaaagtggat

SEQ ID NO: 256245 - DNA, 400 bp, Homo sapiens
atctgtgatacatcatatccacaatctccctgatgcatgactttcctctatttctgaaaatagaatgaaacaatagcaatagtaaaacatgtgtagttctttatttcctaaatggagacactttaaagttcccaaacccgaattttccacaatctgaatttaatttgtatttcaaaagttatcttgcaaagcatccattaataaatctttggtcactaaatatctgcagcatgttttatgacatgcaccagagcagggtgcccaacctccaggccatggatgtgaaccagcctgtggcctgctgggaaccaggccacacagcaagaggtgaggagtgggcaagggagcattaccacctgagctccacctcgtgtcagatcagcgatggaattagaatctt

SEQ ID NO: 256246 - DNA, 135 bp, Homo sapiens
ctctggcccccatcactcacccaaattaataaccctttttgtgtactcactaagccattaaaaatgttcttgttggccaggcgcagtggcttacgcctataatcccagcactttgggaggccaaggcgggcagat

SEQ ID NO: 256247 - DNA, 514 bp, Homo sapiens
tgacagagtctggctctgtcacccaggctggatttcggtggcacgatctcggctcactgcaagctccgcctcccgggttcacgccattctcctgcctcagcctctacgagtggctgggactacaggcgcccgccactacgccccgctaattttttgtatttttggtagagaggggtttcatcgtggtctagatcgcctgacctcgtgatccacccacctcggcctcccaaagtgctgggattacaagcgttagccaccgcacctggcctctggacagtgtttttcacaggtcagattaatttttatataaatcatttattttatttttattatgtaaaattttataatttttaattttatttttaatttcctttttaaaagttaaataaaattttaagtgtaatgatgcaaaattttgtttaaaagtaaatgtatataaaaatgttgatatagactaaaaaattgaataagtaagaaggtagttagttgtcacagtaggagtgaagtgaaaagc

SEQ ID NO: 256248 - DNA, 402 bp, Homo sapiens
gtcttcagtgattttactgactcttctgtcacctctaatctgctattaaacctatcaagtgaattcttcatttcaattatttaacttttcagttatagaatttctttttggttctttttgtatagtgttatctgctgacatttcctatcagttcactcattaaggccgccttttaagcctttgaacatatttataatagattctttaaagtctttcctaaatgtaatatctgtaccatatcaggttctgtttcttttcttttttcagagacagggtctcactctgtcaccaggctgaaaagtgcagtggcacagtcatagctcctgcagcctccaactcctgggctcaagtgatcctcccacctcagcctcttgagtagctaggacccacaggcatgtacca

SEQ ID NO: 256249 - DNA, 5979 bp, Homo sapiens
ccgcggagggagcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcggcggggccaggcggcccgagccgtgcagtcggaggtccttgtgcatgaagacagatttgttctatggcctcggagttgggtgccagggatgatggaggctgcactgagctggcaaagcccctctatcttcagtacttggagagggccctccggttggaccattttctgcgacaaacgtcagctatcttcaataggaatatttctagtgatgacagtgaagatggactggatgacagtaatccattattgccccagtctggggatcccttaatacaagttaaggaagaacctccaaattcattgcttggtgaaacttctggagcaggcagttctggaatgttaaacacatattctctgaatggagttctacagtcagaatcaaaatgtgataaggggaatttatataatttctctaagctgaagaaaagcagaaagtggctaaagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggagttgcagcaatatcagtactacagtgcaggcctgctctccacatatgaccctttctatgagcaacaacggcacctacttggacccaagaaaaagaaatttaaggaggaaaagaaacttaaagctaagttgaaaaaagtgaagaaaaaaagacgaagagatgaagaactttcctctgaagaatcccctcgtcgccatcaccaccagaccaaagtctttgccaagttttctcacgatgcacctccccctggcactaagaaaaagcacttatccattgagcagctgaatgctcgtcgcaggaaagtatggctcagcattgtgaaaaaggaactaccaaaggcaaataagcagaaagcttcagctcgtaacctgtttctcaccaatagccgaaagcttgctcaccagtgcatgaaggaggtgcgtcgagctgccttgcaggcccagaagaactgtaaggaaaccttgcctcgtgcccgccgcctcaccaaggagatgcttctgtactggaagaaatatgagaaagtagagaaggagcaccgcaagagagcagagaaggaagctttggagcagcggaagttggatgaggaaatgcgggaggccaagaggcaacagcgaaaactcaacttcttaattacccagacagagttgtatgcccatttcatgagtcgcaaacgagatatgggtcatgatggtatccaggaagaaatcctaaggaaactggaagacagttctacccagagacaaatcgatataggtggaggagtggtagttaacatcacacaggaggattatgatagtaaccattttaaagcccaggccctgaagaatgctgaaaatgcttaccatattcaccaagctcggacaaggtcatttgatgaagatgcaaaagaaagtcgagcagctgccctacgggcagcaaacaagtctggcactgggtttggggagagttatagcctggctaacccatctatccgggctggtgaggatattccacagcccacaatttttaatggcaaattgaaaggttatcaactgaaaggcatgaattggttggccaatctatatgaacagggtattaatggcattcttgctgatgaaatgggccttggtaaaacagtacagagcattgcccttctggcccatctggctgagagagagaacatttggggacctttcttaataatttcacctgcgtctacacttaacaattggcaccaggagtttactagatttgttcctaaatttaaggtgctaccatattggggaaatcctcatgatagaaaagtcatcagaaggttctggagtcagaagaccctctacactcaggatgcccccttccatgtggttattaccagctatcagctggtggtgcaggatgtaaagtatttccagcgggtcaagtggcaatacatggtactggatgaggctcaggcgctcaagagtagttccagtgttcgttggaagatcctcttacagttccagtgtcggaatcggcttttgctaaccgggaccccaattcagaacaccatggcagagctttgggctctgctgcatttcattatgccaacattatttgattcacatgaggaatttaatgaatggttttccaaggacattgagagccatgccgaaaacaaatctgctattgatgagaatcaactttctcgcttacacatgattttgaagccatttatgctgaggagaatcaagaaagatgtggaaaatgaattatctgacaagattgagattctaatgtattgccaactgaccagccgacagaagctgctatatcaggcactaaagaacaaaatttccattgaggatttattgcagtcttctatgggctctacccaacaagcacagaacaccaccagcagcctcatgaatctggtcatgcagtttaggaaggtgtgtaatcacccggagttatttgaacggcaagaaacttggtctccatttcatatttccctaaagccataccacatttcaaagtttatctaccgtcatggacagatcagggtcttcaatcattcacgagacaggtggttaagggttctttctccatttgcaccagactatatccaacggtctctctttcacagaaaaggtattaatgaagaaagctgtttctctttccttcgctttattgatatatctccagcagaaatggcaaaccttatgcttcagggacttttggccagatggttagctcttttcctgtctctgaaagcctcctacaggctccatcagctacgctcctggggagcgccagaaggggagagccaccagagatacctgaggaacaaggatttccttcttggggttaattttccactctcctttccaaacctttgcagctgccctttgttaaagtctcttgttttcagcagccactgtaaagcagtgagtggctactcagaccaggttgtccatcagcggagatcagctacctcctcgctgcgtcgctgcctgctcactgagctgccatcttttttgtgtgtggccagtccacgagttaccgcagtgccattggattcttactgcaatgaccgaagtgcagaatatgaaaggcgagttctgaaggaaggagggagtctggcagccaagcagtgtttgttgaatggggcccctgaactggctgcagactggctaaatagacgatcacagttcttcccagagccagctggaggtctgtggagcatcagacctcagaatggctggtctttcatcaggattccaggcaaggagagcctcatcactgacagtggaaagctgtatgcccttgatgtcctgctgactcggctcaagtctcaagggcatagggtccttatctactcccagatgaccaggatgatagacctactggaggaatacatggtttacaggaagcatacctacatgaggcttgatggctcatccaagatctcggagaggcgagacatggttgctgattttcagaacaggaatgacatctttgtgttcctgttaagcacacgagctggaggactgggtatcaatctcactgctgcagacacagtgattttctatgatagcgactggaaccccactgtggaccagcaggccatggacagggcccaccgcttagggcagacaaagcaggttactgtgtaccggctcatctgtaaaggcaccattgaagaacgcattctgcaaagagccaaggagaagagtgagattcagcggatggtgatttcaggtgggaacttcaaaccagataccttgaaacccaaagaggtggttagtcttcttctagacgacgaagagttggagaagaaactgaggctgcggcaggaagagaaacggcaacaggaggaaaccaaccgagtgaaagagcgcaagcggaagcgggaaaagtatgcagagaagaagaaaaaagaagatgaattggatgggaaaaggagaaaagagggtgtgaacctggtgatcccatttgttccctcggctgataactccaacctctctgctgacggagatgactccttcattagcgtggactcagccatgccaagccctttcagtgagatctccatcagcagtgagctgcacactggctccattcccctggacgagagcagcagtgacatgctggtcattgtggatgacccagcctcctcagcccctcagtctcgagctaccaactctcccgcatccataacaggctccgtctcagataccgtgaatggaatttccattcaggaaatgccagctgcaggacgtggtcactcagcccgaagccgaggccgccccaaaggttcaggaagcacagccaaaggagcagggaagggccggagccgaaagtccacggcaggcagtgctgctgcaatggcaggagccaaagccggggctgcagcggcctctgcagctgcctatgccgcatacgggtacaacgtgtctaaaggaatctccgccagcagtcctctgcagacatcccttgttcggcctgctggccttgctgactttggaccttcaagcgcctcttctcctttgagttcccctttgagcaagggaaataatgttcctgggaatcccaagaacctccacatgaccagcagcctagccccagactctctggtccggaaacagggcaaaggcaccaacccctctggaggacggtaaccatctgggccctccgacttccttcaaccaaaccagggctagagtcctgacctgccagtggtctttggatggcttgcccgtgcagcatcttgcatcctgagtcagaagtggaaatgtccagcaggggaaggacaggcaggtggatggtgtgagcacttttatcatctgtgtctcatcaggagcatctggggtgcctgtaggaggaaggccacagggcatggatcagccccactgcatctcaagtgaactgtatagccaagtcttaaacctctcacggggcaagcctgacacagaccccctttagatgctcaggcatactgtttccatcccgattccactcttcggctctgacacgtcccttgcaaagtctccgcaggtgctgtgaagagccttccatggtagagatttctcttaagagtgtgatttctcatagggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtaaagagaccaggagccacctcaatcagcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagat

SEQ ID NO: 256250 - DNA, 490 bp, Homo sapiens
gcggtggctcatgcatgtaatcccatcactttgggaagctgaaacaggaggacctcttgaggccaggggttcgagaccagcctgggcaacatggtgagcccttgtccctactaaaatttttttttaaaaattagcaaggcatggtggtgcacactcgctcgtggtcctggctactcgggaggctgaggtaggatgattgctagctagagtccaggagttcaggattaaaatgagctatgatcataccactgcactccagcctgggtgacagagtcaaaatttatctcaaagtaagtgtttagattgtggtttttgtgcataaatgaaaaaaaaaataaaagaagaagaaaaaagataaagcacataatactttaaacatattgatgcatatgagtgatatgggaagaataaattcaaatttcaaagttggaattaatataggtattattattttggaaggggaaatctcaaacctttacactaaatcaaa

SEQ ID NO: 256251 - DNA, 468 bp, Homo sapiens
acaactgctaaactggcttgtttctaaaagtctgaatttacatggtttcaagtttctctgctggtgtactcggccactaggtggtgactgaggcttgtggctctgaggcttctgctgcaaggtggcagaattgccatgctctgcccgaggttgagcagggaggaattttagccctgcctgaaatatgaagggaaactgacctggggacgggccaaggctagactgagccctggctctgtcagaatggcccctagccccagcagcaggatggaatgtcagtctaaaatgagaaggcttggccaggtacggtggctcatgccaataatcccagcactttgtgaggccaaggcaggtggatcacttgaggccaggagttcaagacaagcctggccaacatggggaaaccccatctctactacaaatacaaaaactagcctggtgtggtggtgggtacccataatcccatct

SEQ ID NO: 256252 - DNA, 252 bp, Homo sapiens
gtgtcagcatccaacagtacttttttctaaggaaagggataacttgccacaggaaaagaaaatgctgtggctttagacacagccacccatcctgtctccaggctctggtgacagactctgtcctggggccgctgctggttaattcaggcttctccatgctgggaattcgcttccagaagagtggcccccaggatgctttgccttcagggtcagccctgtccgccttacctcaggcccagcagaaatagcagg

SEQ ID NO: 256253 - DNA, 473 bp, Homo sapiens
atatattatcaaatacttaactctgtgtcatgcctgagttggaaaccagagattgagtgatgaaaaagatgatacagttccagccctcatagagctgacaatctagtggaagagatgaataattaaacaatgacaaaagtgggatatgggataaaagagagcaagccagctggtaaagagtatcaaggcataggccgggcccggtggctcacgcctgtaatcccagcactttgggaggccaaggcgggcggatcatgaggtcaggagatcgagaccatcctggctaacacggtgaaaccctgtctctactaaaaatacaaaaaattagctgggcgtggtagcaggcgcctgtagtcccagctactcgggaggctgaggcaggagaatggtgtgaacccgggaggcggagcttgcagtgagccgagatcacgccactgcactccagcctgggtgacagagcgagactccatctc

SEQ ID NO: 256254 - DNA, 1010 bp, Homo sapiens
ctggaatgcctgtggtttctccagcacctgggtcctgctggcaaccagcagcacccagtggccagcagcgtactctttcacctcttcttgggtgactttgtggaatgctccaatgtgacatctccctgtgaacgcctttcctgacaccctaaaaagtgtcaggaatttccagcaagttccagagagcaggtttccagcaagtttggtcagtatgacaccacagcgatatctctgccattcactgaacttggattcttccttcttcaatgagagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggtaggtgtggcaatatctcccattctgtgcttacctgggcctcgactggtaccagcagacagggatgggcagtcagttaaggagtgtggctagcgactgttgtgtcatgcattgcactggttttctgctcctcaggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggcaccagacagatttgggatttcagaacttttcagatgttagaaaggtaaatggtatatattgcatatgtagtatttccagtagagtctgggtcagcacctcataagcaaatgtattaata

SEQ ID NO: 256255 - DNA, 874 bp, Homo sapiens
ctggaatgcctgtggtttctccagcacctgggtcctgctggcaaccagcagcacccagtggccagcagcgtactctttcacctcttcttgggtgactttgtggaatgctccaatgtgacatctccctgtgaacgcctttcctgacaccctaaaaagtgtcaggaatttccagcaagttccagagagcaggtttccagcaagtttggtcagtatgacaccacagcgatatctctgccattcactgaacttggattcttccttcttcaatgagagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggcaccagacagatttgggatttcagaacttttcagatgttagaaaggcgattaggagcttctgcgatgagaaagggatccagactgatcttagactttatgcacccagagtattgagcac

SEQ ID NO: 256256 - DNA, 1183 bp, Homo sapiens
ctggaatgcctgtggtttctccagcacctgggtcctgctggcaaccagcagcacccagtggccagcagcgtactctttcacctcttcttgggtgactttgtggaatgctccaatgtgacatctccctgtgaacgcctttcctgacaccctaaaaagtgtcaggaatttccagcaagttccagagagcaggtttccagcaagtttggtcagtatgacaccacagcgatatctctgccattcactgaacttggattcttccttcttcaatgagagatgttcaagaaaaagaacaacttcagtggaagaagaagaagataggagcccaggtcctgtgtttcaccaagacagccgtgcaaagcagatgctgccaaaaaggtgcaaagtggtttgtcagctcttctgcatgttctaacaaattagacatgcatcccaaaaggtttcctagactttccatcaccaccagtgaattctgagtgacaatagtgtggaatttggaagaatggaagagaaactgaagtggagagatggtgaaagagaagaaaaaatgaagaaagatgcttgcaaaaatactgctgtgggtcctgagatgaggattctgggagggtaggtgtggcaatatctcccattctgtgcttacctgggcctcgactggtaccagcagacagggatgggcagtcagttaaggagtgtggctagcgactgttgtgtcatgcattgcactggttttctgctcctcaggctgaaatggatgcccctgacagctccctttgagttcctgttcatctgaagtacaccagctttctagatatgctgtcactttccttctgcagagccacagtggtgtcctgtcttctcagacctcttctcacctcaaatcacttaggactcggcaccagacagatttgggatttcagaacttttcagatgttagaaagggcatgagcatgaagatgctgacaaagctgttcctacacttcctgtgctggctgggaagggatctgattcgggctgagccttaagaatcacagttccaagctttcttctcattccagattttagtcgggaaagtaggcattctggaagtagagtccgtatctatactttatatgttccccttaggtttgatgagcaaaaagtaataaaggaaacacaaactcaggaaagaaaagatttttctaggaaa

SEQ ID NO: 256257 - DNA, 265 bp, Homo sapiens
cctgcaggatccaaggatgcccccaggacagccagcggctccaagggctcacccttccctggatcagtgtttctattttgttcccggcctcttgggggcttccctcacctgcctgcaggccccgtccattcactaggcaggcgttctcaccatcctttaccgtgcctcagtgcagtgtggtaggaaataggacagtctctagcccaccacagtggatggtaactagactgtaactttatgcttacaatcagcaaaaatgaatgtt

SEQ ID NO: 256258 - DNA, 507 bp, Homo sapiens
attgcccttcattttgttcctcatcaatgccatggcttgctcctaacttagggcttttgcactatgttcactctgttgggaactcttcctaaatcattacatgagtgactacttttcatcatttcatgttgtagttcaaatatcatcttttcagacaagcattgctacctaaccatccttccagaatgacactagcctcatccccctcaatcccattaccttttttacttaaaaatttcttcaaaccatttatcagtatctgaaattatgtttttatattattttataatctccatactcactagaatataagccccgtgatatcaatgatcttgtctctttttgtttttgtttttgagatagaatctcactcggtcaccccaggctggagtgcagtggtgtgtgtgatcacggctcactgcagcctggaactcctaggctcaagtgatcctcccacctcagcctcctggtagctaggactataggcaacaactaccatgccgagct

SEQ ID NO: 256259 - DNA, 512 bp, Homo sapiens
aagtttgaggacttgcaaagtcttaatcccagttccgctggacttcaaaacccaagccataaactaccatgctgccatgtctcccagtgaccacatacagtggccgccaagaacacagtggggtaggggaatggtctctgggttggtgtgtgccacgtcctgtacaccactgcccccagtggaaggccagggaaggcatgtgattcgtggtcagggtctgcagcctcccatctctaggcatcatcatttattagacatcagctgagtactcaggggtcgaacagaagactcagatttccctcttttcttccaccataggaacatcttttatgcgtgcctaataacctaaaaacatctacagttcacccttgaacaacacaggggtaagaggcaccaaccccctgcacagttgaaaatctgagtataacttttgacttcccagaaacttaactgcttattagcctactgttgactggaagctttaccaataataaaaagttaatacatatttt

SEQ ID NO: 256260 - DNA, 382 bp, Homo sapiens
caagatacttgaagtctaactcaccaagaggatgaagttctcatcattccatctgacgaacaagcgagaactagccaagtgctggccaaaggtgagtcaaatctagaatgactgataaaggaagaagatgataaatatcagttttgcttctgggaccacctgcagtaacaaggactccatcttgtttgctaacattttttatgtctctggaggagactgaaattgacaactactttgaagaactgaacttgttccttcttttctgagaaagaagcaagggtctctttttctaataacagctttgggtaccatataaaggcataagtgctatttaattggtatgaagggtaaactaataaagattcagttcacgtaccaccca

SEQ ID NO: 256261 - DNA, 335 bp, Homo sapiens
aaggagaccatatttggagttttaaatgccaggaaatagtatttcataatttaaattgctggtaaaaggaagagtcaaattagcaaaataattataattgctaacatttattgcatctcactatataccaggcactgtactaagggcctttaaatattacttaatttcattctcaaaactctcctataaggtatggccccattattatcatcttatgaataagaagagtaaagcctagaaaaattaagtaatttgcccaaggacacacagcctatatgtaatggctgagattttatcccaggtagtctgactccatagcgtgtgctcttgagatg

SEQ ID NO: 256262 - DNA, 407 bp, Homo sapiens
ctttattgaaaagaatgcaacagccctggaatatgctttgatgtggcaatgggtttttttggatctcttcttgcctgatcattacttggtttacacaggacttggccagggaggaagacacacccctttgacaggtagacaggaagcactattggcagggagcagctgcgaagcaatcctagttgccatcattggggtgctggcatagtactggtcctgcaggtttctaacttgtcatcctagctggtaatgtctcctggtttttatggaaggcttaattggagagtgtctgatgcctgaaggactttcctggttgacaaccttgaaaatggtgaaagaaagaaattgaaaccaggtaagctcttccttgtgcattcttccctccctcacaggtggagcctggcaaa

SEQ ID NO: 256263 - DNA, 4449 bp, Homo sapiens
  misc_feature (1669)..(1670): n is a, c, g, or t
  misc_feature (1733)..(1733): n is a, c, g, or t
  misc_feature (1795)..(1795): n is a, c, g, or t
  misc_feature (2181)..(2181): n is a, c, g, or t
  misc_feature (2605)..(2607): n is a, c, g, or t
  misc_feature (2729)..(2730): n is a, c, g, or t
  misc_feature (2750)..(2750): n is a, c, g, or t
  misc_feature (2752)..(2752): n is a, c, g, or t
  misc_feature (2789)..(2789): n is a, c, g, or t
  misc_feature (2809)..(2809): n is a, c, g, or t
  misc_feature (2933)..(2934): n is a, c, g, or t
  misc_feature (3013)..(3013): n is a, c, g, or t
  misc_feature (3152)..(3152): n is a, c, g, or t
  misc_feature (3526)..(3526): n is a, c, g, or t
  misc_feature (3813)..(3814): n is a, c, g, or t
  misc_feature (3818)..(3818): n is a, c, g, or t
  misc_feature (3926)..(3926): n is a, c, g, or t
  misc_feature (4021)..(4021): n is a, c, g, or t
  misc_feature (4078)..(4078): n is a, c, g, or t
  misc_feature (4146)..(4146): n is a, c, g, or t
  misc_feature (4416)..(4416): n is a, c, g, or t
gcgaccgtcgggatcccggggccgcgcgctcagcttcacccgacttacttcaacctggccgaggccgaggatttggccaccgccacctgcggggagaggggacccggcgaggggagccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgaactttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactnnaatttggggtattgccaatgcaagcttcatgttgaaggtcctacttgtagccgctgcaaactnttatattggaatctggacaaagaaaaccccagtggatgttcagaatgcaagtgccataaggngggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgncctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtacccnnncttgtgaggccagacacttcctgcttgatggggagccaagacccgtggcagtgaggcagcccacacctgcacaccctgtcatggtggacctcagcgggagagaggtggaattgcatctgcgnntgcgcatcccacaggttggncnctacgtggttgtggtcgagtattccacggaggcagcncagctgtttgtggttgatgngaatgtgaagagctccgggtctgttctggcaggccaggtgaacatttacagctgcaactacagtgttctctgccggagtgctgtgattgatcacatgagccgcatcgccatgtatgagctattnncagatgcagacattcagctcaagggacacatggcccgattccttctgcatcaagtttgtatcatacctattgaagaatnctcagctgagtatgtgagaccacaagtccactgcattgccagttatgggcgatttgtcaatcaaagtgccacctgtgtctccttggcccatgaaactcctccaacagcattaattttggatgttctaagtggcaggccnttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaacagattgagtttgacatctcagagcctgaagtggccgcaactgtgaaggttccagaaggaaagtccttggttttggtccgtgttctagtggtgcctgcagaaaactatgactnccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggcaccggccctcactgcagccctgagggtggcagtgcccatgccagcccaacgtcatcgggcggcagtgcacccgctgtgcaacaggccactacggattcccacgctgcaagcnnaagncgtgcagctgtggtcggcgcctttgtgaagagatgacggggcagtgccgctgccctccccgcacggtcaggccccagtgtgaggtgtgtgagacacactcattcagcntccaccccatggccggctgcgaaggctgcaactgttccaggaggggcaccatcgaggctgccatgccgagtgtgaccgggacagcgggcagtgcngatgcaagcccagaatcacagggcggcagtgtgaccgatgtgcttccgggttttacngctttcctgagtgtgttccctgcaattgcaacagagatgggactgagccaggagtgtgtgacccaggnaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgccngcaaccatccacagcgcgtcctgggtcgcaccc

SEQ ID NO: 256264 - DNA, 1120 bp, Homo sapiens
cctagaggatcccggaggcacacggaacagagtcaagctcacctggatctggggcagctcttccatgtggcctatattttaatcaaatttgcaaattctcctcgccctgaactttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatccgtaagtttcatttcaagttggtgtatcttagcctgtgtgtactgcctcagcgaagtcatcaggctaactttggatcagttaataacttccttcatgccctctctcttcagagtattagttgtgctcgctatgtgacctcagtcacttacacagtctctttgaattttggatttattgcatgtaaatggaaatgataatgtatttcataagattaaataaaatgcaatcaaaagcatg

SEQ ID NO: 256265 - DNA, 2305 bp, Homo sapiens
  misc_feature (1388)..(1389): n is a, c, g, or t
  misc_feature (1452)..(1452): n is a, c, g, or t
  misc_feature (1514)..(1514): n is a, c, g, or t
  misc_feature (1900)..(1900): n is a, c, g, or t
cctagaggatcccggaggcacacggaacagagtcaagctcacctggatctggggcagctcttccatgtggcctatattttaatcaaatttgcaaattctcctcgccctgaactttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactnnaatttggggtattgccaatgcaagcttcatgttgaaggtcctacttgtagccgctgcaaactnttatattggaatctggacaaagaaaaccccagtggatgttcagaatgcaagtgccataaggngggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgncctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaagtcagtgtggggcagaaggtgcagccgca

SEQ ID NO: 256266 - DNA, 482 bp, Homo sapiens
gggtcatgtttcaggttccaacttgaagatgctaccactggctggctaaggatatgaaacttgagtattaacaagaataacttcagtagattgatatgtatcaattatatctaaatccatgaatttctaagactactactactactactacaacaaaaatttgttactgttggaggattctaggaagccaactcactttaacaactgattctgccttttctatataaactgtgctattaggtaatcaaataatagatgagtttgttcttattagaataatattccagctaatgagtgaagaaggaatgttggagttaaaatactaccatttgcaatccctgataagctattgggatctaggcatcaaggctcagtggctgacagataactaaaaagaatacaaccaagcattatgtgcctcctgatagaaaaatacaacactatccaagaagtagtcttgccaaccccatgccttaaaaaag

SEQ ID NO: 256267 - DNA, 455 bp, Homo sapiens
catttaaagtatacaactcaatggttttacatattcagagagttgtgcatacaccactactatcaattttagaacattttcattaccctaaaaagaaaccctgctttgcttagccagctttaccaatctctcccctcatactccagtcaaccatgaatctactttctgtctttataaatttgcctcttcagaacgtttcatgtaaatggaatcataaaatgtggtcctttgtgactggtttctttcacttaatgtaatgttttcaagagtcattcatgttgtagcatgtatcggtgcttcatttctgtttattactgaatagtattccattgtatggatatactacatgtatttatccattcatcagttgatgaatattggattgtttccactttttggctactataaataaagctgctgtgagcactcatatacaagtttttgtgtggacatgc

SEQ ID NO: 256268 - DNA, 902 bp, Homo sapiens
tttttatttcgcgctaatgatagattagcaactacacaaattttagttcacaatatgtaatttttattgagtgatcaccatgtgctgatttccataatagggattcacgtttgaactgtcttcaaaacaaccctatgatttagttaccagtatactttctcagttgaataggtgaagaaaccaaagtaaatagaggttaagcaattttccgaaggccgtaaagctgatgactagcagagcagggattcacatccaggtagtctgactctaggtaccacatgctacacatcctgtaccacaacttattatatttgatcctcataccaatcctataatggtagattttttagagtgtcttctcagattgtaaaccaactccagaccatgtctcgttggttgatttaaaccaaatcctagcacatgatgattataacatgatgagcctcgtgacctagtctctatctcttattattgtgttctttataataaagatgatttattgaatatataattctatctcagtgtttatatatttgtaagactttctctatcaatccccaaaccaggaactatccctttgccatgtgttttgcttggattgaaatatagttacatgcacagcatgtgcttaatttatatacattgaatgaataatataagggagatgtaggacggggttgagttgggagggtcttagacatttcctaggtggtaaattgatgttcccagttgaaatgacgtacccatggtcatgtggatggaattggtcagttttatattccactatctgtgttagctaccagtgtatctccagtgataatcacaatgcttgacatatagtgaagcataatagctatttgatgaataaataaatcactgatttgactaacaatatgtgttat

SEQ ID NO: 256269 - DNA, 357 bp, Homo sapiens
tttatttattttgagacagagtctcactctgttgcccaggccagagtgcagtggtgcaatctcggctcactgcaacctccacctcccgggttcaagcgattcttctgcctcagcctctcgagtagctgggattacaggtgcccaccagcacaaccggctagttttcatatttttagtagagacacggtttcaccttgttggccaggctggtccccaactcttgacctcaagtgatctgcctgcctcgccctcccaaagtattgagattacaggtgtgagcccctgctcccggcctatatttttaaatcacaaaaataatatataaaaaaaagttgttaatcctggaatgtacaaagt

SEQ ID NO: 256270 - DNA, 786 bp, Homo sapiens
caaagtcctgggtgggagcattagtttggttaacaaaggtcacatgactgatgatcaataatcaaataactaggaaagggactatcccagactttttgagatttcccaaaataaggaatgtgttcagacactgggcagccatcaacagatgtcatttacacgtatgtgtgcatgtagacacacgcacacacacacacacacaaacacacatattcgatgattgcttcccaatgccagagatttctcattaaatttgtaacagcatggtgttcaaatacttttctttttaaatttatgttttactacctaaaacataatgtttcatggtctaaaggaagaaaaacacaagtaaaggaaaagaaataaaaaacttttaaaattccagtacctgattaaaataacagcaacatttttgtgtatattcttccaggctttgttcaatacatagaaatgaactctttagccaaagtaggatgatagtacatattatagtaagaccatctttttaaaattcacaatgtattctaaacatctttctatggcaattttagaaggacatactattctgttccatggatgtatcataatttgttcaaaaatcacagattattgaacagttagattatttacagttttctgtcataaacaatgctttgataaaaaactattttttcatacccttttcacattattgaattacttcagaaaaataaattgctagaaatgcacttgcctcatcaaaatataacacattttaaaggctttcagttgttaccctcaatttac

SEQ ID NO: 256271 - DNA, 506 bp, Homo sapiens
  misc_feature (379)..(379): n is a, c, g, or t
tgtggagtagaggacaggctgaaggtcaaggcagggtggggaatccagcctggaagtgactgcagcctagctgagagagccgtggtggccaggaccagtgaggcagcagcgtggatggagagagaggagggatgcagagatgtttaggacatgagctggctggtgatggatagcatggggcaggctggtggtggtaaggggtccagggtccagctgccactaggagggtgggtaggtttgggcacaagcccttgtctttctgatccttgttcaggtgagatccccctgcacagatttcacctgcttttttttttttccctggagccatttaaaacggcctccgggggatggggtcggcatgattttattaatttatttnatttattaagacagagtctggctctgtaccccaggctggagtgcagtggtgcgatctcgattcactgcaacctccgcctcctgggttcaagtgatcctcctgattcagcctcctgagtagctgggat

SEQ ID NO: 256272 - DNA, 438 bp, Homo sapiens
atacctgatgtgaaaggttttatgttcaaactggattccagtgtataacagaaataagctctgacctctctaaccgtatgactaatttttcttaacttttaggttttaatttttcttttttcccttgtttaggccaacagtgcaccctagagaaaatgtgagttattttctcttctagcagttaagaaaacagactccagtgccagatgtcctgacttctaatcctagctttgcttttcctagttgtgtgacctccaaagcacccaaactctgtggcccagttgcctgtaaaatgaggacagaaactatttcatgggattttgaaagaaattaatctacagcaggtgcctggtacatagtgccactttatcattattgttacacataaatgaaatttttgaaaaacataagttccaaataaaaaacctcaaccatatt

SEQ ID NO: 256273 - DNA, 307 bp, Homo sapiens
tttgtggttccccgttgggaatcctgatgcaatagtgaaagggttagagtctggatttttcagagtcccccacgcaggcacagttgtctcctaggggcctcggggaggagcagacgggagtgcagcccctccgggtgagagtgggagcagcggccgtggggcggggccagtctgggtgtggaggtgcagggcagtgagggctggatggtgtaacctccacggggtgcacgaagctgctttgctttttcccagtcgttgccttctgtcaaccaccctgcccttggccacactccatcgtgtggcgttg

SEQ ID NO: 256274 - DNA, 185 bp, Homo sapiens
cccttcctgtgtccatgtgttctcattgttcaattcccacctatgagtgagaacatgcggtgtttggttttttgtccttacgttttttaattaaagaaagtcatcaagtgtaccaagtagagtggtaaaaaaagttgctactcaggaaattataatgaaaatgatctcaaattcagatttgcatt

SEQ ID NO: 256275 - DNA, 305 bp, Homo sapiens
ggtcatgggcctttttctttctttgtttgccatgttatctccaacatctggaacagagtctggcacaaagcttttttactgcagggcttccgtgaatttggagatttttctgagctgggagaaccaagattttcagagaggcaaggctaagcaccagccaggtcctccatcttccaaccccaaaattcatccagaatgtaccaggatgggcctagaagtcaacttcaaactttgatcttcaatcctacaaagaatgatcatctcagaaaacttagggcaaaagtaaatatgcatggatttacaaa

SEQ ID NO: 256276 - DNA, 271 bp, Homo sapiens
cccatcccggaaaaaaaggggagaacacggggggcaatcggcggagaggggaaggcagaaaatgttaccagaggtgccaaatgaggtgagaaagaccagggtaggaaacataagaaaggcgggactctcgggcaggaaggtctgtttggggtagggaaggcatgtcaggacagagctttccggacagccgaccttccttctttccagcccctccatccccgacaaactcactttctcagcaaccctaagcccgtgggtcaccctcgccttg

SEQ ID NO: 256277 - DNA, 411 bp, Homo sapiens
gtaactgactgtggctttcatgtgaccctggtttgtgatgagctgtgctgtgttttgggaatagcattaatattttcttgcagtttgagtttaactatcaacggtttcctggcatcttttggttgatgtcagacagtaacattttagatatggcagcctgattgtcacctgcacatttagagacaattattagactagtggttttccttctaaagccaaagagttttttgataatcttcctatatatactgttacaccccccagttttgtgaacacacaataactagtcttatgacttgcggtaatgctgaataatacatctgttgtgttactttcctaatgtatgatctaagttgtattaccattgtcttatgttttccttaacattaaaacctttcttttgtttgttta

SEQ ID NO: 256278 - DNA, 714 bp, Homo sapiens
cagtacatcaccttcatgagcgcatcagtgaacaccagtctaaggaagacatctctgaacgtaattttggagattttgatgagttccattgaaacaaggaggaatgtgatgtccagtatcagttctgcagacccaaggacaaagaaaattctgtgataaactcatccagtgtgactgtaatgtgggtatctatttgatacctccaagtaactgtttattcttgtgccagttgagtagatggtacgggccagttggtgttgattagtgaaccacggacaaagggcatatgtcacatgagttgctcctggataaagtcacccagtcacttcctgatgaatatcctgcataaactccaaagacaaaagagagttaaggttgtttttctcaccttagaccaggcagtgatagaagaactgggggaagagataattgtatttatcttggtgaaggtgacaaatcatggcaaatgagcaaaatgaaaaaggtttgcagatttcaacaaacttctaaaagatcagcttacagtcatgtatacatctcttcctttgtttctagtttatttgcatctcattactatgttctcggtttaggatacaagacaccggactttcaaatcaacaattgtttcaaaagactcctactggattcctgctagtgatgggagaaaattatcattctgtgagttgtcaataaatgtttaaccacaaaaaaaat

SEQ ID NO: 256279 - DNA, 608 bp, Homo sapiens
cagtacatcaccttcatgagcgcatcagtgaacaccagtctaaggaagacatctctgaacgtaattttggagattttgatgagttccattgaaacaaggaggaatgtgatgtccagtatcagttctgcagacccaaggacaaagaaaattctgtgataaactcatccagtgtgactgtaatgtgggtatctatttgatacctccaagtaactgtttattcttgtgccagttgagtagatggtacgggccagttggtgttgattagtgaaccacggacaaagggcatatgtcacatgagttgctcctggataaagtcacccagtcacttcctgatgaatatcctgcataaactccaaagacaaaagagagttaaggttgtttttctcaccttagaccaggcagtgatagaagaactgggggaagagataattgtatttatcttggtgaaggtgacaaatcatggcaaatgagcaaaatgaaaaaggatacaagacaccggactttcaaatcaacaattgtttcaaaagactcctactggattcctgctagtgatgggagaaaattatcattctgtgagttgtcaataaatgtttaaccacaaaaaaaat

SEQ ID NO: 256280 - DNA, 945 bp, Homo sapiens
tgcctctcaaagtgctttattcattcagtgatttttttcatttgtatttgtttattaaacctggtgctgcccatttatacccttttccccacccaccttagtttcaaattaaatgtacacattgaaacttctttactgagatagtttcctaatccctgagggaatctgtatcagaaatatgcataaaagtttgaggccaggcacagtggctcatgcctgtattcccagcactttgggaagccaaagtggaaggatcacttgagccatccaggagtttaagaccccatccctatttataaaaataatttaaaaattaagaaatatgcatgaaagtttgacccccatgttattttttagttccagttcaactttgttttgcgtaactctaatttgcattcccatctgtattaaagacaagttctcaagtagcaaactttttaactctgccaaggctgaaacttttgagactaagtagaaggaaggcatttttgactaaggtttttatccactgtgctcaattagcttagtcatcttttttcttcttaagatctttgtggcagatataaagtacaactctttacctacaattctgtacgtgtatgtgtattatcagttgaagcctcataccagatgcttttagttattcaagatatgtgttcgaagacattgatacatgatgtttatttttcttctacttcagcatacctgagggatacaacatactcctgtcagtaacagattcactgttacagagattctcacttgaactaggaagcatgctctttaggaaagaggcctatcagaatctaaaaaggggaaatgaaggttagaaaagtaccagcacccccatagatgtttaatttggtacactcgtctcctccagcagctgaaaattgctagttttaagagattgagccaggcgccgtggctctcgcctgtaatccc

SEQ ID NO: 256281 - DNA, 178 bp, Homo sapiens
cctcttcttctttttttttacctttttccttccttcagccaataattattaagccagtctctctgctacatgttggaggtacattcatggaacggacagaacatcctcgaaagagcccaggattcagatttatctctacctctcacttccttcacttccccttcctgatggattgctc

SEQ ID NO: 256282 - DNA, 411 bp, Homo sapiens
ccactgcactcaaccttgagtgacagagtgagaacctccgtctcaaaaaaaaaaaaaaccttgcccagcccaatgttgtagagtatttctgtatgttttctagtagttttgtagtttcaagttacatttaatcctaatccattctgagttgatttttgtgtatggtgagaggtaggggtctagtctcattcttcttcatggggatgttcaatttccccagcactgtttattgaagagactgtcttttccctcgtgtgtgttcttggcacctttgttgaaaatcggttgactgtaggtggcatacgcaatatataaagaggaaaatcagccacggaccaatacagaatgttaatttgaagtgattattttttaattactgaataattgttcagttcaacgtattttctagta

SEQ ID NO: 256283 - DNA, 781 bp, Homo sapiens
tgtaccttcacagacaaattcagatctaagattattttcccaaatataccttcacagacaaatttagatccaagattatttccccaaatataccttgacagaaaaactcaggttcaccatctgtgcttatgtggggtaagcttttttaggcaaggaaatcttgcataacaattaaaaaattaatgcatttttcaggtggacattttcagctttcttttcacacaatcccttctggctagaattgctatggttacatggcaggatatatcagaccagattctaggaattcattatctcacttttctgtgaatatattgacattcattaggttatgggtttagctactatgatttataagatataaggtgaattgagctacttttagtaaaattcttgtttgaataccagcttgtcttccagaatacacatttttttgttctaaatattctaatattcagaattattgaacattacttttctacagttgggaataaagaagtagcagaaagagaaagtagatttcagtaaatagtattttacttccaaaagattttctatgtaaatatatagatcatatattcctaagcaaaattatcacatgaagttttatgtattgcctaatgtaaggtctgatattagaacaatactttagatcaaaactgtgccaaaatccataatgcacttcttactctacacaaagggaattactaagttgataatattttcttttacattttcaatttgttgttacttgccaatgaaagacaagtagggaagagcc

SEQ ID NO: 256284 - DNA, 473 bp, Homo sapiens
gtaacctgaggaaagcccatcctttagtcctaagagaggctctgaccaacaccttgcaggaaaggggtcatgtaagggagaattctgcttccttcatagcctgcaataggcaaacagtcttccacatatcacagtgggatattggaatattcagcttaaaggaaggcatcatccataaggaaaaaacatccatgctccactgcattctgaaaggatgagtcagatctttaaaatactttttaaccagatcatatttcttaaatgctttttatttcacaaatggaaccccatttttatattcattattgtagttgtagcccactgttttcaccaatgaaattttttctgatattcaatatgatgattagcaaagggtcagttatctgttgaaatacaaatagtagtggcacttacggtggccaaatctggaatgtagatttttactatggctaaaatgaactattccctataaa

SEQ ID NO: 256285 - DNA, 547 bp, Homo sapiens
tgagacagggtctcattcttgcccaggctggagtgcagtggcctgcactgtagcctctacctctcaggctcaagcagtcctcccacctcagcttaccaagtagctgggactacaggcacaggccaccacaccagctaatttttgtgttttttatagagacagggttttccattgttgcccaggctggtctcaaactcttgggctcaagtgatctgcctgcctcagcctcccaaagtcctgggattagacacgtgagccaccagcctagtgcccttatttttaagatggagtctgtgggttgaagaggttcatgagatggggagacttcttaaaaaggcctccaaaggaaaagcagcaatgcaaaatacatgcaaagagccataaaataccagctctgtcctcataagaggcctcgtctactcgccagccttcaggcaaggccacacctccattgtccccaacagttaagtattcatcaaataaattggaattccagtaaaacaggaagtgcactccactgatttgctggttctcacagttattgctg

SEQ ID NO: 256286 - DNA, 397 bp, Homo sapiens
gcacgaggccggtaaccgggccctttccacctccgcctccatgttcagtttaaatattaatcttgctctatctagaaccccaagaatcatctaagctgactcttaaattatatccaaaaacttacggttgtgatattcaaatgtataaacagacagatgtaagacattaatagaaaagacattgtatccaaaacaccattaagaaaattaaaagacaaaaattaaactgctaaaaagattgcaacaaaatgtccaaatttatatttaaaaagtttttgcaagtcaataagaaataatattactaacctaatacaaaaatgagcaaagaacatgagctggcaaattatgaaaaaagaaatacaaatagctaataaataggtagagaaaagtttgacct

SEQ ID NO: 256287 - DNA, 457 bp, Homo sapiens
aaaagaaaaacacttcccaaggcccggcacttttcagcagtggaaagcaggctccgcgtaggaggcagcgcagcaaaagaattccctactccgcacttttcccgctcttgcaccctgcgagcagcaggattatataaagtgaccggcgcctgcttctgctagcagctctgctcggcggtcggaggcgggacgaacgcgcgcagcctcgctggggaccaaaaatctgctgcccgtggtggcctcggacgccgggaggctagtccgacttgcggaggccggctcggcacttgcttgtacgccggtggcagtggaaaagctgagggggcttgggaagggaggggacaccaggcgccaggctgtgactagcgctgcaatcgtcgtaaatcaccgacgggtagagtcagcccatccaagttgaaagagagggggaaggcgatggaggttgcggtcagtttct

SEQ ID NO: 256288 - DNA, 116 bp, Homo sapiens
aagtaattagttctttactgattgaaccatttttttctcctcttttagtatttggaactggaacaacttacttttgatgattcttacttactggtccagtctcagcccacctgcac

SEQ ID NO: 256289 - DNA, 526 bp, Homo sapiens
atcccattcctgtcatcacagttgactcatggcaggcacacagcttgctgcaagtatggaaagagatttctcaagcacaaagggctcaaagcacacagaggacttgctgttcctgacagactttgtcaaggacagaaaggaacttacagactcacacactgatccacaaagaaaattagaaactcaccagaccctctccattttaagggaaactaaggagggtggcgggagatgggacaggaaatgactgcccaagtataatgcaacataaactagtatttcttgtgaaatgttttcttatcctcaagtctaaagacatggcacgtgcgtgcctgcgtgtgtctctgtgcatgcacttgcacttgtgttcgcagtggtgtggagggtaggaaggactaatagcatgattgaaatgatcatattaactagattactctttgacatacttggattttgacttgtcttctgattggaagtttttcttcagcatctttggcattaaagaggcttgttttgggaagtaaca

SEQ ID NO: 256290 - DNA, 463 bp, Homo sapiens
ccatgtattgatgtgattttatctgcaattcttgcctccctaaaacatataaaaaccaaactgtgggccaggcatggtggttcatcccagcactttgggaggccaaggtgggcagatcgcttgagcccaggagttcaagaccagcctgggcaacatggtgaaattgcatctctacaaaaatacaaaagctagccgggcatggtggtgcacatctacagtcccagctacttgagaggctgagatgggaggatcacctgagcctgggaagtcgaggctgcagtgagccgtggtcacatcactgcactccagcctgagctacagagtgagaccctgtctcaaaacaaaaaacaagaaaagttgtaactcaactgccctaggcgcactttctcagggcctcttgagactgtgtttcccaggccgtgctcactcatattggctcagaataaacctttaacaaatattg

SEQ ID NO: 256291 - DNA, 551 bp, Homo sapiens
aattaacagtataccaatatatataattaaaaatagaaaccaaatagattctctgtatttggcaacagagtggcagaacaatagtggcatctccacatttgttaggatgaacatagccctttcccctctccttccataaaagtgcacagaacatgttagtgcagatacagtcctcagaacattaacattccattttgcaaaagacattttccagaatcttggcagtaggtaattctgaaacacttttgaattaccttcaatcatcccatataattaggaatccagaatacaaagtacaaacttggcaattgttatgattgaaactgtcactgatgcttaagggaaattgaagcaagaagcataatttcttcctttaggttatatttcagcaaaatacttgacagcaacatacaatgaacagcttgtttggagagatgatatgatacaatgtaatagtgatgtcaaaataacctggaggaatatccaaaaaccagaaaaacgttaaaatgaagcccaactcatgaacctctctaactgaagcccagtcaaaa

SEQ ID NO: 256292 - DNA, 323 bp, Homo sapiens
caaggagaaaaatgagaatgctagggtctgaatgtttatgtcttcccaaagttcacatgttgataacctagcccccaaggtaatggtatgaggaggtgggcatttagaaagtatttagttcatgaaagtggagccctcatgaatgggattagcacccttatcaaagagacgccagagagattacttgcccatctgccacgtgagaacacagtaaaaagatgccttggaattggactcttgccaaacaatgaatctgccagtgtcttgatcttggacttcccagccttcaggactagaaataaatttctgttgtttataagcca

SEQ ID NO: 256293 - DNA, 487 bp, Homo sapiens
tcagcacactcagctgagcaagactagcagcaatctcaggcctcctgtcctaacagcattctttttatttttttagctttagggttttcatttgttgtaaattaaaatagttaaaaatctttatcggaggagagtagcttgtacacttgaggttgctttgttttctaattactgttggagatggtagtaagcagaataatggctccccaaagatgttcacatcctaattcccagaacctatgaatctgttgtgttacacagcttgaacattcctagtctgaaaatccaaaatgctccaaaatctgaaactttttgagtgccaatgtgacaccataaatgaaaaattccacacctaacgtcacatgatgggtcgtagttaaaacagtcaaaactttgtttcatgcacaaaattatttagaacatacaaaattaccttcaatctgcatataagatgtatatgaaaagtaatgacaatattccaaaattc

SEQ ID NO: 256294 - DNA, 637 bp, Homo sapiens
gtttattcttgggaagtactggacacacatatttcagcacctacgacagaacctgtttcttagaaatctagagtattgattttagccaacggggtatctttgtatcttcaaatctcatagaacttagagtttacggtggggccaggcatggtagctgacgcctgtaattccagcactgggaggccgaggtgggcggatcaactgaagtctggagttcgagaccagcctcgccaacgtggtaaaaccccgtctctaataaaaatacaaaaattagctgggcctggtggtgagcacctgtagtcccagctacttgagaggctgaggcaggaaaatcacttgaaccctggaggcagaggttgcagtgagccgatatcatgccactgcactccagcctgggcaacacagtgagactctgtcttaaaaaaaaaaacacacgtatatgtatatttttttctcaatgtgtcatgtgtataactcatgtctccttaactaaattgtaagttagttgcataaatcagtgtcaatatcacaactgaagaaaggtggcacgttcgggagtaattcaaggagttaagctatgaaggggccccttatcatgaacaaggtaatgccacccggggcttgtaatgatttagcc

SEQ ID NO: 256295 - DNA, 613 bp, Homo sapiens
gaaacatggcaaataaaaatttacactgtcggggggccaggcacagtggctcacacctgtagtcccaacactttaggaggccaaagcaggaggattgctgagcccaggatcagtccaccctgggcaacaaagggagaccccatctctacaaaaaatcttaaaaattagcagggcgtggtggaatgtgcctgcagacccagctattcagtgggctgaggtgggaggaacacttgtgcccaggaggtagaggctgcagtgaaccatgattgtgccacagcacgccagcttggatgacagcgtgagaacctgtctccaaaaaagaaggctatgcggctagaaggaagatacagccagcagctgatgttaaagttttataatagaatggttgttatgcttcatgtatatggcaatgttggtcatctggaacataaattaagctgcagaagttaagaaggctactgggtagtaaaaatagaagttataaaattgatacattaaagtttatgcatttttctcacagctgagtccctcaaaccttacttcacagcctaattaactcttattttagacacatttccaacacacttgattgtctgctattccagacccaggc

SEQ ID NO: 256296 - DNA, 357 bp, Homo sapiens
tgaatgagagagagcatatatactttattcatagcatagcttgatataaacacgtctttgcaagatagtgctatcatctggattgttactaggatacaagtgttccatcacattcttggggaaaaaaaagaaaacttgtacccagtggacatattccagcaagcatagtgagcatgatccaccattttgggctcaagaaaaaggactccatgcaggttaatcagaactttttatgaaaactattcaaaagaagttgaatatactcctgaaacatttacaaaagaaaaaagtgggacctaaaactggccacatactttttaattattaaagttgaacattatattgtatgtgcattta

SEQ ID NO: 256297 - DNA, 429 bp, Homo sapiens
acagagtatgcagtatcccccatgatgattcaaccccagattttatttttcactgagcatctcacacttagtagtgtatcttttctatgcattgggcactgggagacgacgtgtagtcatctcaacagagacctggccttcagacgccaccactcactgccgctctgtccaggcgagcatcaacttgcactgtttcagaagcaaaaggaaaatgaaccgcagccactgaagtccctcagaactgaggaaaagttattgactttcctgatttgtgttcaatctggctggccatgggtacagacacagctggtttccccatttgtgagctggacggatttaattcctggctgtttgaatgatgtatcccctcatcagtgaaaccaacagagtagctcaacttaattttctctttctatggcatgccattta

SEQ ID NO: 256298 - DNA, 419 bp, Homo sapiens
ggctagagaagtcaccctccttcgcctcggagtgggatgagattgagaaaatcatgagttctattggagaagggattgacttttctcaggaacggcagaagatctcaggtaccgtactaagtggccattttccccacagaaactggcagtctggctcttttctggctcaggctttcctctaacacagaagacagacattcagtgggtgggagaggtcagcttcagaccacgtcatgctcctataattcagtctccaatacctagacagccccatcttgctgttatttttagagccatgactccttttacatatgggaggggaaaagggacaaaatgaattttaagctgcctattgggaaaaatttttagatcaacaatcgtaacttattcattattttatgggctttcttagatgggct

SEQ ID NO: 256299 - DNA, 529 bp, Homo sapiens
gatagacttagcacaatagcagaagagagggaaggcagaagacctgaaggaagagcagcagaggaggggcaggcataaagaatggtaaacatagaatggcaaccatagtcacctcagggatcagctcatggcctcctggtcaagcttcctctccctgtgattcttggctgtcttccatctgcagctaagtagccagaccagaatagtcaataattctagtgatctggcaactataattttctagtcttgatgagtatcggtattgtcactgtattaaacttcccctattcgtcatctccatctgatcatcattattattctaagaatcccatgtggaagtaggaactggggtgacaagaatctgggtgctggctgccccttgaatgcatcccatggccccatagccatgactgcggtgccagtgaagcagcagttcccaggaaatacatggattgccttgcctggggctgaatgggagtgcttcaatggtgggtctgtaagcaaagattgtgaacttgttcaggacaaa

SEQ ID NO: 256300 - DNA, 1714 bp, Homo sapiens
  misc_feature (509)..(509): n is a, c, g, or t
cggctgggactaaggcggcagcgggctgagcgctcggccacccccagcgtgcgcagcccgggcgggcttcgcccgcggagcttgacctagggtcgggacccgtcgggttgcaccgccgcactcgggaagacccggcttcgagcctctcctctccgtctccaaagcgccctcccgcctcccggcgctccccatgcacctgccgggctgcgcgccagccatggccgacgggagcttctcgcttgccggccacctgctccgcagcccgggcgggagcacctcgcgacttcacagcatcgaggccatcctggggtttaccaaggacgacgggatcctcggcaccttcccggcggagcggggcgcccggggcgcgaaggagcgggataggaggctgggcgcgcggcccgcctgccccaaggcgcccgaggaaggctccgagccctccccgccgccagccccggcgcccgcccccgagtacgaagcccctcgaccctactgccccaaggagcccngggaggcacggccgagcccagggctgcccgtcgggccagccaccggcgaagcgaaactgtcagaggaggaacagcccaagaaaaagcatcggcggaaccgcacgactttcaccacgtaccagctgcatgagctggagcgcgcgttcgagaagtcccactacccggacgtgtacagccgcgaggagctggccggcaaggtcaacctaccagaggtccgggtccaggtgtggttccagaaccgacgggctaagtggcggcggcaggagaagctggaagtgtcctccatgaagctgcaggactcgcccctcctctccttcagccgctccccgccctccgcgacgctgtcgcccctcggggcgggcccgggcagcggtggcgggccggctgggggcgcgctgccgctggagtcctggctcgggccgccgctgccgggcgggggcgccacggcgctgcagagcctgccgggcttcgggccgccggcgcagagcctgcctgccagctacacgccaccgccgccgcctccgcccttcctgaactccccgccgttgggccccggcctgcaacctctcgcgccgccgccgccctcctacccgtgcgggcccggcttcggggacaagttcccgctggacgaggcggacccgcgcaacagcagcatcgcggcgctgcgtctgaaagccaaggagcacatccaggccatcgggaagccgtggcaggccctctaggggcactggggaacgtcttgggatccgaccccgggccgaccgcaccgtacccgcatcctctctcccagggacaacccccctccccagctcggcccctctttccctgtcgcctgcagccacccgccaagcatagttcagggccacgcgcctgctcccgatgcacggggagaagggcgactttcaggcctgaggagaggccctctggccgcctcaacgcacttcgcggacctcagccctgcagctggagggcaacaggctgccgggccccgctggccacgccgctcccatcaccgcaggcgctggagcctccaggcccaaacaggctgaagctcctaaacttggccattcccaggaggcttggagacccccagataaccataacagggaagcaggggaggcggaaaaatagagtttgagaaacttttgtataagtagtttcaaactatttgagaggagaattaaagacatgcttgttttgtttcg

SEQ ID NO: 256301 - DNA, 2007 bp, Homo sapiens
  misc_feature (623)..(623): n is a, c, g, or t
  misc_feature (647)..(647): n is a, c, g, or t
  misc_feature (713)..(713): n is a, c, g, or t
  misc_feature (802)..(802): n is a, c, g, or t
cggctgggactaaggcggcagcgggctgagcgctcggccacccccagcgtgcgcagcccgggcgggcttcgcccgcggagcttgacctagggtcgggacccgtcgggttgcaccgccgcactcgggaagacccggcttcgagcctctcctctccgtctccaaagcgccctcccgcctcccggcgctccccatgcacctgccgggctgcgcgccagccatggccgacgggagcttctcgcttgccggccacctgctccgcagcccgggcgggagcacctcgcgacttcacagcatcgaggccatcctggggtttaccaaggacgacgggatcctcggcaccttcccggcggagcggggcgcccggggcgcgaaggagcgggataggaggctgggcgcgcggcccgcctgccccaaggcgcccgaggaaggctccgagccctccccgccgccagccccggcgcccgcccccgagtacgaaggtgagtgcgcaccctggctgtgcgaggccgttcgggcgcccgagcttaggagttggccagacgagagcgccccttccttaacttttattaaggcaactgggcgcggggttggggaccgtctatggcgggagttccaatttgcancagagaaagcttaggacccatcgncgccctcaccacggacctccccgggccatctcggccaggcgggctggccagtgcccacagcgaggnggggtcggcccaagggtgttttggggagtgcatctgactcccgggcctcgtcgccccagcccctcgaccctactgccccaaggagcccngggaggcacggccgagcccagggctgcccgtcgggccagccaccggcgaagcgaaactgtcagaggaggaacagcccaagaaaaagcatcggcggaaccgcacgactttcaccacgtaccagctgcatgagctggagcgcgcgttcgagaagtcccactacccggacgtgtacagccgcgaggagctggccggcaaggtcaacctaccagaggtccgggtccaggtgtggttccagaaccgacgggctaagtggcggcggcaggagaagctggaagtgtcctccatgaagctgcaggactcgcccctcctctccttcagccgctccccgccctccgcgacgctgtcgcccctcggggcgggcccgggcagcggtggcgggccggctgggggcgcgctgccgctggagtcctggctcgggccgccgctgccgggcgggggcgccacggcgctgcagagcctgccgggcttcgggccgccggcgcagagcctgcctgccagctacacgccaccgccgccgcctccgcccttcctgaactccccgccgttgggccccggcctgcaacctctcgcgccgccgccgccctcctacccgtgcgggcccggcttcggggacaagttcccgctggacgaggcggacccgcgcaacagcagcatcgcggcgctgcgtctgaaagccaaggagcacatccaggccatcgggaagccgtggcaggccctctaggggcactggggaacgtcttgggatccgaccccgggccgaccgcaccgtacccgcatcctctctcccagggacaacccccctccccagctcggcccctctttccctgtcgcctgcagccacccgccaagcatagttcagggccacgcgcctgctcccgatgcacggggagaagggcgactttcaggcctgaggagaggccctctggccgcctcaacgcacttcgcggacctcagccctgcagctggagggcaacaggctgccgggccccgctggccacgccgctcccatcaccgcaggcgctggagcctccaggcccaaacaggctgaagctcctaaacttggccattcccaggaggcttggagacccccagataaccataacagggaagcaggggaggcggaaaaatagagtttgagaaacttttgtataagtagtttcaaactatttgagaggagaattaaagacatgcttgttttgtttcg

SEQ ID NO: 256302 - DNA, 603 bp, Homo sapiens
gggaagagaatgtatttcttttgtttatatgaccaagctttctgagaaattttaatttggtgtacaaaacttttagtagttagtgaatgagtaagatgatttgtgtattgtgcagtttggctttaagagcaaaggagaacttagagactatgggttctagatgctgtgtctgcctttcacagtttctctgaactttgtgattgaactggattcatattggagttatatatcagacaaaaaccaaagtcattgggcacaagcagaataagtccaaattaaaagtataatcatgagtttgttaaataatgctttatatacttctttaaaatatacttatttaatattaaggatttttttttccttgaatccatataatttgaaaggtctaaggggaaaaacttgttttgagccactttatgatgtgaattcacttcataggaaataacatgcttgtttttaatgtactttaaccctttaaagtacactggaccaaattttagagagcatatacatagtgttataaaatttttaaagtagttaatttttatattctcgattatcaaagcaaaatcatttaactttgaaaagctcttatacttgttt

SEQ ID NO: 256303 - DNA, 678 bp, Homo sapiens
aaactcatttttttaaagtctgttttctcttcctccattctaattctgttctcagtgcagtgaggatgaagttcgacttcaccctcatcattctaccaaactcttcaggtcaaggtcatcggtgactttccacactagcaaatccagaattaaagctcagtgctcatctttatctatcagcatatccatgacatacttgatcatttcccctttatgaaacactttctttactttgattctagaacactgtttcttatttattcttctttcttactatttgtattctctcagtctcctttgctggttcctcttcatcttctcaacctctaaatgttgaaatgcctactttcaaaccttatttttttatccactgcactcactttctacgggatctagaaataccatttttaagttggctcacaacaaatacttcagtgtctttaatatgccagtcactgttctgcatgtaagggatacattagtgaataaaaactctctgccttagtggcttatagtaatagccattttattatatctagtgttttataggtgaggcatttgatacgggctcagctggatgatttgcctctgcttcatgatgtctggggcctcagctagagtggtttaaacccatctggagatgactgaagctgtatgtctaggtcctctgttctccat

SEQ ID NO: 256304 - DNA, 686 bp, Homo sapiens
ggggaagggggtttgaggccttctggatggaaggcaagggttctgccagctactctgggcacctagctgggtgtctttgcacctctattcctatggaaggggggttgaggccttctggatggaaggcaagggttctgccagctactctgggcacctagctgggtgtctttgcacctctataccctagggaaggggggtttgaggccttctggatggaagggaagggttctgcctactactctgggcacctagctgggtggtctttgcacctctatccactggggaaagggggtttgaggcattctggatggaaggcaaaggttctgcttgctactctgggcacctagctgggtccagagagcagggtggcattgacagagcaagagcctcccagtgatatgatctgagccacaccgtcttgtttactgccatctgcctgaagactgtgcttaaggaacaatttctttgtcaaaacacacgacagagagcctgctttggccccaggcttctgtttcataactcttttttattggagcagaaagaagcagcacattattgttctcttgctccgcgttttctcatggatcaagaaagcaacaagcactttgtgcaaatagaaaagcctgctttgttgtctgaagacaaggaggtgaggttgtaagaagcagagctttcacagatcataa

SEQ ID NO: 256305 - DNA, 346 bp, Homo sapiens
tgtagattcctcagaatcatcaagtagagtctgaatatgcatatctgtccccaggcttcctctgttttgatttgtaacagaatttcaggcacaggaaagataaaaatctgctttttatttgtaatgaatttgaaaggtctttgtgcaactctcatgattggtgaaatgttttctgtaattatgtattccgagagttcacatattctggaatagtgttcccctgttttgcctaataagattcacacatggcatgtgattccaaggctctgactcagaacaacgcatcatctccagcgggggagggtcctgagagttgtggttttaaaactagtgccccaggtgattc

SEQ ID NO: 256306 - DNA, 189 bp, Homo sapiens
agagaagtgtactttaaatatgaagacatatgttggttaaaagtaatgggatggagaaagatatgtcatgctaacgtaaatgaaaagaaagctggagtggctatagtaatcaaagtagatttcagagcaaagactatgaaagataaagacagtcatttcataatgataaaagtcaattaatcaagagga

SEQ ID NO: 256307 - DNA, 349 bp, Homo sapiens
gaatctgtattttttttaccttcctgtctgtctcctttttggttttgtctgtatcttctacatctgtccatgttttttatcatctcctccatctcccccttttctccctccttttcctttttgattatcatcatcactactctctgccatatgtagaccaaaaagcacgcatatcaattaaggatttgaatgtcagcaatagaaatcatcacatgttgtcttaggcagaaaaattttgcatcaaaaagttacaaggtgctcacagaattgactggcagctaaaggaccaggcttcgaaaaatgcaggaaaaactgtatagaaggttccacacaggaaactaatcaattt

SEQ ID NO: 256308 - DNA, 438 bp, Homo sapiens
aggaatatgaaaagattcttggaacataggcaagtattacctcaaaccggacaaagaatgtactgatgaacccgcaggatgacaacgagaggatcaactcagctctgccttagcttctccgcagtgccctggatctgggctagtagtcatgcaggctctagtgagggcttggggtttctctcccacatgatttctgcatgcctctcccactcctctctttgccctgggatcttactttaatctctgggagcaaaatctctgtcaaaatatatctgaatctttttatgtggggctaaagtcagtggttttttggagagttaatggttgaatatttgtcaccctgattttcttcagtctactctgtataactcatgtctattcatttgcacagtctgggatcagaaactaataattcgaaggattgtccaaccacaaaac

SEQ ID NO: 256309 - DNA, 493 bp, Homo sapiens
tgagacagagtctcgctctgttgcccaggctggagtgcagtggtgtgatctcggctcactgtaacctccgcctcctgggttcaagcgattcgcctgcctcagcctcccgagtagctgggattataggcgtgagccactgcacccagcctaatttatttaaaataaaatatatattagtaattaaaccacacataatctcatttagtatatccttaggaattcccggctttagaacttttctgaaacaaaaagcttatttctcctattacaggaatctcaaaaaatattttaatggcataaaagataattcaaataaaaagctttattatacaaaaaatatgtctattttctgattaatatcagtctgtctagaataataacaattatcattattaagctatgtgaatatcagaattacttaagttattcaattatttaatatttttcctttctttctgaaggcaaaggtacttgatagtgaactgggagtggc

SEQ ID NO: 256310 - DNA, 442 bp, Homo sapiens
cgcccacctcgacggccatgttcgtgggtggggagaggccagcccgaccctcggacggcgggactcgcgggctactttagggttaccaatgatcctgatctgcccaaggctgaggagtttcccaggatatgggactttcactgctaaaaccaggatagtcccatgcaaagcagcatggctgatcaccctacttgctgccatgagactaccaccatcctcgaggatgatagatcccaaggagagagtgacccagtcaacatccagccccatcagcatgtgacttatccagccccagtccagtcaccagataatagcaaatgcatgagttaattcaggtgagaccatcagaacgatctagctgaacttgtctcaaattgctgtcctctgttggagtttttctgcacataaaaaataaaattgctgtcctacataactgtaaaaa

SEQ ID NO: 256311 - DNA, 420 bp, Homo sapiens
ggaaagacaaatggagccaaactacctgggttcaaatcctgactccaccacacgctacggttaccaatgatcctgatctgcccaaggctgaggagtttcccaggatatgggactttcactgctaaaaccaggatagtcccatgcaaagcagcatggctgatcaccctacttgctgccatgagactaccaccatcctcgaggatgatagatcccaaggagagagtgacccagtcaacatccagccccatcagcatgtgacttatccagccccagtccagtcaccagataatagcaaatgcatgagttaattcaggtgagaccatcagaacgatctagctgaacttgtctcaaattgctgtcctctgttggagtttttctgcacataaaaaataaaattgctgtcctacataactgtaaaaa

SEQ ID NO: 256312 - DNA, 219 bp, Homo sapiens
accgctagtctgtgaaagatcagttgccacagtttttggtttccacatatgtaaagattcgtcataattagcaagttcacccttagtaggctgtatcacctcttgttccccacatcccagatttcagtccgtccttggctctcggatgggaggccactctgattgcagccacagttcatgccccacacagacattcactgagcctctgcccagcgttct

SEQ ID NO: 256313 - DNA, 562 bp, Homo sapiens
cgagccctgcaatccctcccgagggctacagacctgagacgggctccaggaaaaggagggaaggctcgccccgacaccgacccgggcttccgcggtgtgagccagtttcagcgaggagctagttggttatgaccggaacgtgccgtaggtggggtgggggaaatagcaaaaggcgaggttggagggattgaaaaatgcagacggctgcgtggggcttgcttaggtgcctggagtttattctttaggcaacagggaacctttggagggctttaagcaggaagtgataactgatttgtgttatttaaaaaaaaaaaaaagtcactctggcaaccttgtggtcggaaatgaaaccagaagaaccctcaaggctgcaactttcatttttatggtgtcattttgatgctaaccacaagccaggaagcaggacagacaggcaccgaggccttttgaaaggtgaacaccctgaagcccagagaggtgacacacgtcattgcattaggagcttttataaaagtaaaaatgaagtaaaataaaaagcttttgcttatcaagattttaccat

SEQ ID NO: 256314 - DNA, 299 bp, Homo sapiens
cctgtagacattgtgcatcccccaatgcctttccccttaaaaaaaattatattctaatccagtccatcaaataaagtctacgttcattagaaacatattctcttggtttttataatttcagtttttttcagacacagatagtgcatatgcagatttgttacttttgtacagtgcaccctggtagtgagcatagtacccagtaggtagttattcagcccatgctcccctctttcccccacccccgtagcctgcagcatgtcttgttcccatgttaatgttcctgtgtgctcagtgtttag

SEQ ID NO: 256315 - DNA, 391 bp, Homo sapiens
tagctcatcatgtatcattaatgttagtgtattttctgtgtggcccaagacatttctttttccagtgtggcctggggaagccaaaagattagattccccggaattatagcacactgtccctaaggcgtggggtggctcagcagggcccacgatctcctctggggaccccgggccagggatggaggtctccttctgcctggatgtcacatcgcagattctcactgtggggtttggccccctcagacacagcttttgagagaactcgactcccgtctctgctctgcacagcccccctccctggccccattcacaaaccattccctatacagcctctccattccagctggaggagtctgaaccctgcctccattgtgtgcatgctgtgtggcct

SEQ ID NO: 256316 - DNA, 454 bp, Homo sapiens
tttttaaagcagctgactttttatccatcttctcaaagtattcagcttcattttcacagaaatgataattctcatctctcactcaaattttatgtttgcataaattttcatcaaacacataattacagtaagtttaactggaaaaaataagagagactctactgttaaaagcaaaaaggcccaggcttctgaagagacgcgccttctcccctggtgtttgtcatggcaccagccaacacagcaagatggagccaccagtccagccagggagcttctgcagtgtttcaaacaaggcggcaccagcacagaaatccacaggccctgcagtgggaagggatgaatgagtccccaaaaacagatccaaataaaaataaggacggagaaaaggaaacaccaagctaacaggaaggggtgttctaagacacaaagagctatttggaaaacatcacataag

SEQ ID NO: 256317 - DNA, 459 bp, Homo sapiens
ccaaaaagactgcaaataagagtttgataaacagaaaacaacatgacaatagtttctgggtaactctttgaacttgttaggtacagcatatactgtccttcacacacctgctgtattttgagaatctgagcttatcgaaagccacacggcatcagtggaactgactagctgggtgactgcatgcaagcagttagccactctgcctcagtttccctaaaaatacaatgaaatggatagtcagttgagtggtcctcagacttttacatcttatagtatggaagcggacatggatttgctatatttcatttttctgtgtaagtacattaaaaatcaaaactactgcctactattaccatctttcatgaaaaaaaatattttttagcctgaaagcattgagacgaacataacctcagagtaagcgatggtccttgaaaagtgaataaatttaacggtttggta

SEQ ID NO: 256318 - DNA, 433 bp, Homo sapiens
aagtatctaacatacaggcagatgccaaaacaaacatacaagaaaaaaaattggggggaaaaacaggatatacaaaaagaagataacttaaaaaaaacaacaacccattcttaatctcctcagggagatataagaagatgttatatggccttaaaaggacattcaaagggtccttcagagggcctcactctgtcaccaaggctggagtgcagtggcaccatcatagttcactgcaacctcaaacttctgggctcaagggataattttaaagaacttttttgtagagacagggtcttgctgtgttgctcaggctggtcttgaactcctgggctcaagcgatcctcccacctccccctcccaaagtgctggattataggagtgagccactgtgcctggccctccttgttaattctgcactgagtttacttaactt

SEQ ID NO: 256319 - DNA, 249 bp, Homo sapiens
cttatttatgaagtaatatgaatttaaatgttgaagggaagaagactgcttctgtgtatttgagattagtgcgctacttccatgtatctgaaattgtctggtattttagtatggtctagaatgagggctgtaccagaggataagctaaaaagagccatgttttaagactagaggttctaaaaaaaacaatttaacagcatggtggcaagagggcctaggcataacaatggaaaatttagtctagaacta

SEQ ID NO: 256320 - DNA, 167 bp, Homo sapiens
agtcttctataacacagcataatcacatgcgtgatatcccatcgtattcccaggtcctgctcatcttcacagagagattatatagggagatacagcagggcttgggaatcttggaggtcctcttacaagtctgacacagagaggaattctgataggaatttatggtc

SEQ ID NO: 256321 - DNA, 593 bp, Homo sapiens
atgcttcaaaatttttttagagaatgcagttttaataatttgcctctaaatgttagttataactactgtccctcagctattcattcatttgcttattccatcaacaaatatttattcagtgtctagtatgtaccagaaaatacttttggcatcaaggatgtagttgtgaactttaaaggtagttttctttctacttttctggtacctatatctaaagaagaacctgaaaagtaagatgaatgaatgaatgattggtcaaataaatgaatgaataaacaaagagaaataagataatgagaaaaataaatgaggtactatgataaagaatcatgaccagttaatattgggagggcaaggaagaggaggtgtctctgagaaagtgagacataaaccaagaccttagtgacagtggaatgtaaccatgctaggagctctggcaaggatatagtaggcatgaggctcagcaaatccaaaggccttaaatttcaaacaaatttgggggtcttcagaacataccaaagtggagtctaacttgaccaatgcaaagaccagggctagtgttataacatgaggttggaaaaggaggtaatggc

SEQ ID NO: 256322 - DNA, 398 bp, Homo sapiens
attgaacaaaagttatgaaacattatccaagggatggccgcttgttttctggtgcatggatcgcattagcgccatgtcttacagaagaagtgctgtgaggtttgatccttgccaagtgcctgctgtgtgataaatagcaagtgtccagtgcttggccaaaaataaaggaatgagaaatagataagtacagtcttctcaagtctcacagtctgttagggagacccctgcacagacaggtcactggatattgcatccaatggtagcacaaagaaggagtagtgttttcaggtaaatttaggagaacagaatcttacgtgaatgacagcagctctggcaaaagcatggaggcctgaacccacagcatttgtgagctatcagactgtgccatgtggctagta

SEQ ID NO: 256323 - DNA, 433 bp, Homo sapiens
taatattagaaacatgacatatcagaatttgagggatgcagctactaaattactgaagcaatgctgtatggctatacatgtttgtattaggaaaggagaatagtgtagtctgtggtctaagtctcctacttaaaaagcaataaaaataatactaaattaaacccaaagcaaatagaaggaaaaggtgatgataaagagtggatattcacagaatataaaacatgaaaacaatggagagaattataaacttctagcaagattatttagaagaatactaatagcaggaagaaggaaaaatatcactatagatgttctggcattgtggaataattgggggatacaaaccattctctgtattcccaggttctgtatctgtgtatcaactaactataaatggaaatagccaagaaaaatataaaataatgcaataata

SEQ ID NO: 256324 - DNA, 639 bp, Homo sapiens
tcccttaagtccttgtttcttcaggtctttggatccaatttgaagaagcaggaattcctttatgataccatctctcaaactgaggttctcctgttaagcaatcagggcctcagacagatgacttctgattgaaaatacgtaataaaggaaaacttttaaagaaaaaaaacacccaaaattccactgtcctcataatttttagctttttcataatgctatcaaaagtctcttgtttcttgttcgcatacttagataaaattttacttagttgaaacttactgtacatatacattgtatatcaaaattttaacatatttgtcttatttttaataacaaaaatgtcaatgactaacactgatgtaatcttgaaaaagcatttaaatagaatttctggtttctctcataaaatctatatggatttatgctgtttgaaacagtacgcactagccatacatggctaatgagcacttgaaatgtggctagtatgaaatgagatgtgctgttaatatgtaaagtatacctggatttgaaaaaagtataaaatatctcaataatttttatattcattatatgttgaaatattttgaatatattgatttaaatacttaaacatgaaaattattaaagaaaatttacctt

SEQ ID NO: 256325 - DNA, 460 bp, Homo sapiens
ccaggctggagtgcagtggcacaatcttggctcactgcaacctccacctcctgggttcaagcagttctcctgtctcagcctgctgagcagctgggattacaggccggtgccaccatgctcagctaacttttctactttttttttttaattattatttttttgagacagagtctcactctgtctataaggagtgtatgtgttatatacatttttagttttagtagttactgaagatattaattataacatctatttttgactgatttaaatctattattatttagtaaagtctcctcctaaacaatgcaaagaccttagttctctttaacatcatttatcttcattctgatttatatgttcttaacatattttaatttttaattttttttttttttgagacggagtctcactctgtcgccctggctggagtgcagtggcgcgatcctggctcactgcaact

SEQ ID NO: 256326 - DNA, 434 bp, Homo sapiens
aatagataggacaatctcctagctctcctccaattgagaaaacactccaattgggctttgctttaaactttgtgttcttaagtgatgtcaaagccatttccagcttaatgttctgtgggtaccttgggggccattcatgcagggagcatggccaggcagggtatgagtacattgtttctgatttctttcatacatcagggttcctcgggaaatttttgtattttttttttaagtcctgctgctttaaaaatttgaaagtggctcattaaactaaacaggctaatgtaatttgttgcttatgccaagcctagactgttgagaattgacgtttttaaagattatcaaatacctcagtaggtaaaatgagcccatgatcttccactgagtggtgagcatactcccagcccatggacaaggccggaagagacaggctt

SEQ ID NO: 256327 - DNA, 439 bp, Homo sapiens
aaaaagaaggaaaaaaaaaaacccactcacaatctaatgccaatggagagaatggtattttaatctacgaaactgtaatgaaggctcttaaacaatcccactttccataattgaggctttcaaaagggccaggtagctggtggtgtttgtattaacatctcataggctctggatcattcacagccacgtattgatctatgtggttttgacgtttaaattttaatgaagcagccttagtggggaagaaaacagctatgcatgtgcctggtaagggggaagaggacctgttcattcctgtttctaagccagcatcttaagagtaggtattacctgtgtgtgaaatcaaagtattttaaaattaactctaggaagaatgttggattttcctgtgttgttttcagtggttggagaaagggtttctggagagaaaaaaaaaatt

SEQ ID NO: 256328 - DNA, 405 bp, Homo sapiens
caataagcatctacagagagctatgtccagagtcctaggctaaaagacaagaaggctattgagttaataatctaataacaaagatactgtggctgaagtccagaaacttaatgatgtgtgtctgcagtcgggagcttggttctgtctgtgtgggttgagcacccaccccatccaggcccagtacaagggaatgccaatacaattaagacacagatgccagcatgacatttacacttggcagaaggtaacagatgtgtgagaagtacttccctcttcctgccagtcaaaggaaggaaattccaccaggtggtgtgagcactgaccgcaaaccggtacacatgcctccaaagttgttaatcctataggcctcgttgaaatgcatgtattaaacatgttctatttata

SEQ ID NO: 256329 - DNA, 375 bp, Homo sapiens
cttgagcccaggagttcaagacaagcttgggaaacatagagagactctgtctccattaaaaaaaaatgtatatatatataatattagccaggtgtggtagcacatgcttgttaatcccagcttccaagctacttgggaggctatagcaggagtccaagagttccagcctgggtgacagagacagagtgagaccctgtctcaaaaaaaaaaaaaggcataaatcagccaaacattcaatccagctgagttgaggattttggtttttgtttctgttgggtatttataagtaaagactatcagaaaactggaaatgaaagttagttagtatctcagactacactctgcaccaagtagtttgcttaagaatcgacttca

SEQ ID NO: 256330 - DNA, 583 bp, Homo sapiens
cagcacaaactgaccttttgggggaataattagcaaaacttgaatatgaactagatattaagggcttaagtatgacatatgtaagagaatgtgtttacttttaggagagacataaacgaatatgacaaaaaagctaacaaccacaatatccaaatgaagtatacaggtgtttaccgtaatattctttcaatgtgtatgtctgaacattcttcagttgggagtgatgtgggagaatgaagtcactttaaaaagtgggtgaggacggtgaccaaaatgttcagttgtaaggaaccaaaaaacagtaatagccgattctactgacaggtgtaacaaagaaacacactgaacttaaaccaggttcctatgacacatatactggaagatggagccaaaaaagagagggcatcattttactaaacaattcctatcctcaaaaagtttaaaatatcaaccaaaactctgctgataaaaccttctgaaatacacccagtatctatcattttctcaagagaagaaggggctattaaagatataccatttttcctcaattataatgattaagatgtatggaaaactttgtaat

SEQ ID NO: 256331 - DNA, 546 bp, Homo sapiens
gacactgtggaaagttgatttctattaattgggatctgttcctagcacatactaggctatgtgtgcttgatggaacagttagctgtagagatgtgatttagcaaagttggttataaagtgggtttttgtaaattgtttccttattactgttctttgtagaattgaagatgtattctctcccagcaaaatagttcacctgcagatcattgaaaagtttggctgaagaaaggggttattttggtgtgggggtaggaggcttctgtgggctgggcatggtggcttacatttgtaatcccagcactttgggaggctgaggcaggaggatcacttgaggccgggagttcaagacttgcctgaccaacataatgaatctcccatctctacaaaaagaatcagccaggcgtggtggcgcacacctgtagtcccagccactcaggatgctgaggcgggatggtctcttgaacttgggagattgaggctgcagtggagcagtactcgtacccctacactccagccttggcaaaagagggagatcctgtctcaaaa

SEQ ID NO: 256332 - DNA, 395 bp, Homo sapiens
gaaattttattgtatagataagtaggaagttaaaacctaagaaaatcatcaaatattaggggtgcttctgaattgatttatctgcagtttaactacttagcatttatggaaggcagtttacaaaaagccatagaggtttatgataagctggtcaagtaattagttgaatagattttataattctttgcacttctcatctgataataactaccgtataggtagtagacttgacagtagttcagtattttctgttaacagagttgtgtttataacaattacagtcaactactgtggttcttcagttgcacagagtagcttttggcaaaagtgaaaaaacctacaaccaacctacatctttttacctaggagaggggccaaggagaggggctctcaaa

SEQ ID NO: 256333 - DNA, 881 bp, Homo sapiens
gaaattttattgtatagataagtaggaagttaaaacctaagaaaatcatcaaatattaggggtgcttctgaattgatttatctgcagtttaactacttagcatttatggaaggcagtttacaaaaagccatagaggtttatgataagctggtcaagtaattagttgaatagattttataattctttgcacttctcatctgataataactaccgtataggtagtagacttgacagtagttcagtattttctgttaacagagttgtgtttataacaattacagtcaactactgtggttcttcagttgcacagagtagcttttggcaaaagtgaaaaaacctacaaccaacctacatctttttacctaggaggaataatattgagttcttaataacagactatacttcattatagcctgtgtgtgtgactagctaggttgaaatgtactgtgcatgataagccttgtaaagcaagttatatgttgaaattagtatctttggaagtgtagatagatagctggagaaaaatgtaatgatttggagcttgtactccagaggggaaaatgtatttcccgtgtttatagagaatagaagaataatgggcaggggttgaatgtaaagggaattaagggatatcttagaatggagaagaaaaggaatagattttgaaggaaaatagcatacacattccgtactcagtcacatttggaaaatagggaatataaaatttactccaatattaactgttaaaagggtaaagaggatctttagttggaaaactgttctgattttgttgttctttcagttcagacttatttcagtactttggtttgttatgaactttagaactattgtggagcaattaataaataactcttaacaga

SEQ ID NO: 256334 - DNA, 845 bp, Homo sapiens
gaaattttattgtatagataagtaggaagttaaaacctaagaaaatcatcaaatattaggggtgcttctgaattgatttatctgcagtttaactacttagcatttatggaaggcagtttacaaaaagccatagaggtttatgataagctggtcaagtaattagttgaatagattttataattctttgcacttctcatctgataataactaccgtataggtagtagacttgacagtagttcagtattttctgttaacagagttgtgtttataacaattacagtcaactactgtggttcttcagttgcacagagtagcttttggcaaaagtgaaaaaacctacaaccaacctacatctttttacctaggaggaataatattgagttcttaataacagactatacttcattatagcctgtgtgtgtgactagctaggttgaaatgtactgtgcatgataagccttgtaaagcaagttatatgttgaaattagtatctttggaagtgtagatagatagctggagaaaaatgtatttcccgtgtttatagagaatagaagaataatgggcaggggttgaatgtaaagggaattaagggatatcttagaatggagaagaaaaggaatagattttgaaggaaaatagcatacacattccgtactcagtcacatttggaaaatagggaatataaaatttactccaatattaactgttaaaagggtaaagaggatctttagttggaaaactgttctgattttgttgttctttcagttcagacttatttcagtactttggtttgttatgaactttagaactattgtggagcaattaataaataactcttaacaga

SEQ ID NO: 256335 - DNA, 474 bp, Homo sapiens
ttgccaggggagctaacattcttccgagaaaaagcagaatgagagagagatatgcagctgcagtggaggacttggaagagaacaacgccaggtcctggatcctgcaagaatctcctctggaaaagcaggggagagaaaagcaaggaaggaagcagggtcaccgcaagtgtgggatttgtcttattaaaatctgatactgtgtggcagtttgcttcactcttggtataaaatgtctgagctccatgttaaagtaaatgtaagtaatataaatctgcctttcctgaggtgaaaatagatccatattatttaaaatatgaactgagatagatgacagttacaaacattatacttgttcttattataattcttactaagctcaaggaataaaaactgggatgatgaaaaagaagttctgaatgtaaaaattggtgttttggataaaatacaaaccaacccagaaatgatgaaaaaaat

SEQ ID NO: 256336 - DNA, 438 bp, Homo sapiens
cacaacatctttttgtcaagctgtcattctgtctggaaaacaaattaaaaaaaattgtcactatttaataggaagaaaaatgaaaccaaataatcagtgcctagcatatgatagagatacagcaaattctggaaaaaaagcaaacatatgctgggactacaaattttagtattaacaatatattaatttgcagaacagatagtggttggccttttacatttctgacgtttacaatatcttaatttctgatcacctcacataagctcatttgatctcttattgttgcagtggagtttagaagtttgaattttgagatgtggatgacatatgaagttatgagatagatgaatataggtgctggagctaaagaaataatagaaagcttggtgaactgtagttgactacaaatggacactggttctggggtgaataggaagt

SEQ ID NO: 256337 - DNA, 3132 bp, Homo sapiens
acgagatggaaggggatgttcaaagcccctcccttgactctgaacggacccccagggaacatgcgaccctctctctggcgacgcctcccacccaccactaatacttgctcctggaccggggggcgcggaggttggagagaggaggcaggtgtctgcatgctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctg

SEQ ID NO: 256338 - DNA, 3038 bp, Homo sapiens
gtctggagctccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctg

SEQ ID NO: 256339 - DNA, 2585 bp, Homo sapiens
  misc_feature (2458)..(2458): n is a, c, g, or t
  misc_feature (2552)..(2552): n is a, c, g, or t
gtctggagctccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcaggtgagggggcagggcggactgcaggctccgccctccccacccgtcaatcagcgggtgtcccacttccgccngggctggctgtgcaaccttgggcaagttactcaacctctctatgcctcagtctcctcaactgtgaaatgaggttgataacagtgcctatctcgnggagttgtgataattaaatgacttgatttacac

SEQ ID NO: 256340 - DNA, 821 bp, Homo sapiens
  misc_feature (31)..(31): n is a, c, g, or t
taagctatgtctaggtacgaggctgggtgtnaatcccttactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaaggtgagttcctgtggtccggccac

SEQ ID NO: 256341 - DNA, 3430 bp, Homo sapiens
gtctggagctccagacgcctcggcaagagcccgctgcgccccctgcgcgctcctcctgctcggagcacggctcctacctgtagagtccggacgggcgctccctccccgggcacctacaccttctcctctttcggaaatctcccatccagctacccgggtctcggacaggcggcactgggaccacgaggcagggagccaggcttgaagcaggtgacatgtagacgtcccctggtccagcctcggaacctgagcgcccttctgcctggaaagtttgtggctaggcgccatggccaagagcagctccctgaatgttcgcgtggtggagggccgcgcgctgcctgccaaggacgtgtctgggagcagcgacccctactgcctagtgaaagtggacgacgaggtggtggccaggacagctactgtctggaggagcctgggccccttctggggggaggagtacacggtgcacctgcctctggatttccaccagctggccttctacgtgctggatgaggacactgtcgggcacgacgacatcatcggcaagatctcgctgagcagggaggcgattacagccgacccccgagggattgacagctggattaacttgagccgagtggacccagatgcagaagtgcagggtgagatctgcctgtcagtgcagatgctggaggatgggcagggccgctgccttcgctgccatgtgcttcaggccagggacctggctcccagagacatctctggcacatctgacccatttgcacgtgtgttttggggcagccagagcttggagacctcaaccatcaagaagactcgcttcccgcactgggatgaagtgctggagctgcgggagatgccaggtgccccgtccccactgcgggtggagctctgggactgggacatggtgggcaagaatgacttcttgggcatggtggagttctctccaaagaccctccagcagaagccacctaaaggctggttccgcctcctgccctttcccagagccgaggaggattctggggggaacctgggtgccctgcgagtgaaggtacgcctgattgaggaccgcgtcctgccctcccagtgctaccagcctctcatggagctgctcatggagtctgtgcaggggccagcagaggaggacactgctagccccttggctttgctggaagagctgaccttgggggactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaaggtgagaccccaccgcgatggggagcagggggcgtccctctgttcccacccgccccctgatcgcctcccacccgctgcagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtaccctcaggaagaaccaaggctgggtgggggtccagtgtgccaaactcagacccttggagcctgggagaccttgggccaggctgtttatctctctttgggtctcagattaccctgtataaaaagaggagggaaagtct

SEQ ID NO: 256342 - DNA, 2285 bp, Homo sapiens
  misc_feature (31)..(31): n is a, c, g, or t
taagctatgtctaggtacgaggctgggtgtnaatcccttactgccgccaggaccttgccaccaagctggtgaaactctttcttggccggggactggctgggcgctttctggactatctcacccggcgtgaggtggctcggaccatggaccccaacaccctcttccgttctaactccctggcatccaagtcgatggaacagtttatgaagctcgtgggcatgccctacctgcacgaggtcctgaagcctgtgattagccgtgtctttgaggagaagaagtacatggagctggatccctgcaagatggacctgggccgcacccggaggatctccttcaaaggcgcactctcggaggagcagatgcgggagaccagcctggggctgctgacgggctacctggggcccatcgtggacgccatcgtgggctccgtggggcgctgcccgcccgccatgcgcctcgccttcaagcagctgcaccggcgagtggaggagcgcttcccccaggccgagcaccaggatgtgaagtacctggccatcagtggatttctcttcttgcgattcttcgcacctgccatccttaccccaaagctgtttgaccttcgggaccaacacgcggacccccagactagccgctcactgctgttgcttgccaaggctgtgcagagcattggaaacctgggccagcagctgggccaaggcaaggaactgtggatggcccccctgcaccccttcctgctgcagtgtgtctcacgtgtgagagacttcctggaccggctggtggatgtggatggggatgaagctggtgtcccagccagggccctgttcccgccctcggccattgttcgagaaggctatctgctgaagcgcaaggaggagcctgccggcctggccacgcgctttgccttcaagaagcgctacgtctggctcagcggggagaccctctccttctccaagagtcctgagtggcagatgtgtcactccatccccgtgtctcacatccgcgccgtggagcgcgtagacgagggcgccttccaactgccccacgtgatgcaggtggtgacgcaggacggcacgggggcgctgcacaccacctacctccagtgcaaggtgagaccccaccgcgatggggagcagggggcgtccctctgttcccacccgccccctgatcgcctcccacccgctgcagaatgtgaatgagctcaaccagtggctctcggccttgcgcaaggccagcgcccccaacccgaacaagctggccgcctgccaccccggtgccttccgcagcgcgcgctggacctgctgcctccaggctgagcgctcagccgccggctgcagccgtacacactcagctgtcaccctgggggactggagtgacccactggatcctgatgctgaggcccagacagtgtatcggcagctgctcctggggcgggaccagctcaggctgaaattactggaggattctaacatggatacaactctggaggcagacacaggggcctgtcctgaggtcctggcccggcaaagagcagcaactgcccgcctgctggaggtgctcgcagacctggatcgtgcccacgaggagttccagcagcaggagcgagggaaggcggccctgggcccccttggcccctaaggaaatgccagagctagcccggaaggaggagcaagagccagggggccctcttcagcgcatcctgccccgggagtctcctgtctccttggacctctttgattctgtggtttggaggctcccagagacgtgcctagtcctgtgtgccttgagtccagaactcagggcatggaagccctttggcaggggccagccttgcactgagtgaaacttgccctctggcttgattcagactggagtggataggataaggaacctgacttatttgactgagactggggtctctacttcaccaaactggcctctatccataccaaggaggccagcctggccctgagctgctggatacagctggacctgaattcctgatgcccatgtgatgttgttgccccagatgggcactaaatggcctcactccttcctgttttcatgtctgctaatccctataacctcactgattcttctgtaccctgcccttggcctaggactccaaccacaagcttccagaatcaggtaccctcaggaagaaccaaggctgggtgggggtccagtgtgccaaactcagacccttggagcctgggagaccttgggccaggctgtttatctctctttgggtctcagattaccctgtataaaaagaggagggaaagtct

SEQ ID NO: 256343 - DNA, 361 bp, Homo sapiens
gatggtgcctccctcttagggctgtgctcttggcatagtgcttggcacaaagccaactctgaggacatttggccaaatctgcttttgtaggattggttttgttattccattttccaggtgagaaaactgaggcccagagaggaaaaacttcctcggccagccggtgtggcttcctggtcaattccccatcctacttctctttgcaccacgaatttctagtccttgctgcctcagtttacgcagctgagaagtgggtttggggggctcctcttaccttctgctcctcccagcaggatgtgaagtacctggccatcagtggatttctcttcttgcgattcttcgcacctgccatccttacccc

SEQ ID NO: 256344 - DNA, 391 bp, Homo sapiens
aaaagattccctaccaagtaaagtttgaaaaccctagtataaattaatgtatataccaaaaagttagcatccttctccccaaaattacatattctcatttttggtgggaatatctttcaaactctttgctattatcttcccctctctaaatacagagctgaattatttagtctaattctgcaccaggaatgagacacactacactagtttgctaatttgtttcctagggctggcatgacaaagtaccatcatcatggtggcttcatcaacagaaatatgttattacctcacagttctggaggtaagaagtccaaaatcaagcaatctacagagttggtgcttctaaggggtatgagagaacaatttatttcaggcccatctccctctatgt

SEQ ID NO: 256345 - DNA, 568 bp, Homo sapiens
ctaatacatttggacctttaagtgacctagatcatcagtggaaacaaaggagagatactgattaaaattcaaggctccttgaagctagctggttgagtgtggaagccttaccttgacagtaaattctgttttctcaagttctctgagtagctcttttcttcttgttgcatcctccacactgagactggattggtcttcattaatagacccactggatttatcttccacaagcctgctttttatgttacctactttgttcctgaaaacattggagttggtgatgcagttcagatagtttccctttggctttaaagtatacagttctgggtatgtagaaagagtcaggataaggtttggtaaagtttgtcctctgcgtaggcagctgattttggacatgtttggactggaagcagtatctaggtgtggaaaatggggtcatatttaaatgaataacatcctgcttggaggttatggacaagtcttgagtgtgcgtgtgtggaaggaatttaggggtggttaaaatttggtataaaaaaaggtactgaagtctgcaactttgaaactcatc

SEQ ID NO: 256346 - DNA, 2174 bp, Homo sapiens
agaaattggagaagataaaactggacactggggagaccacaacttcatgctgcgtgggatctcccagctacctgcagtggccaccatgtcttgggtcctgctgcctgtactttggctcattgttcaaactcaagcaatagccataaagcaaacacctgaattaacgctccatgaaatagtttgtcctaaaaaacttcacattttacacaaaagagagatcaagaacaaccagacagaaaagcatggcaaagaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcgagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 256347 - DNA, 981 bp, Homo sapiens
tatctgtgatgatcttatcccgaacctgaacttctgttgaaaaaaaaaaacttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcgagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 256348 - DNA, 856 bp, Homo sapiens
ccctacacccctatgcggtatacttaaccaccacaaaagaaagattcagagtgtaccaatctctgctgtgaagccctaacgtgtaaactgaagcctggaactgattgcggaggagatgctccaaaccataccacagagtgaatccaaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcgagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaataaaaacacaacttttgaggc

SEQ ID NO: 256349 - DNA, 2447 bp, Homo sapiens
agaaattggagaagataaaactggacactggggagaccacaacttcatgctgcgtgggatctcccagctacctgcagtggccaccatgtcttgggtcctgctgcctgtactttggctcattgttcaaactcaagcaatagccataaagcaaacacctgaattaacgctccatgaaatagtttgtcctaaaaaacttcacattttacacaaaagagagatcaagaacaaccagacagaaaagcatggcaaagaggaaaggtatgaacctgaagttcaatatcagatgatcttaaatggagaagaaatcattctctccctacaaaaaaccaagcacctcctggggccagactacactgaaacattgtactcacccagaggagaggaaattaccacgaaacctgagaacatggaacactgttactataaaggaaacatcctaaatgaaaagaattctgttgccagcatcagtacttgtgacgggttgagaggatacttcacacatcatcaccaaagataccagataaaacctctgaaaagcacagacgagaaagaacatgccgtctttacatctaaccaggaggaacaagacccagctaaccacacatgtggtgtgaagagcactgacgggaaacaaggcccaattcgaatctctagatcactcaaaagcccagagaaagaagactttcttcgggcacagaaatacattgatctctatttggtgctggataatgccttttataagaactataatgagaatctaactctgataagaagctttgtgtttgatgtgatgaacctactcaatgtgatatataacaccatagatgttcaagtggccttggtaggtatggaaatctggtctgatggggataagataaaggtggtgcccagcgcaagcaccacgtttgacaacttcctgagatggcacagttctaacctggggaaaaagatccacgaccatgctcagcttctcagcgggattagcttcaacaatcgacgtgtgggactggcagcttcaaattccttgtgttccccatcttcggttgctgttattgaggctaaaaaaaagaataatgtggctcttgtaggagtgatgtcacatgagctgggccatgtccttggtatgcctgatgttccattcaacaccaagtgtccctctggcagttgtgtgatgaatcagtatctgagttcaaaattcccaaaggatttcagtacatcttgccgtgcacattttgaaagataccttttatctcagaaaccaaagtgcctgctgcaagcacctattcctacaaatataatgacaacaccagtgtgtgggaaccaccttctagaagtgggagaagactgtgattgtggctctcctaaggagtgtaccaatctctgctgtgaagccctaacgtgtaaactgaagcctggaactgattgcggaggagatgctccaaaccataccacagagtgaatccaaaagtctgcttcactgagatgctaccttgccaggacaagaaccaagaactctaactgtcccaggaatcttgtgaattttcacccataatggtctttcacttgtcattctactttctatattgttatcagtccaggaaacaggtaaacagatgtaattagagacattggctctttgtttaggcctaatctttctttttacttttttttttcttttttctttttttttaaagatcatgaatttgtgacttagttctgccctttggagaacaaaagaaagcagtcttccatcaaatcaccttaaaatgcacggctaaactattcagagttaacactccagaattgttaaattacaagtactatgctttaatgcttctttcatcttactagtatggcctataaaaaaaataataccacttgatgggtgaaggctttggcaatagaaagaagaatagaattcaggttttatgttattcctctgtgttcacttcgccttgctcttgaaagtgcagtatttttctacatcatgtcgagaatgattcaatgtaaatatttttcattttatcatgtatatcctatacacacatctccttcatcatcatatatgaagtttattttgagaagtctacattgcttacattttaattgagccagcaaagaaggcttaatgatttattgaaccataatgtcaatattcttttatttatatctccttagggttatagttctcttccttactatagatactattctttattctcttttccctcttccttcctccctcttctttctccttctccttcctctttttttatctttttccttcttccttttttctctttcgctcttcgccgttctctcctttctttttctcttcttttcctattctcatctccctcctttttttcctccatctcattgtcccctcttcttccttcccattcctcttttttttttctttatttttttatcttacaatataactt

SEQ ID NO: 256350 - DNA, 530 bp, Homo sapiens
caggtgtgagccccctcgccctgcctgtatgttaactttatatattttactttactgaattttattgtttgagtcttactgttgattctctggggttttccaggcattctattatatatgtgtacaaatagagaaagttttacttctactttttcaattcttacgcctctaattgttgtcttttacttaactgcatcttttctgatcttaacagaaatgtctctggtgtttccacattaagtaagatgttggctttagggttaaggtttatatattataagataattatttaaaattagccacattaaaaaaatttaatgttaaaaaaaaatccagcgattcctcatctcttgagtgtttttcattaggaatgggtgttatgggtgttaaacttcaaaggttttctagcatctgtggagataaccatgatgtttctccttagatgtattaatacgatgttttacattatttgatttttaagtattgaactgaacttgaattcctggaataaagctcacttgattatggta

SEQ ID NO: 256351 - DNA, 395 bp, Homo sapiens
acagctagtaagcagtggagctgggatttagactcaggtttgtctggctccagaatctatgcttatccccctgcaccatgccaagctccggagagattgcttttagtagcctccggaaatggttctattatcctagcttcagataagggaaaacagacacagacaggtacagatacgcctagatggtctggggaacctgaaagagtttgatttaggtttcaagagctcaagttctctgtcctaaccttcctgccattctccatggtctgtgcaccaatgcacgtggttcccattctgtaaaatctcaaaagctgatgcttccttcccatgacacagccttggcctggcttctgacagaacaccctccttccatggcctggcaggctccggaactc

SEQ ID NO: 256352 - DNA, 762 bp, Homo sapiens
gagcccttaccccgactgcttggcctaagggacaactgtgaggagggagccatttcccctccatccaaatcccaccaacattatagctgctgccatgtgggtttttgcttatggacatgtttttggggggtgatgcccatttctgtgataaataagttttaagcagttcatggggctcttcaaggccactcttaagtacactgctgacctttctagggatgggaggactggagttagcaactcaacaggtacattcaccataatctccatgtaataaataagagcctatgaaaagattaaataaatctttcctaatgctttttgactggcttaatcaataattaatcatctttagatgaggctgtaacttgtggagtagatataattggattagctgaaaagcggcagttgcggagctttgaagagattaaaatggctgtcaatcccataattaaactgccacaaacaaaagcaatggtgttttttagaaaggaggaggaggaggaaagaaagagtgaaagagagagagagaaggaaagaaaagtcggggagagagttggggaaggccaactaatttgaaatgaatcaacatgtacttacatatcactagagactgaggcaaaatcaaaaccgacagatttattccattgaatgaagtgtatgcatatcaaatcagccatttaattgtatgctccaaccactggggcaggtgaaattttggcagcttcaacttgtctaaaacaaaaccaatccaccaaaaaa

SEQ ID NO: 256353 - DNA, 249 bp, Homo sapiens
aaaacacaggtaagtcagaaggaaaaaaaatcatcgcttggatataaacacagataatgtttggtttgcagccacccaaacagattatattccaaatattgtcttaaaatctgatttactgcataatttactaggaacatgcatccatgtcaataaatagacatctgcatcacttttaatatctgtatattatcccattgtttgaatttcttttttttttttttttttttttttgagacagagtctctc

SEQ ID NO: 256354 - DNA, 110 bp, Homo sapiens
aacaagagagagggccccacgttctggcaacatggcgaacctgtgaactagggaagccctcccagcacagaaagtgccaggaaaataaaaacaaacagaacattttaaaa

SEQ ID NO: 256355 - DNA, 425 bp, Homo sapiens
agatcaaaacatggtatgctattatggttgaactgtgctctccccctccaaagtatgttgaagtcttagcccccaacacctgtggatgtgactttatttagaaatacaatctctgcaaatgtatcaagttaacatgaggtcataatgaattagggtgaaccctaagccgatatgactggtgtccttctaagaaagagacatagacacacagacagaatgccatcatgtgatagcagaggcagaaattgaaatgatgcagctacagccaaggaacaccaaaggattgccggcaacaccagaagctaagcacagaacaggttcttccctagagccttcagagagggaatagctctactgacagcttgatttcagacttccggcctccacaacggtgacagaataaatctctgttgttttaagctaaa

SEQ ID NO: 256356 - DNA, 489 bp, Homo sapiens
accaggagaatgtcacataatgattggtttaagcccagattcttaaaccaagcacaggggattattgtgattggctaatcaatcttcccatcctgcccacaagaacctagaaatggggtcattgacccttggcccatgttagctattttgaggagtggtaaataattaaacaaagctgacgttctgttagaaagggaactgggggccagctgtggtggctcaagcctgtaatcccaacactttgggaggccacgttgggaggattgtttcaggccaggaattgagaccagcctgggcgacatagcaagaccccatttctacaaaaagttagaaaaaataagccagtatagtggcacacaccagtagtcccagttacctaggaggggatacgtggacatatcacttgaaaacaggaggtaaaggctgtagtgagctatgatcgtaccacagcactccagcctgggcaacagagcaagatcctgtttctaa

SEQ ID NO: 256357 - DNA, 410 bp, Homo sapiens
agatcctcatagctttatgttttgtcatcttactagcaacaacataaagaaattctgaaggctttcatatctttattttgcattgtgtccctttctatgttctatataatgaacatcatttattcttctagcaattaattgcctacattagagatttcatgtgaacattttatgggctataagtattgtgacagatatacaattgtaattttggcactgaatcacatgtctccttgaaatatcttgattattttataatcataattctgtatctggaatactcatagagtttgtacaaaatattcagttaaacatatattttatgtgtataaatgccaaataatagtttataattaaaatgaaagctgtcatttggttaaattaataaaaattctttcttagattttatt

SEQ ID NO: 256358 - DNA, 620 bp, Homo sapiens
tatacctgttacacagctgtcatgtcaatgtccccttcaccatctgcctttgttttcaatgtgcttctatttttttcttagattatatgtctgtgtttttcttggatcattcttatttgctcaccttctagtaacttcctgagaagggtaaacagtagtttaataatttgagagtttatatgtctgggaaatatattaaatttatttccctgttgttctaatacattttcctttctgttatatgtctaatttctaaaatctcgaggttatgtttgtctgcttgttctttcaatatttatttttaaatagcatattgttcttgtttcatggatgtaatacctgctgtgactgttcaaatggcctttttttcaccttatgattcctttttttctctttgtcctcaatgttttatgcttgtaaatgttttagttgtagctgtgtatagttatatataatctatgggagtggtaagctacctatatccatttaatgcatttaatttgtctcagtccatcttttcattgagttgataaaactgagaacatgaggtgtatccctatgtatcgacacagaagcttctatcaagtaattgatcacttttttcaatatgttcggatctt

SEQ ID NO: 256359 - DNA, 209 bp, Homo sapiens
tgccttccaaagtgctgggattacaggcgtgaaccaccgtgcccagcctttaaaatctttttaaagagttatgtcttgtttgatctgttaaagggatctgtactctacccagttttcatccagttgattcagaattttcaaacaattggtttcagaacaaaatcagtattaaaaatactgaaaaatattttttaaacgggagtcttttc

SEQ ID NO: 256360 - DNA, 502 bp, Homo sapiens
taatgtgctgggctcctggcacatcactctacactaactttcaggtagacagatgggataccgtcatagtttctaatttctgagaagatttttcgctataatgttgttatatctgttggatgtctttggggagacaataagaggatcagtgtgtgtgtgcttcaatcccttagtcctaaaagataccactagttttcaaattttcccttcataatgaagatgacatgttttaaaatcctatctttatattctatcaactaatgccttataacctttaaacacttatttttcagctgattaagaaagtgacacatttttatttggagacagggtcttgctgtcacccaggctggagtgtagcagtgtgataatggctcactgtaacctcaaaccctgggctcaagcaatcctcccgcctcagcctcctgaacagctgggactacagagtgcacaccaccatgccgtcgacgcggccgcgaatttagtagtagtaggcggccgc

SEQ ID NO: 256361 - DNA, 504 bp, Homo sapiens
aaattaaacatacagtttttcatagactgcctgaactcagggaccagacatcacataaagaacccctgactagaccccaatattggtgtgtttaaatgaggtaacgtaagtctaggcaggacgcataatctgtccaggataatgtaaagtgtaagtgacaatgccaagaccagaacctgaaattcctaaatgctggctctgcaggacattgatagacaaagaaaaaaaaatgatcttgatgttagtcaggagattaacctgaatgagccagagaagcaattttgggtgataaggggaggacgtttaagcctttggttcataaatgggcagtgatgcagtgaaaagttggcttggcagatcttaaaggaatgcttatagtccttgcagaccagtggagatcaccagttagtgcatcaagaatacttacaactgaatgaccccgtttgaattcctgtgcaatcttaggcataagaatttagtttgttgggagaaagttgtattttg

SEQ ID NO: 256362 - DNA, 427 bp, Homo sapiens
gagaaaattggaggagagagatttgggagagcaaaatcttaaagattttattttggacatgttaacagcttaagatgcatgtgagtcatcaaagtaaagatggtgcaggggcagttggttgtgtgaatctagggctcaaaaaaagagatctgaactaaaaatacaaatttatgtagctaaaagatgttatctgaagccatgagaatgggcaaaatcagcaaaggggatagaagaaatttccatgtgggtttgaaaccacatatatgaatgcaaactgattcatgcgcttccaggctctgaaagaagggtttatgagagtggaggcctcgtagagttgacagcagggattaaatggcagacctcgtggggcagagatatctaagagcctgatgggtgtgatgacccgagagaaggtgcaattgtcccc

SEQ ID NO: 256363 - DNA, 635 bp, Homo sapiens
aagtcatggaatcaacctaggtgtccatcaacggtggattggataaagaaaatgtggtaaatataactgtggaatacttacacagccataaaaatagcctgtcctttgcagcaacatggatgcaactggaggccattatgctaagtaaattaactcaggaagaggagaacaaatactgggtattcttacttacaagtgggagctaaatgtccagtactcatgtacgtagagacggcaacaataaacactggggactactggtggggagggacagaatgaggtaagggtttagaaattaagtgttatgtgcttactacttaggtgacgggaccattcgtgctccaacctcagtgtcacacaatatacccaggtagcagccctgcacatgtatctcctaaatctaaacaagaagttgaaaaagggggagaaagttattttaaaatttctgttaaggaatgaggaagagatacagaaacaaaaaatgtattcactcaagaagatcaagtgaaaaaattatttaatatggaataatgtacaagtaatttgtcaaatgtaatagctttttcttatgtcagcaataatcagttgatagctattgtgggcagagtttccatgctgataaaaataaataaata

SEQ ID NO: 256364 - DNA, 708 bp, Homo sapiens
actgttcatctcttctcatttatgcatgcccatgtttttacctctttcctagctctttgaaagtgtgcttacgtaagtgttattgctttcaaacagtcaagtcctatgccagtttggaggatatgggtgttttaatgaagaatatataatacttgaaattatgaggtttgtgttcaaattgtgacgaggtaatattaaaacaattattttatgctttttaaaagtatgtattttactacctgagtgtcaatttaaatcataactatggcatttattacatgtgtgcctttgaacatataattaaattttatagtctcaggttcctcatttgttaaatagggcaaaggacactcatcttaaataattgttaagtaattgaacatagaaatgtctagcatattgctggggcatgggaaacacagtaaatattaactaaatctgcaaaaaaagttttaaatctgaaaaagtgtcctgagacacttgaaaatagaaaataactttggaaaacaggaaataataattttattgttttttgtcccaaagagaagacaatggattccataaattattgatccatgagcttgatatctctcaagagcaaaattctgcagtggattaaatacatgctctgtgagcatttaccagaggaaatggttatgatcaagagctattgaatatttatagaacatatacattttaaattgacct

SEQ ID NO: 256365 - DNA, 442 bp, Homo sapiens
cttataggtggcgtgttctccttgggtatcatcacatcgcctgccttctgtgcatgtctgcatccacgtgtcccctttccaataaggatattagccctttaggctgggtcccgtcctagtagtctcatcttaactaattacatttgcgacagtcctatttccagatcaggccacattctgagatgctgggggttaggatttcaacacaggaatttggaggaatacaactcaatcaggcttatggaaaattctggtcttaagtcaagggtagtgttctccagtctgtatatggaggcgcacacctatggtcccagccacttgggaggctgaggccagagaactgtgtgagcccaggagttccataccagcctgggcaacatagcaagacctcctctcaaaaacagacagagtggtgtcttccagagtgattagtttgcttaaa

SEQ ID NO: 256366 - DNA, 349 bp, Homo sapiens
ggattggccatttgagatgtcttttcaggttttttaatgtctgaattgatggctccaccactccagtggcagcacccagaagcaactcagctcaagaggacagctttgactccctatgatttcatctccaacccaaccaatcagcagaaagcacccattgcctagccactgccaccctgtcccctgcttcccccaaactgatggcagtgacagcccgtgtggagcagccactgtgaggatgccagctgcagcaggggaggcacagctggggctgcacaatccacaaggccagagggagccctgcccctaccgagttggtggggcaggagcccacactcctgggcacagc

SEQ ID NO: 256367 - DNA, 725 bp, Homo sapiens
gtgacctattcatacctcccctatcctgaccaatggattttctaaaattgtggagcacagtggtgggtgtagcatgtgtgctatggtctaaaggtttgtgtccctccaaaatccatgtgttgaaattctaactcccaaggtgatgctattaggaggcagggggccttggggagttgattaggtcatgagggtagagccctcattaatggcattagtgccctgaaaaaggagctcaagagaaattcctcaccccttccaccatgtgaggacaaagaatgtgcccatctgtcaaccacgaagatagcacccccagacaaggaatctgctagtgccatgatcttggacttccaaacctccagaactgtgagaaataaatgtctatagtttataagctacccagtctaaggctttttgttacagcagcccaaatggactaacaccctgtggaaagaggagtaaatgggttccaaatatagtatactttaaactctggttgattatttcttcaaagaacatctgtttccctttgctattccccaaggacaatatatctaaaaaatattctggggtagaagggcaaacttacaaatcatattattatgcaaaaggtaaaattatagctgtttctcctaagcaaattgtaagggttaattatctaattcaacaatctaagaatgtctaaacaatgcttaaagcattattaagtatactgtataaatatttat

SEQ ID NO: 256368 - DNA, 686 bp, Homo sapiens
taattttcatgtttctctcccacccctgggagatattgtggtggtgtttttttctttaaatttactttatttgccttggggagagggtgagatgggtggacagtagcaattgctttcacttggtcttcctgcataagatggctcttaccccgcaggtcaagaacccaatataggggctgggccaactaccaattttgtctattctgactatacgttcaaggataaggtagatgaccacaaactggtctaataggagagctataatggttccaggtatcaatgtcaactcaagccctgtgtgcaataatttttgaattattgtacctcttttatcagtgcagttacctacgtaaataaacataggtcctcttggaggactggcagattcattactgtgcaaaccttccaagattttgtagcatcttcactcctggcaactggcttcatcttcaattaatgattaccaggctggctgtcctaggtttatatattgggcaaaggattgtgactttttattgggccaaatgctgttggtcccttgatcatccatccttaatttcttttgatggtacaaatgtgtatattggtgttggctgctcatctgttttcacccctaagaatgctatggtttaatcttcataactctcaggcacccctggttgctctctgaccttgcaattcattat

SEQ ID NO: 256369 - DNA, 192 bp, Homo sapiens
cttgaaaaataccaagaaagtgggtaagtgttctcaccacaaaaatgataaccatgtgaggtaatgcatgtttatcagctaaatttggtcattctgcaatgtatttatacttcaaaacatcacgctgtacatgataaatacaatcttatttatcaattaaaaaaataaaaacttctgagttctcaccatact

SEQ ID NO: 256370 - DNA, 682 bp, Homo sapiens
gtctatgctaagcgtgtataattaaaaaaaaagagagtaacttcaaaatgatttggaagaaaaaatatgtacatatgtgaatagtacttaattccaggtgatgggaatatggatgactggttatcttcttctttctgtatcttttatatttttaaatggaaaaactcaacgacctggaagtgaaagaacagatttggaagaggtgtggggcaggtgagaggaaaatgcagagtgaaactctgtctcaaaaaaaaaaaaagttacttgtaataaaactcaccaattttaaatctacgatgtaaccatttaaggaggtttgtagaattgtgcagtcatcagcagagtcacgttttagaatatttttgtcatttccccaaataccctaaagcctctgcacagtcatttcctaatctctggtgcccatgactgggccccaacaaaataaaaatttggaaatccgacatcattaaatttcaaattttcttagattgggattttttgtagtgaatcattgtcttacttttgtgacatttgaggaaatattgcattttagggacttttttgatgaacttaataatagtcctgttcattgctcttcgtgaattgtttcatttttgctgataactgatagttgctaccaaacctggtctggcaagcctaaatgaatgagctaaaaaagaaa

SEQ ID NO: 256371 - DNA, 619 bp, Homo sapiens
ggtgactggagaggtaggctgagagtatgctgtggatgggaatggtggcaggaacgtatgctgagtggaagtcagcagctcaggcacagaggcaaaatacacttcacttcgtgagggactggatgcccaggtaatggacaatataggaggaatgatttctcaatttctggttagcactgaactgaatagataatggtgccatccgtggagatagggatcaagaggcccagacttagaaagataaagaatttgctttgggatacgtatactgaacttaaaaccctctgaagcatggaataagcagacagatgacggaagtttgtcttttagagtaaaggtggctctgtacaaagaaatttgtgagcaactgacatatattaatagatggcaatggaattgccttggggccaggcgcggtggttcatgcctgtaattccagcattttgggaggccgaggcgggcggataacttgaggtctggtgttcgagatcagcctggccaacatgatgaaacccagtctctaataaacacagtagccgagtgtggtggcgcacacatgtagtcccagctactcgggaggctgagacaggagactcacttgcacccgggagacggggtt

SEQ ID NO: 256372 - DNA, 653 bp, Homo sapiens
  misc_feature (110)..(110): n is a, c, g, or t
gtgcggacccccgctggccaatggcaggaacgtatgctgagtggaagtcagcagctcaggcaaaaaaaaagacggtgccagtatggatggagagaagccagtgggcttgnatagatctaccagaggcaaaatacacttcacttcgtgagggactggatgcccaggtaatggacaatataggaggaatgatttctcaatttctggttagcactgaactgaatagataatggtgccatccgtggagatagggatcaagaggcccagacttagaaagataaagaatttgctttgggatacgtatactgaacttaaaaccctctgaagcatggaataagcagacagatgacggaagtttgtcttttagagtaaaggtggctctgtacaaagaaatttgtgagcaactgacatatattaatagatggcaatggaattgccttggggccaggcgcggtggttcatgcctgtaattccagcattttgggaggccgaggcgggcggataacttgaggtctggtgttcgagatcagcctggccaacatgatgaaacccagtctctaataaacacagtagccgagtgtggtggcgcacacatgtagtcccagctactcgggaggctgagacaggagactcacttgcacccgggagacggggtt

SEQ ID NO: 256373 - DNA, 499 bp, Homo sapiens
tgttttcagtacagtaggtcctcaatgtcatcagtaggttcttggaaactttaaacaaaacaacgtataataaaagcatttttttctcatcaacattgtaatgaaaaaatgtcgaaggaaacaatgttattcgagggcctgctgtacatcattttgctaaaagttgccattttcaagaacctatctacaatgttaagtgaggacttactgtactttaaagatactgctttgccatcttcttatttgcattacttccaatgagaaatttgctatcatttttatctttcttcctctcccatggatgtctcttttatatagttgcttttaagatatgtctggttatgacttgcttggtgtcattttcttaccaagactacgtttcatataggattatgctactcctattttgctgatgttaatctccaaaatcgtggtggataatcaggtaggattgacctaactgagtcataaataatagtaaaaaaaggaatatttttaa

SEQ ID NO: 256374 - DNA, 327 bp, Homo sapiens
ttttttttttgagatggagagtgtgggctgggagtggggcaggagtgtacaggagattttaaaggttctggacatgaagagcttgctcaatgaatacagtgtgagctctcctgtctcatctccctagaataaaactctttgtcactgatactcgcatcccgggtaggaaaggaaaggcaaagagtatgttgaaaacatctctcactcttttcacagctaaagtattacccaaaaagtcactattctccctcttcagtagagaatagtgactttttgggtaatactttagctgtgaaaatttttcttctaaatttttctactctgaac

SEQ ID NO: 256375 - DNA, 502 bp, Homo sapiens
tcagctcactgcaagctccgcctcccgggttcacgccattctcctgcctcagcctcccgagtagctgggactacaggtgcctgccaccacgcccggctaatttttttttttgtatttttagtagagatggagtttcactgtgttagccaggatggtcttgatctcctgacctcatgatctgcctgccttggcctcccaaagtgctgggatttattcttgattatttacagcaaccctgtgagctacatgtctattcctacataagacagcaaagttgccgagagctgaaacagtacagctaggagaaactgcaatcagcctctgctctggcttcaaagctcagtccatttcacagcaggggggtttctgagtggaggattcagctgctccattgtatgatgagacaatattgtggagtatttgtctatggtctttctcccacctccctctgtcccccatcacttcccagaacaatggcactagaaggtaaaaaaggtcatgt

SEQ ID NO: 256376 - DNA, 498 bp, Homo sapiens
ctataatagtacacctctttgttcttgctctttgtggaaagaaattaggctatttgtcctttagacttctccactctctagatcaggctagttgcttcctcgagtattttggtatcagggagtctctgtctcccataagccccatgaacttaaaagtttgatgtggtttttgttttgtggtaagactgccatagctgtcacttcctgttgcatcgtgtaagcaggtacataatgtctgatggtcctcctttctgtgatcttaagattggttggtgggtccaggggtggtcagcctaatccctccattatgcagtccctgggtgccttattcttgatctgtaaaatgtgactagattaagcacaggggtctctactccacagggatcttatgtgaatgaaatggtataacagattagaaagcactttgttttaaggagcccatagcaatcagaccaattctggacttctgctatagagtcagatctgaagggcacacct

SEQ ID NO: 256377 - DNA, 463 bp, Homo sapiens
agggaatgctatgttgctcccatcagactggtgtacatcaagggtgttgtgatacttccatcaaattggtggtttcccaggacattgtgtgtttccccagagggctatgtgacccttccccaggtactttctcaaagggtcttgagtctctcccatcagactgaggaatcctcaaagctaagaaaccattttaggctgggcgcggtggctcatgcctgtaatcccagcactttgggaggccgaggtgggcggatcacaaggtcaggagtccgagaccattctggccaacatggtgaaacctaacaatgcaaaaactagctgggtgtggtggcggtcgcctgtagtcccagctactctggaggctgaggcagaagaatcacttaaacccgggaggcggaggttgcagtgagctgagatcgcaccactgcactccagcctggagacagagcaagattccgtctca

SEQ ID NO: 256378 - DNA, 335 bp, Homo sapiens
agggaatgctatgttgctcccatcagactggtgtacatcaagggtgttgtgatacttccatcaaattggtggtttcccaggacattgtgtgtttccccagagggctatgtgacccttccccaggtactttctcaaagggtcttgagtctctcccatcagactgaggaatcctcaaagctaagaaaccattttaggctgggcgcggtggctcatgcctgtaatcccagcactttgggaggccgaggtgggcggatcacaaggtcaggagtccgagaccattctggccaacatggtgaactttcgcctcaaccaagacgctgggaccagcacaaccg

SEQ ID NO: 256379 - DNA, 358 bp, Homo sapiens
catgtggctaatgggtccggaataaggggaaaagtcatgtgagatgaagtagaagaaatagggaaataggccgggcgcggtggctcatgcgtgtaatcccagcactttgggaggccgaggcaggcggatcatgaggtcaagagatcaagaccatcctggccaacatggtgaaaccctgtctctactaaaaatacgaaacttagctgggtgtggtcaggcgtgcctgtagtcccagctactcgggacgctgaggtaggagaatcgcttgaagctgggaggcggaggttgcagtgagccgagattgcaccactgcactccagcctgggcgacagagggagattctgtctcaaaaaataag

SEQ ID NO: 256380 - DNA, 696 bp, Homo sapiens
tttgtctgcattttgacttgtcgcatgaggtgagatgtagaattttccatatgttggtgttcaaaaagtttgggattttagagaattttggatttttagattagggatgctccacctgtacatgaaaatagcaacagaaaagttgtgaaaccattttaaaataaacactaattacatttacaagctattttctgaaagcaagccaagatagaaacaagggtaggaaattcatccttgctttcctgtgagaaggcaaacagaaataacaacctatgaagtaatgtaaaaatgttcaaaggagtaaacaatcttcctttgatgtgatccaaaagcacaaacacaatgacaaatgaccttccaggtgtagaatgaacttaagtttctatctttcaagcactcatctatgccgtgctgcaacagacgttctcagtcttttcacaccttcaattagagattactttgttaattttaaaactttaattgcattttttactgaaatcaattgcttttaaaaaatctacgtatgatgtgagggcgatctggctgcaacatctgtcaccccattgatcaccagggttgattcggctgatctggctggctaggcaggtgtccccttcctccctcaccactccatgtgcatccctctcaaagctatgcactcggtcaaagaggatgaccattcctgatagaggagaa

SEQ ID NO: 256381 - DNA, 382 bp, Homo sapiens
gccaccccctcctggccaaggcccctcaggtggttgccgggctccgcgggtgcgggatctatagcgcctagctccgagtatacttctgcttgaaaaaaaaaagccagctgtcaaatagcctcaggatgatttccagaagaagattgtgttatcataggagatgacacttccatgcctgttattacccctggacatcttccagtgagataagatgtggaggtagaagacagtgatattgttaatcctgaccttgtgtaagcctatgctaatgtctgtgtttttgtcttagtttttaacaaaaaaaagttttaaaacattgaaaaatagaaagaagcttgtagaataaggatataaataaaatatttttgtatagctgtacaat

SEQ ID NO: 256382 - DNA, 814 bp, Homo sapiens
gcggccgcctcttaagcgccgcagagccccagagggtgtggattctgcaatgctgcacagaaacctactgcagcctcagaccaacagcagcagcagcagcggcggcggcggcagcagcagcagcagcattagcagcagcagcttctctcaatgctgagtattgaatacagataatcatgaggcccaagaccctaaggaacagtgcagccaggagtcggaaggagcctgggtttctgaatcatcacatggaggggagctgtcttcagctgggagagctgtcttcagttggatactggtggccgtttgggcatcctgggccagcccaaggacatcttccagtggccgtttgggcatcctgggtggtagcaggtatctccattgcactctatttgccacctcaccctgaaggaagacatgcgctctggaaccgtgagccatttgggaggtgcaagaggattccaggaaatggcagcaaggccttagaggagtttaagtatgtacttggccaggacaaaagtctgtcttcatctaggctctaggtgctgacttctgtaacaggggagctgttaacttcttcctgggaatccaccttctaccccacacccagaagcagagcaccatccactcaggcctccaagtgctccaggccttgtattccacctctgcctactttgagccagcaactgatttcagcaggaattcactgagactgacatcctctatgctcagcactgtgtgccaatagtatggccacacaagtagattttttcctatttctcttttcttaggctaatggttcagctctaaagataag

SEQ ID NO: 256383 - DNA, 1237 bp, Homo sapiens
  misc_feature (362)..(362): n is a, c, g, or t
gcggccgcctcttaagcgccgcagagccccagagggtgtggattctgcaatgctgcacagaaacctactgcagcctcagaccaacagcagcagcagcagcggcggcggcggcagcagcagcagcagcattagcagcagcagcttctctcaatgctgagtattgaatacagataatcatgaggcccaagaccctaaggaacagtgcagccaggagtcggaaggagcctgggtttctgaatcatcacatggaggggagctgtcttcagctgggagagctgtcttcagttggatactggatggagtctcactctgtcacccaggctggagtgcagtggtgcagtttcggctcactgcaacctccncctcccaggttcaagccattctcctgcctcagcctcccgagtagctgggattacaggaggaagaaagggagctggttaggaagcaaacttgagtttcccatgctctgtggctgagcaagtcacttcaccattctcaggatggaagtggggatggaggtggcatcggcctcatttgaaccacatggactaagaggggctatgggagtattccccaaaggaagactgaggggcgttactagaaaatgggagaatggaagcagagtgggcaaaaccaacagatgttccctatagtaaataaaaaatttggacaattattagtgagcaagtacttataacatatatggcacatgggattgtgactcaccagtgtgttagcacaatatggtcaaaaacctctgatccaattcaacctactcatcttaacgattttatcagcatttaataagtttgttttggccatcatgtgttatagttttgtttgtggttttgacacctcattagaggtttcatcagtgtaaggagccaacctaagagctcttctcacaagtttcccaagagagaaattgcccctccaaatgtgaggagtctcactttatatagatagcatccacacttcttgcagtggaaaacaaaccttataaaatgtaatacgtttggtttcctaactttttcatgaccctggggtggtagaaggaagtgcaagttttatcacttggatttagagacaaggaaattgaaatggagagagaattgggctcacatgcaggcagcatgtctagctgcctccatcgtgtgatctgaggcaccccatgaggcctatgattactgtaaacctctaaaataaataaaaaataaaacaatctctgccactgaaa

SEQ ID NO: 256384 - DNA, 1115 bp, Homo sapiens
gcggccgcctcttaagcgccgcagagccccagagggtgtggattctgcaatgctgcacagaaacctactgcagcctcagaccaacagcagcagcagcagcggcggcggcggcagcagcagcagcagcattagcagcagcagcttctctcaatgctgagtattgaatacagataatcatgaggcccaagaccctaaggaacagtgcagccaggagtcggaaggagcctgggtttctgaatcatcacatggaggggagctgtcttcagctgggagagctgtcttcagttggatactgggaggaagaaagggagctggttaggaagcaaacttgagtttcccatgctctgtggctgagcaagtcacttcaccattctcaggatggaagtggggatggaggtggcatcggcctcatttgaaccacatggactaagaggggctatgggagtattccccaaaggaagactgaggggcgttactagaaaatgggagaatggaagcagagtgggcaaaaccaacagatgttccctatagtaaataaaaaatttggacaattattagtgagcaagtacttataacatatatggcacatgggattgtgactcaccagtgtgttagcacaatatggtcaaaaacctctgatccaattcaacctactcatcttaacgattttatcagcatttaataagtttgttttggccatcatgtgttatagttttgtttgtggttttgacacctcattagaggtttcatcagtgtaaggagccaacctaagagctcttctcacaagtttcccaagagagaaattgcccctccaaatgtgaggagtctcactttatatagatagcatccacacttcttgcagtggaaaacaaaccttataaaatgtaatacgtttggtttcctaactttttcatgaccctggggtggtagaaggaagtgcaagttttatcacttggatttagagacaaggaaattgaaatggagagagaattgggctcacatgcaggcagcatgtctagctgcctccatcgtgtgatctgaggcaccccatgaggcctatgattactgtaaacctctaaaataaataaaaaataaaacaatctctgccactgaaa

SEQ ID NO: 256385 - DNA, 878 bp, Homo sapiens
gcggccgcctcttaagcgccgcagagccccagagggtgtggattctgcaatgctgcacagaaacctactgcagcctcagaccaacagcagcagcagcagcggcggcggcggcagcagcagcagcagcattagcagcagcagcttctctcaatgctgagtattgaatacagataatcatgaggcccaagaccctaaggaacagtgcagccaggagtcggaaggagcctgggtttctgaatcatcacatggaggggagctgtcttcagctgggagagctgtcttcagttggatactggtggccgtttgggcatcctgggccagcccaaggacatcttccagtggccgtttgggcatcctgggtggtagcaggtatctccattgcactctatttgccacctcaccctgaaggaaggtacgagggccccttcaaacgccatacaaagaccttccggagtgcccagtgtgcagattgcctgacatgcgctctggaaccgtgagccatttgggaggtgcaagaggattccaggaaatggcagcaaggccttagaggagtttaagtatgtacttggccaggacaaaagtctgtcttcatctaggctctaggtgctgacttctgtaacaggggagctgttaacttcttcctgggaatccaccttctaccccacacccagaagcagagcaccatccactcaggcctccaagtgctccaggccttgtattccacctctgcctactttgagccagcaactgatttcagcaggaattcactgagactgacatcctctatgctcagcactgtgtgccaatagtatggccacacaagtagattttttcctatttctcttttcttaggctaatggttcagctctaaagataag

SEQ ID NO: 256386 - DNA, 539 bp, Homo sapiens
gcggccgcctcttaagcgccgcagagccccagagggtgtggattctgcaatgctgcacagaaacctactgcagcctcagaccaacagcagcagcagcagcggcggcggcggcagcagcagcagcagcattagcagcagcagcttctctcaatgctgagtagtaagtgtttgacttagtaaactctacaattaccattaggcgcttgcttatgagaggaggcggaatctttcttaaaggaatgggttttgtttttcctctctagtattgcttcataagaggcagagaggatggaatcagggagttttgtggactgagtaaatgagtacagctgtgggaggtcaaggttaaaattaactgggtggttgaggaatggaggcaatgattttagtgtaagtcaatgaaatgctagaagcaccagttttaaagagccctgctaatttcaaacattggggtaatggcaaaataaagttgtatgccttgaaactgattagtaatttgtgctaatatttaatttaatttaatatttgtgctaatattc

SEQ ID NO: 256387 - DNA, 354 bp, Homo sapiens
ccttacccaccgaagatccaaagcttccttctaacaagggtagtagacgtacgtgtctgtgtcttctgttctctaggtgtggattctgcaatgctgcacagaaacctactgcagcctcagaccaacagcagcagcagcagcggcggcggcggcagcagcagcagcagcattagcagcagcagcttctctcaatgctgagtagtaagtgtttgacttagtaaactctacaattaccattaggcgcttgcttatgagaggaggcggaatctttcttaaaggaatgggttttgtttttcctctctagtattgcttcataagaggcagagaggatggaatcagggagttttgtggact

SEQ ID NO: 256388 - DNA, 425 bp, Homo sapiens
aagggccacccactgaggaaagggagggccgggcacataccccagttcagctcaagggcgggtcagtcagctagatcctgcctgtgtggtattggagagttaagttgtcagtggtttaggaaggggcttgtcaaaagtcctgtgccacgagatcacccggagagtttgtcaatatgcagattcccgggccccatccccagcactctgatttaggaggcccacagtgggctggggagttggcatttttaaaaagctccactgatgactctggcactagtggtctttagagcacatacatattgagaaccattagtaaagaacgattctacccagtagggtctgggtcttgctaaggagaatcctgaggattgaagttattcagatgtaaagaaatggctctttattaaagcattatatacacttca

SEQ ID NO: 256389 - DNA, 339 bp, Homo sapiens
attaacatcaagttagtatttactgactttgatcatttttatttcttaatttctaaaacattgtgactttctaggttgtttgttttaaatttttaagcttaattcaattttggctattgaaattcatctaaattatttcaatactttgacattttttgaggcaattaaatttggaaaatataccatgtgcattttcagataatatatagtctgtggcttcagtgttctatatgcaaaaggaggacaaacttgttaatcattcttttcagatcatccattcacttgctaatttttattggcttattttttaattattaaagaggtatgttaaaattttta

SEQ ID NO: 256390 - DNA, 575 bp, Homo sapiens
taccaatctgtggttctaaggcagcaggtccaacagctgggagtagctggggaaggcagactttgtcacaatggactggaaaatgctagattagagtttagaggccagttggaagccaactgcaatcttcaaggtgaaatggctgaggcagcgtttggacattagccgcaaaatgaaacgcaacacctcttgtatgtgaaagacaagattcttgggaacaacgactgtatcttagaatattctgatatccccaactttgttgaggtcaacactgggcacaaagcagggccttactaaatgcttgattgacaactaaagaacttactctaactgacttctagacagtgatctagaaactttgcatgcaataaatttaatccttaaagtgactctgtaatatagtcactttaacaagtaaaggagaaagaaaaccctctaagttaaagagttttaaataatttctcaaacaacttggatatagtgttggaaattgaacagtggttttcctgatgccaaaatccagaatttgttggtggaataaaaagtccctttgtaaaagacagtattcgtcattg

SEQ ID NO: 256391 - DNA, 476 bp, Homo sapiens
ggctctggagcctccctatgggttgcctcctacagcaaaggacatctcaccccgggccttcactcttgaggtggcccagggagccctcagtatgaaggctctgagtccattgcaggcttgtttcagaagattcaggttcagaagtgcaagagatgaagataaagaggttgggtgtgtacagtctatatccatcatagtttttcttttcttactttttcatttaagaaaaaaaattgtcttatttcttctggttctgtaagaatattttaccaaaatgacagagaggagaaaaaaggataattgtagtaaagcaggttattggagaccacttcttccattcttttaaagaaagattgttctctggaaattatcccaggtcgggagagggggcacaggaggaaggaaggaaggaaagaaggaaggaaggaaggaaggaaggagaaggggaaggggaaggggaaggggaagggaaaagg

SEQ ID NO: 256392 - DNA, 529 bp, Homo sapiens
atgatgattgtggcctaattctgaatacatgcctcattcttttaccccgcctcaggcctccagtcggatcctgcgtcattctggctgccttggcctttcctttcctcagttgagccaggtaccatagtttttggcatggctttgacatatctatcgctgtctcccatgcagatgcctccatcacaactccaagataactgttactcagcctttgggtcttagtttaatatcacttgattttagcatttagcaagcctttttttttttttttttttgagacaggatctcactgtgtggctcactatggagtgcagtggcgtgaacatggttccctacagccttgacttcccgggctgaagcgatcctcccacctcagactcctgggtggatgtgcctgtaatcccagctactcgggaggctgaggttggagaattgcttacctgggaggtggaggttacagtgagtcgagattgtgccactgcgttccagccacggtgacagagcaagactcagtctcaaaaaaacaaac

SEQ ID NO: 256393 - DNA, 438 bp, Homo sapiens
tgagaggcgcgggggcagctgagatgcaggccatgcagccccgaagctccgaatcctgggatgactcctgtccatgttggaagggaccctgccagtcctggcaaggttcaacggccttagggcaagaaatgttagtagagtcctggaagacgatgtggggaacgggtagcggccaccggatggtgatcgttcttctacaagaccttgacatggatggggagaaacagagaagaaccttccaagtttgtcccactggacatgcccaccacactttaccagccctttttagaaggcctgtgcgtaacacatgaaaaagctgctctcgacctttccctgaccttttaaaagaaaacatttgctgcatctaatccgcctagatgtaaggaggttcccaaatgtatgacagagtcagacaattacatgtcttgtaagttacca

SEQ ID NO: 256394 - DNA, 311 bp, Homo sapiens
ttcagagacaccgtctttctcattttgggtgttttggtaatttttcaattttctgagtagcatcagtatttctgcttgaaccaaggtgaaattttgcatctatttctcagttctctaggggcctctttcatgactgtctgcttgcttactggtattttccttactcccgttttatcatggtctgtgaatttaaccaacatgatgtttactcccgcttttgaattattaatgagaaaactgtgagatggtacttttatctttaatagttgatgctgaaaaagtgacaaatgcaataaaagcatctttctcta

SEQ ID NO: 256395 - DNA, 418 bp, Homo sapiens
aaaggccagatctcctgttaagtgaatttaagtatcaagagaacaagtagcagatgttggggtatgtatgtggaacaaagtgactttgacttcggctctaaaattctgtttaaggatatttgtgctaagagtagaaaggaaaggagtgatggaaagaatactatctttcagaatctaagtgtaggaagatgccctgggaatgagtcaatgttcttttttttttttttttcctttttctgttctagccaggtggacactggaatgtcatcttgccttttcttaagagagtagaccccagtgtctatcgttcccttctttgtgtccctgtgtacttactgtttagctcccacttataagtgagagcatgaagtatttatttagtttctattcctgcattaattcacttagcattatgacc

SEQ ID NO: 256396 - DNA, 819 bp, Homo sapiens
gaatttgtatttaattttagagttacatgtaccactggaatcacattcatatttctgttacagtgtagtgattctgggttaagaatcactgatttagttctacctcattttacatataccttttcctgcaaagatatataaaaataaaatcatatgaataagttatgtgtttaatagttccattcagtcatctcataagacaaaattactttctaagttaattttaattcagatctttatagaatattgaggttttaaatgtgaacacatatatataattttatgatacaaccttttcttctgaatacttaaagtgttttcacagttggaagtatcaaaaactttgttctctgtaaaccttcagcttccaaccttcttcagtcttatctgcagttatctcctgcacatgtaaatgatgtggtagaagatacggtttaagatgaattttagttatttaaagtgtgtcataacctgaacattttacagatatatttaaacaggtataggtatatttaaaatcactattttaatttaaaaaaaaaaaaaaaaaaaaaaaaaaaaaagtggggggagggcatgaggccctaaaaaaggttcttaaaccaatggattgggcgccagggggccacagaggcgtgagtcaccgtgggcacaaggggtcccaagaggaaaccggggacaagagacaaggggaggaagatctcaccccaatagaaaaagcgccggggggcacccgaccgcttcgagaccagccaagaggagtcaaggcggacaaaagggggatctaccaccagggagccaaaaagcacgaataaatac

SEQ ID NO: 256397 - DNA, 428 bp, Homo sapiens
catgaattgaaatgataccaagataagagagggtgcagattttgttggcagcattgtgtgtcaccaacagctgtgatttcagaggctgccaaagcctactgatgttgaatggcagagaactttgggtgccctataaaatatcgtaagtagatggctgccttcctagggaattgtagttaaaatattttatgaaaattaaaagtaaacaaaactatgagttgtcctataaatatttaaaaagacataaagtttgggcacggtggctcacgcctgtaatctcaacactttgggaggctgaggcaggcggattacctgaggtcaggagttcgagaccagcctggccaacatggtgaaactctgtctctactaaaaatacaaaaactagcccggtgtggtggcacacacctgtaattccagctactctagag

SEQ ID NO: 256398 - DNA, 379 bp, Homo sapiens
ctcccaaaagccttctaattcattactgttttgaaaactagcctaagttcagttgataaaaatatatattaaattgttaagattaagaacttgaggccaggcgcggtggctcatgcctgtaattctagcactttggggtgccaaggctgacagatcgcctgagctcaggagttcgagaccaccctgggcaacatggtgaaaccctgtctctactaaaatacaaaaaactagccacgcatggtggcacgcgcctgtagtcccagctactcgggaggctgaggcatgagaatcgcttgagctcggaaggcggaagtttcagtgagcgaagattgtgccactgcactccagcttgggctacagagtgagactccatctcaaa

SEQ ID NO: 256399 - DNA, 317 bp, Homo sapiens
aaaatataggagtcctcgttaacagaaatccacagggccagctttaccaccgctctgtgcaacctcttatgtgatgacgcacatcagagcttccacaagcattatctcagcacacaggtgggtgaacacaggccaaggaaccatcggctcaagtttgctacccctgctgtgccagtgggtctgcacagcctcaacaggggagaagtgagcgagagagtgtggatgtgagtgtagaagcagtgtgtgtccagagagggtgtggaatccatgtccgaatggtattcctatgtgaatgaagcagtgactctgaacccaat

SEQ ID NO: 256400 - DNA, 488 bp, Homo sapiens
actgttaataccaggtaaccctgtacatgcgtaccatttgcatcttcaaagccccatcccaggcttaccttacctggtcaccaacatagctgctatttccactctctctgttgctaagaccatatatagcttgtgtcttatctgtacctcaaatgaacccagaggtgaagtgttatgggactgacctggaatgcagcttcattttgcctacactagttccacatcaagaccactaagttcattagaatttggcccagtctctgtaagtgttgcttctgcatttatctgttaacaactctcaaatgccaactttgggcatccagagatatgtgaggcctaagaaatattcaggtgctcggtgactcacagcatgagttattggaatatagacctcactgtgtagaatgatgtgagtgtctttggtttctgtactatatttaagaaagatgtcaataaaatatttgtatattaaattatacttacataat

SEQ ID NO: 256401 - DNA, 408 bp, Homo sapiens
aatgaaactggattcatgagtttcccaaatgaatttcccaaggcttcataattcatgaggaactagaactcaaatcccattcatagttccgctaccctggccctagacctctggctcccaccccgttctgagagctacaactcacaattcagacactaacaacacatgttttaagtgtgtggcacaacttcttgctcagtatagcagctcaataaatgctaactgacataaaaattaagcacatttcttgacatctgatttgtatgaaccatatgttgtcacatggcaatataatggtttggaagtcttagagaaagaggttttccagcagaattgcaagaatatctcagtctgagaccactctgttgtaagttcctagacctttttctctgaattctgtagggggag

SEQ ID NO: 256402 - DNA, 193 bp, Homo sapiens
tagtcattaaccaaattctagttccttgatagactagagacaatataaacaacccccaaatttttcagagtgattaaaaaccttcaatattagtaatttacccttatgtccaaatacatcgtggtactgactttaaaacaaaatgtttgactaactcttttcgctttttataaaataaatgtgtttgaacaga

SEQ ID NO: 256403 - DNA, 399 bp, Homo sapiens
gtcaatgccaatttttgtgtactctctggtacacatataatagtttgtctggtactgtcatttcccttttacatgacattccaaaatgacaaaaaccattggtgatcatacacacacacacacacacacacacacacactgatgatcaagacatattgatctagatcagaaagaataaaaatgtaaaaatctaattcagtatactcaatgatcaaattatgcttaatgaagcttataattcatttaatttcccctaccctcaattctcctaaattgtgcttttgttgtaattagtttagaacatggaaatttgcaatgtatttttattttgaacatatcgtctaagttgaaacttcccaaaatctgtctagaatcaaaataaatagaaacatcttgtga

SEQ ID NO: 256404 - DNA, 696 bp, Homo sapiens
ggagactagagaagaaacagtatcaagagcctacattggggcttccaagtgatgccccaaggactcactaaaacatcagaaaagaacatttttaaaaaggaatccattacaggggtgctagaaaataagaaaagatgccatctatacagcaaaagtttcaagaaattccaagaagataaatttttgcttagaatctcaactttaaggccgagaactgttctctaaagcaaggttccccttgagcaaggattcttaacctcaggtccgtggggaagcaattgccaatcaagagaattctggaagttcatgaagctggggagggggtgatttacatatttatttgcatttacctttagatgaaatttagcatgttttcaaatacaaatgtaagcaacaaaccagagtattggtagcaataaccataacttgtcatcaatagaaattcatcattttcatatcatctaacagttactacagatatttggaaatatgtatactcgtccctagtttgaaatgataatagttactagactcaccattaaatcttgttatcaataaagaaacatagctttttttttttttttagagatgggatctagatatgttgctctgactggactcaaactcttgacctcaagcaatcctcttgcctaagcctcctgagaagttgggatacatatattatcataccacaaa

SEQ ID NO: 256405 - DNA, 517 bp, Homo sapiens
ttgcctgctgactgattccctggggttttctgtgtaactcttccatctccagtaacattgcacatgtgtacacatgtgtgcatacacacgcatgcaccctaaacccacaaatatttattgaatgcttgtgtaagacagtgaaggccttgtggaaagtgtacagtgtgatacctgccctcaagcaatgatgatcctgttggagagtgtgtaaatctatgaaaaaacaatttgcaaagcaagagttaaatattaccagccccaagggaagagaggacagcttaatctttaataaagctgtcacctctgacccactgcgttctcacaacagctccgagaaatgctcatggcaaaggctgcagagtgatgagggaaggaccggaggggttaagccatgtggattcgcaacacagaaggaagattggcctcgcaagccatcagcaggaatgaacaacaaccaagcgccgtctcatttgcagtcttggcagcttgtctgtaccaaataaacaacttaacaaag

SEQ ID NO: 256406 - DNA, 190 bp, Homo sapiens
  misc_feature (37)..(37): n is a, c, g, or t
aagaatacattcacctttatgcatactgggacatgtngttcaatgtatttctaaactgttattcataataaggggtatgaagtacagtgcactctgttgttccattccattctattaatctcattccatctaatcctatgttatttaatttcattcagttatatttcatcaaaactatttcatatctggg

SEQ ID NO: 256407 - DNA, 329 bp, Homo sapiens
taattgagacatggtctcactctgttgcccaggctggagtgcagtggtgcaatcttggctcactgcaacctccgcctcccgagttcaagcagtcctcctgcctcagctctcaagtagctaggactacaggcatgcgccaccaccacacctggctaatttttgtattttttgtagagatgggatctcaccatgttgcccaggctgggtggaaagtgttatgttcttcccaaagtactctcctcacatcctgccccaacagtcgccctgtggaatgagggaaggtattagcctcacctcccagtgaggaactcgaagatctcagaagtgtc

SEQ ID NO: 256408 - DNA, 821 bp, Homo sapiens
cctgcctcaataatactacattttaaaaagtggttgaagagagctcctcattgcagagggaaggcagcagtgcacaacaaggggaaatgggctagttaagaggagaggtcaagaaaagggtgaggtggaaaaaatagtggggggcctgcaacctgcagagtcctgcagttgatctgcaaagtgaaagaagcaggggctgactcccctcttctgccccgctcctcccgtctcacttccaaggctcacctgccctttcttcctcagctggtaaaaaatgggaccctgatttgtactctctgcttactttaccctgatttatttccctttcaagagtataagctgagggcagagacttgactttacttgagtttatatcttgcaccacacttatcacagtgctttgcacaagtaggcaatccacaccatttggtgaatttaatgatgaagatctggggtgccctgtgaatttaagattgtaaaggggttaagagtaaaaagacacagagaatattgagacattcatttgcatttgagagagaggagtgggaggaggatacagagagggaccgaattgggacaagaggtacaagtggggtacagtctgcagacccttgaaaagccccggataaatcacattaaagagctcgagcctgaatgactgcttttggtggacagatacctgtttgatcttaaaaaagaacatgggagagaagtttcctctggctccctgtgtaattgctctgcatttcagaaagaaagctctctaaattacaaggaaagaaatgaatgtgtagtaattaattgccccagcttctccaaaa

SEQ ID NO: 256409 - DNA, 1120 bp, Homo sapiens
atcaaggtaaaggaatggtgattattgcagattcttccagttgctggtatgtcttcaatcagcaagttgagaaacatttttactgtattgtattaagttgtatatttggaaaaggaaaatattacttgggatttttctttgttatgataaaagatggcatctgtatttccaaacatggaacaatattatcacatcttacctgatgtaagatttctcaaagtagaatcatgatcactttttaaaatgcatctttgtgataaaggggaaaaaacatagacaggaggagcagtagagtaagatttgtttggggagtgtactgtagtaggatttaaaaattatcccaagaaagaagagaaagtcatcagaaaaggtctctacagatgctgctggtctgcagtagtcaacagaagggaggttctcagctggcagcaaatagaatcgccattgaaacttttataaaaagtacagatgctatactttttacttttataaaaatacaaaccccaacccagacctattaaaccaagtccctaacaaaatatggccaagttctatgtttttaaaagttccacaaggtgttctgatgttcgcagagttaataattgctcaattcttcttaaagattttgattctgtaggcacacattatatgaccccaaacaattgcattgtgtaaaagtctggtttcatgtaattatattctattgtgggttatatatttgtttctttgccaactccagctttgtaaagaatttttctgtaaaccattcaaaaagatagaaaacataaatgggaacagctgttgtagctataattcactaattacccttcactaattagaattcagcagaaccctgcctgtgttccagagtaagagggcgatgtgaatctgctattttactggatcttagtacctcttgcttctcatagaacaccttatcataccagctgtgattccagtgtttaaagacgcagtatgtatacatttgcatttatattgtttattagatactctacactactgtatagttataagtatatccactattgtgcagaattttgtacataaagccctgcttacgcatttgatggtcaatttaaaagatttttcaaggttaatt

SEQ ID NO: 256410 - DNA, 497 bp, Homo sapiens
tttcagctggggactcagggaggagctgataatcttgattgagggtcatggagctggagacccagacaggatttgatgttctagttagtggatcttccagctgcagacccagggaggagctgatgttctagtttgagggtcgtgcagctgaagacccggggaggagctgatgttctagattgagggtcgtggagctgcagacccggagaggagctgatgttctagtttgagggtcatgcagctggagacctggagaggagctgatgttctagtttgaggttcttgtagctggagacctggagaggagctgatgttctagattgagagtcgtgcagctgtacacctggagaggagccaatgttctagattgagactcgtgcagctgcgcacttggagaggagctgatgttctagattgatggtcttgcagctgcagacctggagaggagctgaggaccatcgttgccacgggtcctcactttctgagtcactgatacg

SEQ ID NO: 256411 - DNA, 441 bp, Homo sapiens
ccatcactcactctccacccacaacaccatcaccacactcactctaccaactccaccatcaccactcactctccacctacaccaccatcactctctaactactacaccatcactgatcactctcctcactgctccacagtcatttcctacccactctgcaaacttttcagagtacctctctcctccctcgtgtgtagctccttgccatatagaccttcacacccactgcctgtcaactgctgttcaaagatgacacccccagaggactgacctcatcctcttctttctgcccctcactcacatggagccatttgtggccttttcccacccgcttgtctccctgtgccctacttgaggttggaagctccggagttgtttttctcttgtgttctctccagaaccttccagcctcaggtcttggatgtccttgtttctcctcct

SEQ ID NO: 256412 - DNA, 419 bp, Homo sapiens
ttctcataaagagcagcagcctgcagggtagcccttctggtaggctgggaagcatagcctctgatcagaagccgagaacagatacttggagataagggcaaagggaacaggaatttatgctgagcagagtggctgaatatgcctatttaataaactataagaggagtcatgaatatttatgaaaggagaaacacacgcatgtgcaattgagatttatgccccattcataggtcccatgtataaaatacagcagcattagcattattcgagggtggagttttctgccttccgatgtcaaaaggtgaggcagaggatatgaaaacccttactgtgcattatctgtagcacaactccatggtcagtggtctcttatcaggccaaaaggcaaggcactctcagatagttggttactgacagtg

SEQ ID NO: 256413 - DNA, 333 bp, Homo sapiens
tgagaccagcctggccaacatggtgaaactctatctctactaaaaatacaaaaattagctgggtgtggtggtgcatgcctgtaatcccagctactaggaaggctgaggcaggagagttgcttgaacctgggaggcaagaggttgcagtgagccgagatctcgccactgcactccagcctgggcgacagagtgagactccgtctcaaaaaaaaaaaaagaaaaaagaaatgataaactgctctagaacagagaaacttgggaaaaggaatgtttggcccaatggaaaattctggatatattcattatctataaataatgcattttattattttt

SEQ ID NO: 256414 - DNA, 977 bp, Homo sapiens
ttcagaatttatcatattttttcaataaatgtttataaatcaaagtatgtcagatgctttattccctatatgatctgtctttcctggactattctggactcttcctattgatctctcatttgctaccttgagaccatttctctcacagcagccagagaaatctgctcataatgtaaatctcatcatgctaattcctcaggtaaaaaacctcctgtggaggacatattcatctggtaatgttggaagaagaccctaccatatggctttctgcaaaaaagaccactatactacctgtttggaatacaaaaagtaactgactgaaattactggacaggaagaacagatgctagttgagaaagagaagaggggagctgggagcctgaggagaaggcttttagtctagggctaagtgcagtaggtatagggaaggacagtaaggtagggcagggatgtcagtgggaaaactatgggtctcttcaccaggaaaactggaaaattgaagctagggaaaccttggccactgaagagagtggaagaatcctgcaagggaaagagccaagaaagggtacccagattctgtctgaaatctgaataattcctgtgtgtcacagactcagagcagccaaatgaagggcacaagatctgaactgaaactggagttgctgcccaataaacagaacagttcaagttaagcaaagataattgcttcttacaacaaaaccattctcattttagaaaaataacagaatttaggatcttcacaatgtaacatttatgatgttcaggatacagttctaaaattatccagcatagaaagaaggtcaaagaaaccaaatgctggtttatagaataggagctttaggccaggtgtgtggtgcacacctaatcccagcattttgggaggctgaggtgggaggatcatttgagcccagaagttcaagaccagcctgggcaacaaagcaagaccccatctctta

SEQ ID NO: 256415 - DNA, 317 bp, Homo sapiens
acacagctatgtgactgagccacaggaggcgtcaccggggctgcactagaatgcggaaaaggggcgtggccttaatgctccaagcccattggtcaatgagaaagatgaaagggaaaggaggcggggccaggcagctgcgggtcatgaaggtcctgtgatgtcacaaggaaagcctcccatggaactgctgtccccgcccactctgggagaggggcggggctggctttcacttactttttttttttttttacatatataactttttattataatttaaggtatagtcgataatataatgtttttttttgttttaaaaa

SEQ ID NO: 256416 - DNA, 490 bp, Homo sapiens
aatgagacaaagatatgtaaagcacttggtatttcacccaccacgcaatacatgtttaatgaaggctgggcatatttttttctcagagactttatacataacaagtactcaaaatacaggtattgacaaggaataagatgaggtttaaataattattagaggctatatattaagccagagatctatctagtttttaaagtttaggttgggtccagtggctcatgcctgtaaccccggtactttgggaggctaaggcagaaggatcacttgagtccaggagtttaagaccagcctgggcaacatactgagatcctgtctctaccaaaaatttaaaaattagctgggcattgtggcatgcacccatagccccagctattcaggagattgagatgggaggattgcttgagcccaggaggctgagagtgcagtaagcagtgattgagccactgcactccagcctgggtaacactgtgagacccgcctcaaaaaa

SEQ ID NO: 256417 - DNA, 520 bp, Homo sapiens
gtagaattaggaacgtagcccagggctcttcccatgacactgtcggggagggagaaggaaaccggcactgagctggtctcccctaccggccaaccaagaggctggctgagtgagcaagggttgggaggccctgttggtgcaccatgcccagctaatctttgtatttttagtagagacagggtttcactatgttggccaggctggtctccaacccctgagccacctcgcccgacttcattctacagtcttaacagaaagcaatttcagaagtggtgattcccatcattagaagtctgcgttaggaatcagcaaggtatagtccacagagtggtttttatattttgtaatggttggagaaaagtcaaagaataataagattttatgacataaaattatataaaattcaaatttccatgtcaataaatgaagttttactgttatttattaaaatttctgatatagccacactcatttgttgacttgactttgcactacaaacttcaacagcagagttgcgtga

SEQ ID NO: 256418 - DNA, 419 bp, Homo sapiens
agagccagtgaggcttggtgcatttaaggaccctactgaaaacaagactgttgtttcagagaataaagagaaaggggagaatagagtgagaaaagactggggaagcttgatcactgaggtcttatgggccattcaaagtgtgtagtttagtcttgattctaagaatagtaagtcactgaaaggatttaagcacaagttttacctgatctgatttgcattactctggctataagaagatgcatttagatatgttactctggctataaaaaggataatttcagtagttgaagagagagatgatggcagcttggttttggacccaggatctttaaattcttaaaaaattattgaggaccccaaagtgcttttgtttatatggcttatatctattgatattcactatatttgtaataggaatt

SEQ ID NO: 256419 - DNA, 197 bp, Homo sapiens
  misc_feature (60)..(60): n is a, c, g, or t
  misc_feature (99)..(99): n is a, c, g, or t
cctgtacctaccgggcctgacccttctgctccaatacctctcaggcgagaaccaagaacnaaattgagcaaagattccaccagtacccaagagcttttntcattcaatggctggttgggaatccagcatttgggaagctggattcatacgaaatgactccaagacgcttagctatctctctgaaaactgaaaaaaaa

SEQ ID NO: 256420 - DNA, 342 bp, Homo sapiens
tacaaaaaaggtaagggtctggaataagtgggttttggattatttctgccagttttgtgtctcgatgtgagtaaattttatgtacattcctcccttttctctcctccatcgtcccagctgtccttctgctgggtctcatgcctcatcaaagtgaaaggatctcaaaacctatttcaggaggtactttattaaaacagatggattgggtttctgggttcctctcttgccaaactccgaagaaaaccccaccaaatctttgatcttgcagtgtgtacaggtatatgtgcaattaactcctgtttcccaaactacccaatgaggcaggtactaaaaggagggtcc

SEQ ID NO: 256421 - DNA, 498 bp, Homo sapiens
agacacacaaaacaaaagtactagaatacaaagcccagaaataaactcacacatatacaatcaactgatatttgacaagtgtgtcaagaatacataatggagaaaagatgctgtcttcagtaaatagtgctgggaaatctgtacacccaaatgcaaaagaatgaaactggatgcttatcttatgccacaaataaaaataaactcaaaactgactaaagactcaaggtaaatttactcaatttaccttgcgtctttagttttacctgaaattgtaaaactcctagaagaaaacatagggaaaatgttcttgacattatcttggcaatgatttcttggatataacaccaaaagcacaggcaagaaaaggaaaaatagaccagtgggactacatcaaaccaaaacacttgtgcataccaaaagaaacaaccaacagaacaaaaaggcaacttatggaatgggaaaatatttgcaaactatatatctgaaaaggggttaata

SEQ ID NO: 256422 - DNA, 476 bp, Homo sapiens
ccagctacttgggaggctgaggcaggagaatcgcttgaacctgggaggcagaggttgcagtgagccaagatcgtgccattgcactctagcctgggcaacaagagtgaaactccatctcaaaaaaaaaaaaaaaagaaaaaaagaaaaaactttccttcagctactatttagtacccaatgatatagtaaagaaacacaggaggctgggtgttttggctcacccctgtaatcctagcacttagggaggccaaggcgggtggattgcgtgagctcaggagtttaagaccagcctgggcaacacggccatctcaactaaaatacaaaaacttagccaggcttggcggtgtgtgcctgtagtcccagctactcaggaggctgagtcaggagaattacttgaacctgggaggcggaggttgcagtgagccgaaatcgcaccactgcactccagcctgggcgacagagtgagactccgtctc

SEQ ID NO: 256423 - DNA, 427 bp, Homo sapiens
catttgttcaagtctactcttggggctttcagaagtctttaaaaattttcctcacttaggttttgccatttctttttatgtttatctatattttattatctttgttgctattaaaaggaagttttccggttattatgtatgtacagtatttgaaggctatcagtttctgaatataattttatatcctgctacctcactgaatttttactgttgaaggatacatatatatatgcctgggtaacatggtgaaatcccatcttgacaaaaaatacaaaaattagctgcgcatagtggtgcatccttgtagtcccagctgcttgggaggctgaggtaagaggatcactgggtcccaggaggttgaggctgcagtgagccatgagtgtgccactgaacaccagcttgggtggcagagtgaaactctgtctca

SEQ ID NO: 256424 - DNA, 473 bp, Homo sapiens
cgccacctctgcttggccggtgcctggcctccatcacagtccagcgcaactgtcacctcctccaaggtgctccctgagcccctccctctctggagcagggcctctcttgcccgcacccacatggcctctgcaagcctctgcctgctcagtctcgttagtcctcagaggagggtccagtcttcccctgtgtctaccctctggaactccacacagcatctcgcttggagaaagcactggctggttccttgttgaattaatggccatcaaatgacacacggcacagtccaaccctgcacacccatcagccagaaacagctctgcctccgaggccccacgcacctcttcctctttaattaactcgacacctctactgagcacctgctacccgctggtcataagcatgcagcagtaaacgaagagaccttcctgcccccacagagcagagagtaaataaacacacccaaaacaataca

SEQ ID NO: 256425 - DNA, 392 bp, Homo sapiens
gatggtgaaaacctgacttatggaacactgtgaaagaaacgtagcttagttgttttcaataatgtccaggattggtctccaaccagagaagggggatggagtagtaagcaggcttctttttaagagagcgtatttaaactgggtgggacttgtattaagtatgctcatcactcagaatgattttccgaaagaatttgacacttctgaccctaatagtgttccatttgattttacaaactccattttccatctggttgcttctctggcctcttcttcctctttgttccacataggtgagagttcccgcaagtgtctgtctggctattttctgttttctttctctttttactcacagagttttctaacacatttttttccctcaaatactttaa

SEQ ID NO: 256426 - DNA, 185 bp, Homo sapiens
gaagtgtgtaataccctttaattagtgaatgagccatgattctagcagagtgagagaaggctgtctgcggagggtaaaagtcccagggaagccaggtgtgggatgctgactacaatgtaaacaggtgtgcttcatgctcatgcaagtacactcttagccctcaactaggacaatctgatttcaga

SEQ ID NO: 256427 - DNA, 142 bp, Homo sapiens
catgccggggagtggcattcacaaaggttatgagtgtgaagtgagaatagctaaggttagcaggttcgtaggtgtacactcctgaccgttgagagaatgatcctggatttactgctcgttaatgaatggttaggaatcctag

SEQ ID NO: 256428 - DNA, 389 bp, Homo sapiens
aaggcttaacacctgaaaattccagagtcagatgagctcggatctgactactgaggaattgacggcttcaatgtttataagagtgcgtagacccaaggaagtgggtggagacctaacaaggaagtgatggaagactttttttttggagaagtttggccttgaagaggtaatggccgtggctgagggagagagtgggtggatagaaagcaaggtctgaaatgtagaattggtttttctcttcacaggaaaaaatgttgatcatgtttataaattgaaaagattaaaaatatatgaaagggaagactgatgttaataattggacagcatcttgattatgactgagtaaacaatgtgaggatggactgcctttgagcagaagggtttttccc

SEQ ID NO: 256429 - DNA, 366 bp, Homo sapiens
ctggagtccagaatggtttgccagcaccaccttagacaacacagcgtacctgcaagccttgggtttctcatctcccaaatgaggatgctaaaaagtaagccaaatgcttttgcaattcaaaaatgttatacaaacattgccacttttttcaatatcctgaacatcctgaattgttaaatagatccttctagacaccaactcttaggaattctatttgaatcaggacagccttgcatgggccaccagactgcttgtaaatgcagaagatataattgaaacttcataaagacaacaggaaatttatttgaaagtgttgaattcacattgcagaatgatttatgcacagttacgatttatgcagttagc

SEQ ID NO: 256430 - DNA, 264 bp, Homo sapiens
acccctcttcctgtcaccagcacttcctcagcatccacaggtgacaccacccctcttcctgtcaccgacacttcctcagcatccacaggtcacgccacccctcttcctgtcaccgacacttcctcagcatccacaggtcacgccacccctcttcctgtcaccagcctttcctcagtatccacaggtcacgccacccctcttgctgtcagcagtgctacctcagcttccacagtatcctcggactcccctctgaagatggaaaca

SEQ ID NO: 256431 - DNA, 518 bp, Homo sapiens
cgcctgcgctgtctgcgcctgggtctcttcaaccgcagtgagcggtcgcacggctccacatcagggtcgccctgaggctcagccttccccggccccattccgagtgcgcacaggactgaacgagcacgcccggtccctgctccggagcggaggacacgacgcggacccgcacggtgcaccgcagtgacctgaggaaggagcgacgggcgctcgcgccaaaggcgtccgagtgcctggtaaactgtaaagcgcggtcctgcgtgagttgctatggctacagctgcgccaggcggacggcctgcaggaccgaggtgcagctgggacgagcggaaagctctgcgcgtgggcggggagcccggagcctcgccggggcaatgtcatctaggtgctcggcgctccactgatccggcccccgggggtgggcgggcacgtttgcctcggatggtctaacaggcgtcggggagagccaatggtgtggcttcatggctccacccccttccattcgattggccggcgcc

SEQ ID NO: 256432 - DNA, 255 bp, Homo sapiens
atgatcattccgttacctatacacaggttgggattacctgggcagtttctgaagtcaagatgctaaaatgaccctcaggacagagttcttaaaattttatgagcaatatgtttctcccaaaagcaatcttaccatttagatattttatattaatgaacaattcatctaagggccatttaagcaatgtaatagggcatacagtaatatttggcaacagtatttgcttactaaatgttgatcaaataaacgatttgg

SEQ ID NO: 256433 - DNA, 516 bp, Homo sapiens
ggagaatacactcttctcatattgaaaactaaagaaaattattcattggtgctctataattcagtgacttgagcattttccatgtgctacccgcagtaaacaaaacaagatgagtaaaagtctcatttttgatgtaataataatataattaatttagaaatcacttcagtatacttactgaaaaatatatttatatttagtttttaataagcgttttatttttagaataattttatatttacaggaaagttgcagaaataaaacagagttcacgtataagtataatccagcttccacttatgctaatagcttacatgactgtggaacatttgtcaaagctaagaacttgactttggttacattactattaaatatttctattgactactttcagacctcatttgtatttcaccagtttttccaccagttttccacttttctgttccaggatccagtccaagttagcacattgcactttctatgatgtcttcttaatctcttctggttcatttgttt

SEQ ID NO: 256434 - DNA, 458 bp, Homo sapiens
ttctgtaaaacacgtgtgcaatttggggacagtttgtcatcattgtggcttctggtttttacatgttttgctcttgtcatattgatgtacaaattcaaggttagtgctgacattcagaagaaagcaaggcataattgtgtgtcatgctctttattagacttgttccctgatggaactgagagcttattgctattgatttaaatgtgttcaggtattattgataacagggaatgaagatgcattcaggggcttcacttcctcgtagggtccatgttcccctagaagggcctctgtgagccatgtagggtgcctgtgggggctgttgccaggcaggggaggctggtatccaagtagaactaggtgacacgcagccccaggagaccagagagagagtgggaaggagagcctgaagtgggaagtagagcctgaattgccagcaagtaaagaagcaaactgga

SEQ ID NO: 256435 - DNA, 493 bp, Homo sapiens
actttcagccccatgccccatcctttggaaggggagagaggctgcagattgagttacaattgattatgcccatatgattaagtctccataaaaatccctgaactacaggatcctgagagcgtccgtgttacggaacatgtggagctgatgtgccctgagaggacacagaagccccgtgtccctgccccatgtctgtctcccatctagctgttctgataagtactttcataataaatggttaaatgtaaataagatgtttccctaagccattctagcaaaggattgaatccaaaagtgtgaggcagcagtggggagtgttgtgggaacctctgatttgcaactggttggtcagaataccaggttgaaccggggatttgtggttgggtctgaattaagggtagtcttgtgggactgagcccataacctccaggtaggtagagtcagagttgagttaaatttgcaagatcacctaccagagaattgatgtgtggga

SEQ ID NO: 256436 - DNA, 1336 bp, Homo sapiens
agtcttaacttcttccagcaccaactcaaaagtccaaaaaccagaatctcatctaaaccagacacagatgagactcaaaggtttgtttcatcctgaggcaaactgctctccagctgtgaacccatgaaatcaaacaagttaatgtgcttccaaaatacaatggtgggacatgtataggatagatgttcccattccaaaagggagaaataagaagaaaggggttgcaagtaagtccaaaacccaacaagaaaaacaacaagtcttgagattaatctttgcttgatgctgatcttgtgaacacagtgggggcagagtatttttagttttggggaaaactccatattattgatttctaaagtttctttagctaaggtcttcagcatattttttaagtacctgataatgtctctgtcttccccattaaactgtaagctccttgatgagtttattcacctttgtgcctctagctcagtgccaggtggtcaataatgtgtgttaaatgaataaatggctggtgctctgatttgaatatttgcccaagaatcagaaccgagctcttcactggaacctgatcttctacctaaaaccaagtcacgaatttttacttctctggccccacccccacttttttttttgagatggagtcttgctctgtcacccaggctggagtgcagtggcacgttcttggctcactgcaagctccgcctcccgggttcatgccattctcctgcctcagcctcccaagtagctgggactacaggcgcccgccaccacgcctggctaattttttgtatttttagtagagacagggtttcaccgtgttagccaggatggtctcgatctcctgaccttgcgatccacctgcctcggcctcccaaagtgctgggattacaggcgtgagccaccgcgtccggccgagcctttttattagggacataatattcactcctagattttttgcctgatcccacagtctttgagctcctcaggctgagactgctattgaaacactcaggattaaaatactaacatcttcatgttttcctccagaatctttcttgaatttacgaaattcgaaagctgctccattggaaaccattcaggaattgtcatgggtttaggttaaaaacaaaacaaaacaaaacaaaacaacacagcagttgtgccatggaaagcagatcacttgaaacaggtcttccttttctgttttcttgtagccgggtcctcctccctgaagcctccactcctgtcttctctgatgccggacttgtgtctttcctctactttttctccgtccttttctgagaccctaaattacagtatgtctgcctgtagt

SEQ ID NO: 256437 - DNA, 540 bp, Homo sapiens
tctgctctatcacttactataatagctgtgtaagttaacctgtctgaaatgtggagataatacttgccttacataattactatgagcatttgtgtatgtgcaggtgggcgtgggtgtgtatcagacatttattagagtatacagtaaacagttaatgaactaaggttactaatagtgtttactgtgggttggctatgtgcaaaagtgctttgtgaatgtaatttgatttaattacagtaacttagaatggccggtaccattattaatcccttttttataaataaggaaatggataaagaaaggttaggtaacttactcattattatacagctagttattgatagagccgagattcacactccagtggtgtaactccaaagcacttgccagtataatacattgctcccaggcagccagaaataaaaaaattgttccttttacgtacgacagacttctgaaatggtagtagtagtgcccttttttttttctctttttagcccaggaaagatttagaataaaatctagtttagatgagcacat

SEQ ID NO: 256438 - DNA, 345 bp, Homo sapiens
tatcaacaatatcatacaacttttaaatttcctgtaaatcttaaggtcataaagtagtacattattattgtttaaatttgcataatctgattactaacaaggttgagactatctaatatgcttattagtcattttaactttcattttgtgaactgcttctccctatcctttgtctgcttttctgttgggttttctgctctattttccgaagttctttatttttaactattgatttttgttggcaatatatactgcaaaaaatagatttcctatgtgtctgttatggatgacttttttgaacagaaatccttaaatttaatgtaatagattcatcacattttccct

SEQ ID NO: 256439 - DNA, 503 bp, Homo sapiens
ggggggatgcacatgtcagcagaaatcctggttgtatggtaatgttatcagctgcccttttggagctcagcttgaaagtgtgactaaagctcctctggctgctataaagctagtactttagacttaaagcattgtaaggcagatgcctcagagtggaaagttgcccgggcctggccgggagctagtggagcaagttacaggaagaactagtgcctagagctggggggtggagagagcacttgtgcctcaccctttgcctgtcagttgttcagcgtgtaacagttccctgcttcttaggttctttctgtacccttttataagggtgtatccccttttggtaacttactgtttgttaatttgtagtgttccctgccagtaagcttgtaacactctagtgactcaccttcgggtgggagggtaggaaagggagaggcctgcctcctaaacctgggaagatggggagagagtggtaaacctgagagcccaaaaaacaaaccaaaaca

SEQ ID NO: 256440 - DNA, 2725 bp, Homo sapiens
  misc_feature (1)..(2): n is a, c, g, or t
  misc_feature (943)..(943): n is a, c, g, or t
  misc_feature (1047)..(1047): n is a, c, g, or t
  misc_feature (1162)..(1162): n is a, c, g, or t
  misc_feature (1190)..(1190): n is a, c, g, or t
  misc_feature (1468)..(1468): n is a, c, g, or t
  misc_feature (1517)..(1517): n is a, c, g, or t
  misc_feature (1635)..(1635): n is a, c, g, or t
  misc_feature (1955)..(1955): n is a, c, g, or t
nncacaaggctatgttcatgcactacttcggtataatctcaaaataattgccagctccccagtggaacgcctgccttggtccatgtggaatgtgggcatatggtaggatttccttggaggaactagaagaggaacataaagaatgttaggcatataaattattgtttctttttcttcttgtttctttccactgagttatgtgtgagcccccacacccaccctaccttcctgtcctctaccttactgatgctattttcaggctgttgtagaattgggtgtgtaaaattaaattagcctttctcctcttaatatctgtaaaatgaacaaatttgacaaagaaactacctatctgatatataagaaggttattagcctgtaccacaagtgaaaaagtttcatcctgatatatcaaaatagtaccacttgaaggaaaacgttggggccatctgtttctctcattgtagttagagtacagatttttaaaatatgagcctcaggcataaaaatgcagtattagcaactcaacttgaagaagcagttactagtgtcctgggtgggccacagggaaaatagtaccaactgcctgttatatttaactgcaattaaaaatggcagtgctgggtatcttctgtctctgggtcatctcctaaagatcctgcagagggagccatagctagtgtagaggccagccataactagccatggcaaagaccacagggaacgctcttcaacatgctctgcactgatcctctaccctggtgtggagaaatgtcagattcatcactaacaaggttaaaggtgtaaattgagggaaaaaaatgagaaaagttatctttcacataagacttcagaaagaaattgcgtcgtcaggtttggaactggtttgtaatttcatccagttattttcattttaattactgtcactgttttcttcatccttganaaactatgagctctttgagattgtctttttcatatcctgatgtcagagcttcctgtattttctgatcatggtatgtgctaagtaaatgcaatttttagcatttngaatggtttatcaaatgattgaaggagtgggtaataatatagattacatatacagtcagccacatatgtgtatgtatgtgtatttgtgtgtgtgtgtgtatatgtatatactgtngaccctccgtatcaatgggtttcacatntgtggattcatccaatcatggatcaaaaatattctttaaaaatatggttgcatctgtactgaacaggcacaaactttttttcttatcattattccctaaacaatgcagtatgacaactatttatcatagcattgacactgcattagatatgataagtaatctagagattaaagtatataggaggatgcatgtggatcatatgcaaataatacactacatcttatataagggacttgaacatccatggagtttggtatgtggtgggtgatacctcctcnttgaggaggtgagtatcagagacgcaggtaaatatgatccagagggcanagaggcattgccagcctcacactggctgtcaacaccatgctgagttccacgaaagcagcgaggagagggtggtgttcttgtttctggtacaatacctggcatagagaagatgtcacancaatgttcgtctattgaataagtcaccaaaattgtgaatgactgaataaatgggcaaagggatttgttccctacttgctgtgggaagtttcttgtagttatgacctccatgaaagagagactcgtatctggagaaagttcatagctgaaaccatgagatttaacttttgaagttataatggatctatttttttaacatcataaatgaagattatgcaatactgtatgtgcttcaattgacacaaccccttcccattcagggctgatttatgttctgtactgaatgacaggcacagaagtaaatgtgataatcctgtcccntcgttaccctttattgtggtcttgctgtgtcccagccacacacttcatactgtatctgtgtcatcattctcatatacatctatataggtacacttccatagacttaggcccatttaatggaggagcaactccaacatttagagatcatgaaaggtacctcatgacatatattgacctagtggcagagctgcttagttctacagcctctgagtggaatcctcacgacagtaaaaacacaagcttggtttctcacacactctacctgctttttctcatcccctttagtctctattccttgctgagatgtgttaggcattaaatggttacagtctacttctgtgtgtagtctccaaacactcagaaacctcaaaatttaaaaaaatacagaacaatatgttattaaataatcagggacaagttaaaatggtaaagagaataggccactttgtgaaatcatatgcagggaagaaaaaaatactggagtgaaaacaatataaaaataatactagatgctgtttcgtagcaccaagtgtgttctagcttctgtggttgttgctttatatcattttatataatctttacacaaaacctacaagcagatattatttcccctatttcaaaaatgagaaaaccaaggcaaatagttggtaagtagtacatatatattatcctaactctgaacttctggattcaaagaccatgttctaggataccattttgtgtaccagcatggaatatgtttttagttcatctatttactctaaaaatgt

SEQ ID NO: 256441 - DNA, 466 bp, Homo sapiens
tttttcattctaacttctgaatttaaatctgaatcctctatagcaggggtccccaactcccaggccacacacagttccatgacctgttaggaagcaggctgcacagcaggaggtgagtggcaggcaagcgagtgaagcttcatctgtatttccagccactccctgttgctcacattatcacctgagctctgcctcctgtcagatcagcaaagccattagattctcacaggagtgaaaatcctactgtgaactgctcgttcaagggatctaggtcacatgctccttatgagactctaatgcctgatgatatgtcattgtctcctatctcttcacgatgggaccatctagttacagaaaaacaagctcaggactcccattgattctccattatgatgagttgtgtaattatttcattatgtattacaatgtagtcataataggaataaagtgcacaatagatgtaata

SEQ ID NO: 256442 - DNA, 363 bp, Homo sapiens
gaccttagggctttgaaggcccctggccctgcaaagcacgaactccttccctccatcccagaccccagcctgggggagttctccagatccccaagcaggctgagcccacttacccagagtccagagtaaacggtcactggaccaagcaaggacgtgtccctgccctcagctgggccgctttttcagtcctcagtcccctagagtccccgtctcctgtcagcctctcccactccgcagcccttactccctcctcccactgtctccctggtactcgcaacgccactactgggccagagatgggagggggacgggagtgctgggggtgccagactagcagcatagtcaataaaactggatcacagc

SEQ ID NO: 256443 - DNA, 350 bp, Homo sapiens
tagcagtgaaatttattatcatttgtattaagaagagatgactattagatgccatgccataaccaactcttctccagtagattaggaggaccaggcctgatactgaatattggaactgttggcaagaaaatgaaagttcgtgactgcttgagttatttttaaaactctagttgcatggctgttatgtctcaaatactatataattatccctagttactggtatctttagcatatttgaaaccatccatatgtgacctaaagccacacagctatattaagacatttttgaacaatcaaagcaaatgacactttaaattaaaacaaaactaatatgaagcaactactttaaa

SEQ ID NO: 256444 - DNA, 431 bp, Homo sapiens
gtgaatcctccactgcccacaccatgcttctctctgctagactccttatcacaccacgtgtcttgtttacctgtctgcctccctcattaatctgtgaactctgaagttttgaaggcacgaatggtctcagtaacacagtatctggcatatagaactgttgcttaataaatatttgtctgtttgatggatggagactggtgctaacaagtcttcattttgcaactctggtttctagcttttaccggcagattaagaacaaaagggattccatcacaaatcctgggagaatcatgacaaatgcttagcttcagttcagaaagaagcaagactatttatagctcagggactcaacattaaatgacccggacttaatttttccttgtgacctagatttgcacaactttagatggaaagtgcccttggagatcatt

SEQ ID NO: 256445 - DNA, 494 bp, Homo sapiens
gaaaaatgaaaaaataggctttataaaaggcactgtcttgatcccaacttcccatcatgatcaattttagaagagtatccatagaggattagaatctggaaaacaaccccctatctattgctgcatagcaaacaaccccaaacttagcctaaaatcatcactatcatttactctgctcacaattctataatttgggcagggctcagtgagcaaagcttgtccctgctccatgtggcgtcaggaagcaaggcttgaccaaggatggagagtctgactcagaggtggctccatctcacagatagcacattgttatctgctgccaactgggatctcagtcaggatggaggccagagactctgggccctgtgcagagaagaatgaaatagcaagtctgactgctatccttagaaagacctgtttgcaaaattggtctttagctggcatttgggaattagaatttggggagggttcccaccaccctatcaccaccctgt

SEQ ID NO: 256446 - DNA, 242 bp, Homo sapiens
gacagtgcagtggttcaccatcagaggaaatgtgataggaggtgtaggttctagacttgggcatattgtctctgtggtatctgaaggacaacaaacttagatggtcatgaagctcaggagaacttcatttaaacagcatcattgactgggcacagtggctcatgcttgcaatcccagcattttgagaggccgggttaggcagatcacctgagctcaggagtttgagaccagcctgggcaaca

SEQ ID NO: 256447 - DNA, 469 bp, Homo sapiens
aaggggcaagaggattcattcagctgccccaccactgctatagttcacatcatattcctaacctgtcttttacccccaaccactctagggtccattttgcttttcatcctagaagttcaactccaaaaaagaactgaccccaaaacagcattcatttgttcattactcaacaaatgcctgctgagcatctagtgtgtgttagatgctgaataaaacagacccctaacttcagagagctaagtcaggtattttaagaaatgtacattaaattttcctctgttaatttgtacactacacctctgtggtcccaaattttcttataggattgaagtaaaagactgagtataaaaggtcgggagaaagctgacatatggagtaggtaggaagaaccttagtactggaaatataggaaataaggtgttcaggactcttggggacaaaggcaaagatgtgactacccggcagaggg

SEQ ID NO: 256448 - DNA, 419 bp, Homo sapiens
ttggtgacgccccttggccatgctgggcttctttcctccgagggcaaaagagaagatgaacacctgcccagcctcgaggttcatgtgtgaaagggtttggatcaggccaaggtggacaggaaggctcaggagggaggagggtggtgaggaggggaggggagctatagccccggagctgcaggcttgggtttgaatcccagatctgtgactcgcagctgtggccttggtcttaactgctcagcctcactcttgtcaggaagacaatcaggaataggagtttctcttggagcaaatcaataaaagcttcaggtaaggcatttggcccagatctggcagtagtagcaagcacgtaataaatgtcaccaccgttgtttctttatctttctaggttaagctgctggcctgagtattttaaattt

SEQ ID NO: 256449 - DNA, 247 bp, Homo sapiens
atcacttgaacctgggaggcagaggtttcaatgagccgagatgatgcccctgcactccagcctgggtgacagagcgatattctgtctcaaaaaaaaaaaaaaaaaaaaaagagggtgtaattcactgaatctgattagaaaagctacacatctttatcacataagctgaaatataaaatgtgaccaaatttgaaggaagtaaaatacctgatatacgccatcttagagaatttcacggtgtctaaga

SEQ ID NO: 256450 - DNA, 588 bp, Homo sapiens
agtgttattacttccactgccaattatgcagtgggtctcttagcaggagaagataaagaagaaagaataaagtatttaacagtaagtggtgtttaattacataagagatgacaagttattttggtattaggaaatttctctgcatttccttcgacagaattttaagtaggattggtcttctgtcagcagctttttagtgactccaaatgaaaatttcctcttaagtgacttataaacccctataaagtctcagtctggttaataaaacagttattaaaatataggaaaggaaatttgaaacatgagagctgaaaactggaaattggtaataaaggaattacttgggttcctagaaccaccaatcatagacctctttctggtcacatgtttcaattaagagaatatacaattcttggttgtttgtcatgtatcattgaaaaaggaagagccatattcattcctccagtggaacaacccatggatatgcgatctcactttgctaacaggaaagaggagagcggttattcttttgggtaggttgattttataatggtttcagaatgctgtcatctctgtctagctggagag

SEQ ID NO: 256451 - DNA, 391 bp, Homo sapiens
ctacacagccacagggggccaggaagtgcaattctattatgcatgtgtctggaagaagaaggaaccaagaatccttggtgatttctaaacatgaatgatcatcgcagccacctgcttcctagccatgtgaccctcagcagcatcttgtcttgatccttggggcacagctgccgaggtagtgggtactatggagcaggagggtcaggaggagatgtgggtggggaaatggagtcccttgtcccttccctgatgcagagaacttggaggtgctcttctagcaaggaggagaaagtgaaaagactgtgatctttcaaaaaccaattggcctctccgaacacacactcaataaatactcgctgaatgaataaatactcgctgaatgcatgaagaa

SEQ ID NO: 256452 - DNA, 1420 bp, Homo sapiens
gcggacgtgggcaggagggctggaaaagccggcgctggagcggaacgggagtagctgcctgggcgccaaaggccgcggcactcccacgtggaccccgaagtcccgaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggaacaagcacaagccatttgcaaggttttatccaccgcttttgactctgtattaacatctgagaaaccctgaatcctgcaatcaagtagaagtcaacttcatctgaaagttcagctgttttcaaactgcaatgctgaaatgttatgcaaataatgaagttatcccttgctctagattttctgaagaaaatggattgtgtaaaatgctgatcatttgtttattaaaatgtgtcctattacacagtgagttaactctcaatgaagtcatctattttctgggctaaaaaacttcatttgtctttttcaacttctaataagcttaacctaagtgtcacgaagacgagatgtcacagaggtccactcagtgacacacactgaaggcctgagggaagactgaggacatgggctcagtggtggcttcccagtcatggtatcactggcatggacctctgtccggcagaggtgtggactggagaccaggattcatgctggtctggaacaatgacattgccaacttaagacacacaaagcagattttcagaagtgtctggtcaagataacatgctggccaaccacaattcctagagttaagagaaccttaaaagattaccgctcatgctaaaagtatgtaaagatcccatgtacagtatgatagtgtactttttttaaaggactgtcaatatacaaaactttaaagattaaaaacattaaaaataaaaaaa

SEQ ID NO: 256453 - DNA, 1101 bp, Homo sapiens
gcggacgtgggcaggagggctggaaaagccggcgctggagcggaacgggagtagctgcctgggcgccaaaggccgcggcactcccacgtggaccccgaagtcccgaacccggggatgggcccgcggctgcgaggggatcttctctggatcaagcaatggtggtgaaaaatgtttcgcaagggcaaaaaacgacacagtagtagcagttcccaaagtagcgaaatcagtactaagagcaagtctgtggattctagccttgggggtctttcacgatccagcactgtggccagcctcgacacagattccaccaaaagctcaggacaaagcaacaataattcagatacctgtgcagaatttcgaataaaatatgttggtgccattgagaaactgaaactctccgagggaaaaggccttgaagggccattagacctgataaattatatagacgttgcccagcaagatggaaagttgccttttgttcctccggaggaagaatttattatgggagtttccaagtatggcataaaagtatcaacatcagatcaatatgatgttttgcacaggcatgctctctacttaataatccggatggtgtgttacgatgacggtctgggggcgggaaaaagcttactggctctgaagaccacagatgcaagcaatgaggaatacagcctgtgggtttatcagtgcaacagcctggtgagacttcgttactttggttagctgcttgcccatcaagtcgcaacacccagggactactgtttttgaaggctgaagaaatacaatccattatatatggaatatcttggcctggggatagtgaatgaatattaggccggaggtcagccggctggcaagacagtgcaggtttgtgaaatatttgttagggccagtggcagcactcgcttgtgccgggatttaaaaggtaaacaaagcagctgaggaaaaatgtatcctccaggggccgaaggcttcttccatttccgaacgttgttgccctcctagactgcgtgatcagcctttgcaggctgcagtcgctgtttgctttcctctgaaggagggcagaaagggcccacgtgcagggaagctcatagtatgggt

SEQ ID NO: 256454 - DNA, 608 bp, Homo sapiens
aaaaattatccagtaaatacaggatggtcaagaatatttcacagaattgccttcagttacattcattattcacatagccatcattttttatcattagagacagcatttgagcagtaccatgaaagtacaatctgcaaaatgagaattaattatatgtaataacagttatgtagatataataaaattttaaaagtaaaatgattcaaatattaagatatttaaaatatcgaaacctttggtccttcaattattttcacataatttacttaaatcgtgagaggtggacttgggcttttactagtattggtaactttaatatattacttataatttgagatttcccaaactgcaataaatgaaatatctgttaataacttaattattgtttgcttatattgaaaagtttattgcataaaggaaatcccacagtctgctcttgaattgatggcaattatcataacattatgaaattactataacaagaatatacaattaatcagttctatatttcatactaacatgtgtgtgccctgatgcattgctttcagcaatatagcagctgctctttaatgcattttttatgtctccaagtaattctttcatgatga

SEQ ID NO: 256455 - DNA, 460 bp, Homo sapiens
atcagcaaatagtctttttgttgttgttgttatgtgtgtgtcagagccactacatttaggttgtagacattatatacccttggcaatgatttagctcttgaatgtttgtgttagcctaagtataaatagatcttttaaatagatcaattataaaccatagatcaattataaactatggagctaaacaaaatattaataaaagtttatctgaaacttttttgtttatttcagagcacattattagaatattatttgcaagaaatgcagacctaagcttatatgtgaacttatttctcagcttttctatgcctccatttggggatttgagggctttcttctccataagaaaaaaatttctctccagtttctaccataattaattgtgttttccagaatgaggtattatttaaggcagacactgcccctctcaaaaaaaaatcagttttcatttgcatagtga

SEQ ID NO: 256456 - DNA, 366 bp, Homo sapiens
caggtgctttcaagtttggcctcaactctctctttccctttggattttatctgcttcttctctgataaaagaattcttcagtgaaaaagtctgggccaggtgctgtggctcctgtaatcccaacactttgggaggccaaagcgggcggatcacaaggtcaagagatcaagtctatcctggtgaacacggtaaaaccccatctctaaaaaaatacaaaaattagctgagcgtggtggtgcgtgcctataatcccagctactcgggaggctgaggcagagaatagcttgaacctgggaggcggaggttgcagtgagctgagatcgtgccactgcattccagcctggtgacagagtgagactatctcaa

SEQ ID NO: 256457 - DNA, 142 bp, Homo sapiens
ggggaggaggaaatccccagtgaggctgaaagccagccacactgggcccgccacacacgctggctctcacacagggcgggccagctccaaagtcaccagggagccgggaagcactgctccaaatcatgtgctattttttact

SEQ ID NO: 256458 - DNA, 278 bp, Homo sapiens
cattactctcatgagctggaattgagtgcctgtggcttttccaggagcagagtggaagttgtcagtggatctactgttttggagtctggaggatggcggccctcttctcatagcttcactatgcagtgtcccagtgggaactctgtgtgggggcttcaacccctctgcacttccctagtagaggttctgcataatggctctgcccctgtagcagccttctgcctggacaatagggatttttcatacatcctctgaaacctaggtggaggattccaagc

SEQ ID NO: 256459 - DNA, 401 bp, Homo sapiens
aataaaaccggagatattacaactgataccatgtaaatacaaaacatcactcaaggctactatgaacatctttacatgcacaaaccaggaaatctggagggtatggataaatttctgatagtatacaaccctcctagattaaatcaggaaaaatagaaaccaacagaccaataataagcaatgaaatttgatccataattttaaaaattgccaacaacaaaggaggaagtccaggaccagacggattcacagctgaatgctatcagacattcaaagaagaactggtaccaatccgactgaaactattccaaaacatagattaaaaaaaaaggaatcctccctaaatcactctatgaagccagtatcactctaacaccaaaaccaggaaaggacataacaaa

SEQ ID NO: 256460 - DNA, 708 bp, Homo sapiens
  misc_feature (9)..(9): n is a, c, g, or t
  misc_feature (67)..(68): n is a, c, g, or t
tagtggatncccccgggcgtgtcaggaattcgtgttacgagaatttttgtatatgggattgtgttcnnctgatttggcttctttgggcttgatcttgtgtgttggtgaaatagcgaactgcttagttgtttatcagcttaaggagcttttgggccaagactgtggggttttctatagcaggctaatttatgctagaaaattttaggtaatttcttatattttaggtaattttccctgtattttacctaatattttgggtaatttcataaattttaggtaatttcttataacagggtaatttttgctagaaaaaatgttggtcctgatttttaaaatacacatccacacccaggtatatttacataaaaaatcaaataagaagtataccaaaacatcaactgtgagattatctctgggtggaaagatagcagttgattttttaaatgttactttaaatattttcttaggatttccagaactttctacaataagtatgttacctcatttacaattagaaaaataatacatattttaaaataagttccatcatataataccatcttcaaagaaaccaaagtgaaaaagagttaaaccggtttttagggggaagggctatttccaccttcccgaggggccatgtgggtagaaggcaaattaaaacctgaaagtttagccaatcagtttgtcttatgggccctagatggggga

SEQ ID NO: 256461 - DNA, 695 bp, Homo sapiens
aattatgaatgggattgtgttcctgatttggctcttggcttgactgttgttggtgaataggaatgctagtgatttttgcacattgattttatatcctgagactttgctgaagttgtttatcagcttaaggagcttttgggccaagactgtggggttttctatagcaggctaatttatgctagaaaattttaggtaatttcttatattttaggtaattttccctgtattttacctaatattttgggtaatttcataaattttaggtaatttcttataacagggtaatttttgctagaaaaaatgttggtcctgatttttaaaatacacatccacacccaggtatatttacataaaaaatcaaataagaagtataccaaaacatcaactgtgagattatctctgggtggaaagatagcagttgattttttaaatgttactttaaatattttcttaggatttccagaactttctacaataagtatgttacctcatttacaattagaaaaataatacatattttaaaataagttccatcatataataccatcttcaaagaaaccaaagtgaaaaagagttaaaccggtttttagggggaagggctatttccaccttcccgaggggccatgtgggtagaaggcaaattaaaacctgaaagtttagccaatcagtttgtcttatgggccctagatggggga

SEQ ID NO: 256462 - DNA, 288 bp, Homo sapiens
aatttttgtagtttttgtagagatggggttgcaccatatttcccacactggtcttgagctgctggcctcaagcaatccatctaccttgggccttcaaaatgctgcgattacaagtgtgagccactatggctggcctatttttacatggtatttttaatgtccttttatttttaatctttttatgttcttatgctttaggaatatatctttgtaaatagcattaattcaatattatttacctttttaaagtcagacataagtaaaataaaatttccaattgaaaatata

SEQ ID NO: 256463 - DNA, 260 bp, Homo sapiens
aacaagatggaccgaccatcaacaagagtactgtttaatatatattcaaaagagatcgagaatgaatgagcagaagactcccatcagctgttccaatggaaaatcacgacctctcagtttccagacttatactagctctaagaccttgaacatatcaactaaaggagaaacaagatcttcatgaggaaggatcctgaaacaccacatgtattagtctgttttcacactgctgataaagacataccagggctgggaagaaa

SEQ ID NO: 256464 - DNA, 446 bp, Homo sapiens
aagtgccaactccaacatgaacgagagccgtctgcctgcctgggtctctggccccaggctcccttcaccccacgagcaccacttctcttccctggccccttggacccagactgcctgccgctggctctcccccatgactcagttcttgttccaactcagagagcccctgggatttgtccacactaaaagctgagctccggctcgtacaatccgtgcagggactaaggagtggcagggatgtttgtgtgctgtttctggaaagaggatgagaaggtgatgtcaaaggtaggggaagaagaaaaaaggcaaaagaagaaaaataaaaggaaaggaagaaggaggagaaccacagggtagaaatgtgggaattgtgttctattattttttgacttcttaagcttgtccaagtgaagccaagcaaagaacataaagcactgtcatgttcc

SEQ ID NO: 256465 - DNA, 265 bp, Homo sapiens
gctttttatctgcttaccaattcagttattcaacaaatatctattgagttcttactatgtaccaggcactggtatcagcagttaaccaaagagagaaaactccttgtcttcatggagccagcattctggaacgtcaggttgcagatgcaatccagagacaccattcactcagctctaaaagatgattctagaaggaaagggagacaggaaaaggaaaaaagtacaaaataaatattttatcagatgttgataattgatacagaag

SEQ ID NO: 256466 - DNA, 331 bp, Homo sapiens
attacccagaagaatgtattatcaagtatatttctatttgcattgagttctaacaaatgattactgttgcagggaaaatgtgactggcacatcagagactttatctcttgtcaccattatcatttcccaagtcctcacctagaatcaaaaagctcacaaaatccaccaaatctgcatacaccatgtctttctttcgtcacatctgtaactatttccctgcatccgctggagataggtaactacgacaaaatgaagtcctacaacaaagtctaagggcaaacatttagaaaactaatagtgaataacaaaatatgcactgaatgtggtcgag

SEQ ID NO: 256467 - DNA, 437 bp, Homo sapiens
ccatccgaggtgccagacatcttaagtgaaggaaccatcttggacatccctaccctaatggaagcccatcaagcagaagaaccagccagctgaacccagtcctgattgcaaaatcaagagaaaaaatatactgccactgctttaacccacaaagttttgggggtggcatgttttattgcaatagataacatccacacgaaaactcaaaaccaacccatggctcccatctcacccacagcaaaacgaaacgtttttatcagagcagtagggccctgaatgcctcccattcctgcattgttcttttgactctccaatgggccaagctcccctaagtgccttagtacttactgcacactgtaccttgtctccccatgtcttgcccctcagttccttctgctctctgctcctgtgtcaccttctcactgagatcctctttg

SEQ ID NO: 256468 - DNA, 470 bp, Homo sapiens
gcaatctcgagaaagactcttagttagcttttgctgataatatataccaccattagatgcaatggggaagaccaaggcaaaagtttgtgtagaggaaaaatcaaaagctctgtttgggtcattttaggttagaattattgacagacatgtggagatgtcaagcaggtagcgggatatgcaaaagtctaaaggtcagaggaagtcagggatgaagatatatgaagatatgaatttggaagtcatccaaatatcgatttcagtgactatgccctcagtgcgtcatttgagaaccaatgccttagagaataatgacagagattcagcctttaaggggcccctggggaggaggcaaccttttatagaaagaggtgtgaatcattgccccaaaatatctcctgttaagctctccctatttctgaaggtacagcctttaaaagataacccattttcaccacccgggaaatgaggag

SEQ ID NO: 256469 - DNA, 455 bp, Homo sapiens
tcttggaagaggcaacagagcagtggactagtgtcaaatcatccatttgcttgtgttacctgagtgcaattcatcctttgaagagtgtaattctcctagtccttcctcatgcccatctgaatcatagaatattctgactatatttgtgtccctagggatagagaaagagccccaggctaggagtccaaatacttgtgctccaggcccagttatcagagtactttattaccttgactaaacccttaatttcttagtgtctccattgatgcatctgcaaatgagcaatttgaattcaatgatctctaagatgcgtttgagttccaatattttacttttctctccttgcctaatgctatttaccaaaatctccaagttcaccattcagtgagatctatttcaaaatggcttgagtccctcctggatacttataagcacatagcatttggcattagaaa

SEQ ID NO: 256470 - DNA, 1036 bp, Homo sapiens
atcactatctggtgcaatgtgagtggctaccagggaccttctgaacagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaacccaaccctattgcacatcacagatcttcaggcccgggatgccggggaatatgaatgccacacacccagcaccgagaagcaatactttgggagttacagtgcaaagatgaacctagtgggtaaggagaagctgtcttcacgttgccagcgtctggcctgactcagttctttagtagtgtaattttgctttatgccatgcatttgactttgaaaaaaatcccaaaactcccagcatattttaggggtcaacagatagcacaaggaaactaaatttctgtgttcacttctaaataataggtggttgagggtgaaactttaaaaagatctaatgcagatgttaagaatttcgtaagttaactaaccctgtaactggtgaaaagggatatgaaaatataaggcaaggacgtttgtggttgatgatctgaatgacaaggaagatgagacgtatgacatcagttgggagagaggagaaacctctcggaaggataggcctttgggtagctctgagacccacggggcactgctgaagcaggaagcacatgtggctgcgggtccttgctcagaccttgtacattgaaggtcctttggctccatgcgtaaggaactatgaactggctgtctcccttgttgctccttaatgctgaaggaaacatgaggaagagggatgcaggagcttccagtgtgggcagcactggtcacagtgtttgccagtgtcaaagggttaaccatatcaaggctgttctgtttttctgcctatattaatgtccagtttttattatcacaactaagcagtgggtgttgctagttcttttattaatacacatactatcatttgtttatttttc

SEQ ID NO: 256471 - DNA, 452 bp, Homo sapiens
atacttgctagctccagactttcgtattagacttaatctgagagtatataatttttcctatgagttctttggtatgactgccatctatactgcagcttctttttactatcatcctctttttcagtgtcccatgttcttttttggtttaataaaaagtagctagtggctgggcgcaatggcccacacccataatcccagcactttgggaggccaaggcacgcaggatcccttaagcccaggaattggagactagcctgggcaacatggcgaaaccccatctcgacaaaaaatagcaaaattagctgggtgtggtggcacgtgcttgtagtttcagctacttgggaggctgaggtgggagatctcttgaacccgggaggttaagagtgcagtaagtcatgatcacacacactgcactccagcatgggcaacaaggtgaaaccctgtctcaagag

SEQ ID NO: 256472 - DNA, 1004 bp, Homo sapiens
ggtctcactctttcactctggctggagtgcagtggtatcatctcagctcactgcaacctctgcctcccgagttcaagtgatccttccacctcagcctcccaagtagctgggaccacaggtgtgtgccaccatgcctgggtaattttttgtattttttgtagacctgggtttttgccatgttgcccaggctggcttgaacttctggcctcaagcagtctgcccaccttgacctcccaaagttctgggattacaggcgtgagacaccatgcccggctgtatataacaattataaatacctatgcatgcaacaccagagctcccaggtatataaggaaaacattaatagatctaaaaggagagttagactgcaatacaataatagtaggagattttaacaccccactctcagtaattgacacatcatccagacagaaagtcaacagagaaacgatggaattaaactacatgctagatctaataagcctaactgatatttactgaacatgtaacccaactgctacagaatgcacattcttttcatcagcacgtgggacataagaatagaccatatcttaggccacaaacaaatctgaacaaatttttaaaaaatataaatcatatcaagtatcttttctaatcacagtggaataaaactagaaagcaataacaagaaaaaccttggaaactacacaaacgcgtggaaattaaatagcatgcttctgaacaactaatttgtcagggaagaaattaagaaggaaatgtaaaaatgtcttgaaactaatgaaaatagaaaatgtgacatatcaaaatttgtgggatactgcaaaagcagtactaagaaggaaatttatagcaataaacacctatatcagaaaagtaaaaagacatcaaatgcacaacctaatgatacacctcaaggaactagaaaagcaagaacaaaccaaactgaaattagtagaaggaaacaaataaagattagaacagaaataactgaaattgagacc

SEQ ID NO: 256473 - DNA, 294 bp, Homo sapiens
ggaatgaagaagcgaacatagatttatctgtcagatgcatttaaataaagttatttctctacaatttccttggtcttttgtatactgttataataaactagtaggcagcagaaaattttttttgtgacagagtctcgctctattgtgcgagactgtgtggcacagtctcggctcactgcaacctctgcctcttgggttcaagagaattgcttgggcccaggaggtggaggttgcagtgagctgagatggtgccactgcactccagcctgggtgacagagtaagtccgtctcaaa

SEQ ID NO: 256474 - DNA, 125 bp, Homo sapiens
gccttttctgactggtgatttgtatttttgttttatttatttatttattttttaggttactacctttctgcttgtagaagaatccaagtagttgggtctttttttttttggtttataatgaacag

SEQ ID NO: 256475 - DNA, 176 bp, Homo sapiens
cacagacctaaatgtaagagctaaaactataaaactcagaagaaaatgcagaagttgtcttcatgaccttgagttaagcattggcttcttataaaagattccaaaagcacaagggaaaaacaaatacattggatttctttattgaaattaaaactttttgtgctacaaatgatgcc

SEQ ID NO: 256476 - DNA, 535 bp, Homo sapiens
  misc_feature (425)..(425): n is a, c, g, or t
  misc_feature (428)..(428): n is a, c, g, or t
cgctgctcgcgctgctgggaggctgcggcggcggcggcggcggcggcggcggcggcgccgcggcactgcccgcctgctgcaagcacgatgggcggccccgaggggctggcagggcggcgggcgccgccgagggcaaggtggtgtgcatcatcctggagctcgcgcaggtcctgcccccagatactctgcccaaccgcacggtcaccctgattctgagtaacaataagatatccgagctgcagaatggctcattttctgggttaactctccttgaaagattggacctccgaaacaatcttattagtcgtatagatccaggtgccttttggggactgtcatctctaaaaaggttggatctgacaaacaatcgaataggatgtctgaatgcaaacatatttcgaggactcaccaatctggctcggctnaanctttcggggaatttgttttcttcattacctcaaggaacttttgattatctttcctcattacggtctttggaattccagactgagtatcttttgtgtgactgtaacct

SEQ ID NO: 256477 - DNA, 507 bp, Homo sapiens
aaaagaggaaactgaagcctggtgatatgaagtgaattgtttcaggccagagaaccgacaattgagacatgatatgataccaggtcttccaaagaacatgattatttccacccataaaatgctgccacagctgcaaaaatgatatctaattaggccgccttcctaaatgattgaaagtccaatacatattcctgcatgaaagttcaaattcaaactttaagttgttgttttgttaatggtctaattgctttaattcattttaaggataaaaataattttcacttcctctaacagaagaaaatgtctgtacttgcagaatgtgtccaaatttgtgtgtatctcatgtcaaccaggcttatttggagttgatgtagatttattcaggaaacagcagagtttccaattctagctgctactctttggttctggttgtaagcggctgaatgaagaacaccggggtcatggagatcagattggcttggataattcatgtgaaatttagtggtt

SEQ ID NO: 256478 - DNA, 633 bp, Homo sapiens
aatgacagaaaagaagggacttcctgggaatggatggttaagctaaggccaaaggggaaatgaaacaggccaggtaaagcattgggagggcagctgggaatattctggaagaagggacagcacgggcaaaggacccgggggatgggaacctggcactctggaggaacccagagagaagggtggtgttactaggaaggaagggagacacaagtggccaccagagaggtcagtagccctgggcgacagaacgagactccatctaaaaaaattctggcactggccttagaggagtgggtggttgtggaggggtctaaagcagtattttttttttttttttttgagatggagtcttgctctgtctcccaggctggagtgcggtggcatgatctcggctcactaaagtggtatatttttaaaagcccccctctggttaagagaggttaagaatggaaacccagtgtgcagtcaggaagcaactgcactcgtccaggcaaaagataaaggtggcctggacaaggccgccaggcagtggtgtggagagaagggacaagttagaagtggattttggaggaagaatcaccaggcccaaggtagagccgagagacaaggtagagccgagggggatcctctaaa

SEQ ID NO: 256479 - DNA, 448 bp, Homo sapiens
aatgtttataccaaagggaattataggggagggaagggaagaaaggaaagagaatatttgtgtgtgtcaggggaatgaggggggcattgggagagtaaagatggtggcaaaaggtaacttaggttgccactttttaccacaacacttttctaggctattctcaataagaaaatgtgaattatatatattcaaaatacagataccattttgaattgctttaaatccactcctgcctttaatctcattacatctgtcaaaatatgtctcatttactaagtaaaaagtagaagctggtttccagcacctctttctttattatagcctgatccctgtgcaaatgcattttcctgtggttcatctttgaaagatctctcttctcttgtctggttaacttcctcaatgaccattgatatctttgtgctactttattgtccacttggaaacctga

SEQ ID NO: 256480 - DNA, 649 bp, Homo sapiens
ccaggtggcacttctagtggagccaactggtgagcacgggcccacagtgggtgtgaggcgggacaacgggggcacacttccctcctgcgtgtgtacctcacactgtgctaggatgattatggttctggcatacaaagtcacttatttttcatgcaacctggtccctaaacttaagaaaatgcctttatctggtaatcaactgggaaaaacattggctgaaccccatactttcaagtacttatgagattttcaaaggtggttcttacacactaacttaagagtccccagatggtgagtcccagctgcgccacttcataactaaatgatcttaagtagctaatgacttaaccttgtagagcttccattctcatgggcaaatgaaggataacatctctccctcatgggctcacagtgaggattaaacgaagggaaggtatgcacaacagttagcagactgcttggtacaaagtaagcgctcaataaaccaaagctattatttttagtggtggtaatagcactgcttttctttggcatttaaagctgtgtagctaatctgggcattccaccaggttgctgaagcaatagacggccccttaataaatagcttccagacagcatgtcatttaaaactgaatgcatttttgcttct

SEQ ID NO: 256481 - DNA, 361 bp, Homo sapiens
  misc_feature (298)..(298): n is a, c, g, or t
  misc_feature (343)..(343): n is a, c, g, or t
tgagtagaggaaaactagaaaaagagttgctagtaaattataattatggtttctgctaatcaaataaggacgccgatgcccaagagagcatgccatcttcttcatcatccctcattgccctcaccttgtgtgtccaggtttaaactggaaatatcatttggttaaaattctccctaaaactaaagaagtacacctgcagttctttgcttaaaatagcgatagccagctgggcactgtggctcatgcccgtaatcctagcactttgggaagccgaggtggggttcaccatgttggccangctggtcttgaactcctgacctcatgatctgcccacctcactganaaattcagtggactataa

SEQ ID NO: 256482 - DNA, 450 bp, Homo sapiens
aaaatagaacagtgttacatgtaagaaaagctcctcatcttggccatgttctcactgctatgtaaggcatttgaaggtgaatgatacattcaccgtcaaaatcagaaacagcaggggaggaagagctcccttaaaatccttgagggaatcattcaattcctacttattgccttttttttttccttcccaagtgcccaggagaggtaggacactggccatttatctacatagtgccatgaaactcacaaatattcaatctgctgcctcccctctccttccagatttccacagtggtatagagtgtgagactgactggcttcccattagagccaggagaagggaaaaggaatttccacactggcttaagaaaagtactgtctgatgaagagtcagcttattttattaactgatgaaatggcaaaaagtttataattaaacatactatgtttt

SEQ ID NO: 256483 - DNA, 466 bp, Homo sapiens
tttccttttttttttctttctttttttttagagatagggtcttgctctgtaacccaggctggagtgcagtggcacgatcatagctcactgcagtcttaaactcctaggctaaagctatcctcctacctcagcctcctgggtgctgggactacaggcacacgccgccacgcttgactaactgaatcatttttgccaaatacttaactctcctctcggatctcagttgaatcttcttttaatccctaaaaagtccccccaaggtatctgatatttgtcatgtcatgcctaggctaggcaaaaaatattgtctacatttacgaattgcaatttcaattcatgtcctcaagaccgtttttaaaactcactaatgaagttgcaaatgctaacaccaattgtggttaacctgcttaaaatccagaactttgtgcaagagaaagagattagtgtttaaggaaaatggtgcaaa

SEQ ID NO: 256484 - DNA, 600 bp, Homo sapiens
aatagtacaaccactatggaaaacactctttggcagtttctatccgatacaccgcagcaatcatactcttatacttttatcccagtgaaaactgggatgttcacagaaaaacctctacatgaatattcacagcaggtttatttctaatagccaaaaattgacaacaatccagatgaccttcaacatgaaatgattcaacaaattggtagcacatggatgccatggagtactactcaataaaaatgaacaaattatagctataagcaacaactctggaatcttccaagtaaaaagccaatcccaaaagtcatgtactatatgattccattcattcattcattcattcattcatttatgagactgagtcttgctctgtcacccaggctggagtgcagtggtgtaatctcagctcactgcagccttgacttcctgggatcaagcaatacctccatcttagcctcctgagtagctgagactacaggcacctgacaccatgcccagataatttaagtatatattagtagaggctgggtttcaggttggtttcgaactcctgacctcaggtgatccagccacctcggactcccaaagtgctgggat

SEQ ID NO: 256485 - DNA, 437 bp, Homo sapiens
agtactttagatattctggatacaaatattttgtcaggtatgtgtttagtacattttttctcgtagtctgtggcttgtgtttttatttttttaatggtgttttttgaagggtaaacatttttaatttttgaagttcaatgcatttttttcttttaagatatgtactgtacttttgctcttcaaaagacaccattaaaaaatgcaaagaaatctttgccaaagtcaaggtcaccataatttttttctacaagttttatagttttagtccttatatgtaggtttattgatctattctgagttagtttttgtctgttatgaggtgcagctgaggtatcagctgtatgtacacagtgtatagagaagattatcctttccccattgaatagccttagccctttaaaaaaaattaactggtcatgtatatatgggtctgtttc

SEQ ID NO: 256486 - DNA, 447 bp, Homo sapiens
  misc_feature (12)..(12): n is a, c, g, or t
  misc_feature (26)..(26): n is a, c, g, or t
  misc_feature (35)..(35): n is a, c, g, or t
  misc_feature (47)..(47): n is a, c, g, or t
  misc_feature (66)..(66): n is a, c, g, or t
ttttaggtttgngggggaatgctggnagattgtcnatgggtatgganaacatatcatataaagtantgctcgggtgagtggtaggaagtctaggatcaatgtgccagcaactggcatctggtgaggcccttcttgttgcatcctcacatgacagaagaaagaagggcaaacgagatgaactctgtgtcttcatatggcaggagagcagaagacaacaaatccactccttttttcctcttctttcaaacgaccaagaaagaccataatcaaaaaattaaaaaaagatagatgttggtgtggatgcattgaacagtgaacacttctacactgctgttgggaatgtaaactagtacaaccactatggaaaacagtgtggagattcctcagagaactaaaagtagatctaccattgatccagcaattacactactggatatctatctagag

SEQ ID NO: 256487 - DNA, 295 bp, Homo sapiens
caaattttgctcaaaatgtacttcaaaaaattttcctctttgctctttctctttccagtttttcctcttctttcaaacgaccaagaaagaccataatcaaaaaattaaaaaaagatagatgttggtgtggatgcattgaacagtgaacacttctacactgctgttgggaatgtaaactagtacaaccactatggaaaacagtgtggagattcctcagagaactaaaagtagatctaccattgatccagcaattacactactggatatctatctagaggaaaagaagtcattatgc

SEQ ID NO: 256488 - DNA, 336 bp, Homo sapiens
aggagcatgtcatagctgaaattggccaggtgcggtggctcacacatgtaatcccaatactttgaaaggctgaggcaggcaaatcacctgaggtcaggagttcaagtctggcctggccaacatggtgaaaccccatgctctacataggtagaaattccatcaatgttcatttcctctcttcctagactggtatatgccatttggtcatgtatcatcatattttcatgctgcagggatccattctcaaatgggggcaataactctatcagccccaaatgggcctatatttacctggagcacttgaatcctggaaaacagacataggaaaacctgagt

SEQ ID NO: 256489 - DNA, 337 bp, Homo sapiens
agtagagatggggtttcaccatgttggccaggccagacttgaactcctgacctcaggtgatctgcctgcctcagcctctcaaagtattgggattacatgtgtgagccaccgcacctggccaatttcagctatgacatgctctacataggtagaaattccatcaatgttcatttcctctcttcctagactggtatatgccatttggtcatgtatcatcatattttcatgctgcagggatccattctcaaatgggggcaataactctatcagccccaaatgggcctatatttacctggagcacttgaatcctggaaaacagacataggaaaacctgagt

SEQ ID NO: 256490 - DNA, 485 bp, Homo sapiens
atttttttatttttagtggagacggagtttcaccatgttggccaggctggtctcaaactcctggcatcaagtgatcgacccaactcggcctcacaaagtgctaggatttacacgtgtgagccaccgtgccagccgtgctgtgtaatttttgataaagaagacattgatattagtttagtgaaaataaccaaatcttgaattatgtggtaaaataaacatatatttaatgttaagtttcttacttaggtaaacacctgaaattcacagactataaaatggttgacagggaaataactttaaatgacgactatttgcagttttcataaataggtaaacgattaaaataaaataattagttaaatgtaatggaataaatacttatagacaaacttgtcataatttagaatgtaaagttaaatacatatttcattaaatgtttggatattttccaattaaaaaattatattgtaggaaaacattgtttc

SEQ ID NO: 256491 - DNA, 489 bp, Homo sapiens
tcatttgtcaaacccacagaatgtacaacaccaagactgagcctaatgtaaactattgcctttgggtgataatgatatgtcgaagtaggttcattgattgtagtacatgtactactctggtgtgggatattgacagtaggggaggtgttggggagataaatgagtaatgacatgcatctaccattataatattatagagagtagtttcagtgccctaaagatctccgtgttctacctattcatttcccatccccactagcccttggcaatcactgggctttttgctgtgtccttgcatttaccttttccagaactacattttaataatacatttcccgtggagtgctttgaaagcataaagaagccttgagccaggcatggtggctcatgcctctaatcccagtgctttgggaggccaaagtaggaagattggttatgcccaggagtttgagaccagcctggaaaacatagtgagactccgtctctaca

SEQ ID NO: 256492 - DNA, 503 bp, Homo sapiens
gaggccaggagtttgagactagtctggccaacatggtgaaaccccatcttactaaaaatacaaaaattagctaggtgtggtggcgggcatctgtaatcccagctacttgggaggctgaggcaggagaatcacctgaacctaggaggcggtggttgcagtgagctgacaccacaccactgctctccagtctgggcaacagagtgagactccatctcaaaaagaaaaaaagagaaaattatggaatatgtcctaaatatctgtagaaactgatcttttcatgctattagcatctttttttgccctttgatcttattggtcattgagaaatacttgtatccctttcttacaagtatgaagattattaaaaataccgaatatataagatgaataaatccaattgtccaattcacacctttaaaacattaggaccaaacttttttatcttgcagaaacactaagaatttgtttcattgtttattttcgacagtgtttctccttgacaa

SEQ ID NO: 256493 - DNA, 393 bp, Homo sapiens
ggacggcagtgcttctaagactgtgtcgggggcttccatcactttctctttcagcattttccccccacaaagctgggaccaagagggcggttttggtgaaagaagacatccatggctcactcagctcctcccagtcttcatagtcacaactgtgcggttcaccttaagggcatacgctttgggatgttttagccccaggacacttacttaggatgataatggttattcctagaaacaggtgaatgagaacttagggacactaaaaggcattttcaaactcatccatgaatgttttcagggactcatgtcagggttctaaatgtttgctgccgagatggaaaacgtcaggcttgtttctgataatacgaagattcttattaatagtgaaaccga

SEQ ID NO: 256494 - DNA, 457 bp, Homo sapiens
atttttgtagttaatataatttcagtggaatgcatatttctaccataaatgcatatagaacttgtttgctgacctactgtttggaaaacaaacaatcccattagaagaatgtctttgggatttatttttaccagaaaatcaatccttttttcagtcccttgcaaagtacagtgttacaagccaagactttgataatcaggtagaaaatggatttaaattgcagaaatgtatatgaaacacttttgttccttgccccttgaactttaggggaatgaaaatgtctagcactctccaccttcttttctctcctggaacttgaactgtaattcaaagcctgtttctcattaaagtacctggcagcctatctctttacagcttgagttacaaagctattcagagacctcgctggtctaaagagacagaacaaggatgtgtttaaatagagcataggctgttg

SEQ ID NO: 256495 - DNA, 369 bp, Homo sapiens
tgttcggcacaggatcttttgtttgtaaaaaaagaagttatgtggagctcttcgatttctagatgtgattgtacttttctctttttaggcacctgaaagtcagaaaaatgacttcttgagctagattgtaccagatactatgttgagcatttctactgagtgagaaaggccatatctaggaatataaagtaaactttgtaacagaggaaatgaatcaacagttttgactttgctactatcatgtgggaaaagctccactatatcttaattctaatacaggttaaagtgagttaaaattattgcactcaagtccaaaaaattaaacagttactaagatcagataaaggttttaggacttgattagatctg

SEQ ID NO: 256496 - DNA, 442 bp, Homo sapiens
gggagctaacaaatgagtacacatggacataaagatgtaaatgatagaaactgaggattctgaaaagggggagtatgggaggagcatgagggttgaaaaattacctattgggtacaatgttcactctttgggtgattggtatactagaaacccaaacctcaccattatgcattatatccacttaacaaacatgcacatatatcccctgaatctaaaatttaaaaagataaaaattaaaaatacattaactgaaggtggctaagaaaatggtttgtgaatatgtaatatataacagagcagctggtccaatctcatatcccttcttttccctttttttttgagacagtcttgttctgtggcccaggctggaattcggtggcttgatctcagctcactgcaacctccgcctgggtgacagagtgagactccgatctccaaaaca

SEQ ID NO: 256497 - DNA, 523 bp, Homo sapiens
atgatatgattagatacattctacatactctggatttagtgtggagaatgtctggaggatcctctgaatagcagcaaggagtttgcttattatttttttgttgaatgtaaagataaccagtggtgaaagtcatggcagcattactgaagaacaaagtcagagccagtgagtgtaagagcctgtgtgtcaggaagtctcccgttttcaggctcgtgctcaggttgatggccctgggaatcactggctccttgttgtgtttcagaccctctagtaacaatcccaaatgtccagggggctgaaaggcatatcgctacaataaatgaaagacttcattaaataggatagtttctccctcccaagggagcaaggggcatcagagtgtgaagtcaagttactcattctcaataagcacagaagtccctatctgttcatacacaaagggtgtaattttacagcaagtttccatctgctcccataatgcttactgttgtgtggcacacctgtgtttacttttcaactggct

SEQ ID NO: 256498 - DNA, 409 bp, Homo sapiens
gtgcacaccaccatgtccgactaattttttgtatttttagtagagacagggtttcaccatgttggtcaagctggtattgaactcctgaccttaggtgatccacccacctcggcctcccaaagtgctaggattacaggcttgagccaccgtgcctagccaacatgttgatttttaatggttagcaattcaagttttattaaatcattctggagatgaaagtatattcctggaacaaataaagcccatcaacaagagccaacctgtaactgctgatttagagttactctatttagtcatttctaggtggagacctatatttttagccccagagactttcttccttctaaggtgggacaggaaaaccacgtgaaaggcgacatgctatcagaggcccagagaatctggagat

SEQ ID NO: 256499 - DNA, 910 bp, Homo sapiens
  misc_feature (412)..(412): n is a, c, g, or t
  misc_feature (419)..(419): n is a, c, g, or t
  misc_feature (508)..(508): n is a, c, g, or t
  misc_feature (756)..(756): n is a, c, g, or t
  misc_feature (903)..(903): n is a, c, g, or t
gggaggaacggccaagccctggggccatgaatggcagcaggaggcatggagggcctgaagactgagggccgggctgccagtcccggaccagagtggggaatacttctgcctcttccgggcctgccccttcctgcccatgggccaatccacaggcacttcctcccttctgaggcctgtaaaagtcctgggcttagtcagacaaaggcagaggaccaccagaagttaagggaggcagagagagatgtctttggcagggacgaccagctgcagagagcagtaccttctctgctgatagctgggatgaccagctgcagagaggagtattcgaagagtacccactctgctgagaactgcagagacgatctgccagcagagaggagctaccctctctgatgagaacttcagagacctncagagangtaaaaatgacttgcctgcagagaagagccaccctctccggcctcctctgctaagagccgaacactcaactggacgacctgcctacagngaggagctacccagctctctgagctgttgtaacactaaataaaactcttcttgtggccggttgcgagggctcacgcctgtaatcccaggactttgggaagctgaggtgggtggatcacctgaggtcaggagttcaagaccagcctgaccaacatgatgaaacccggtctctactaaaaacacaaaaattatctgggcgtggtggcacaggccacatgtattatatacatgtgtgtgtgtgtgtttgtntatatatatatatatatatacagctgcaatcccagccacttgggaggctgagtcaggaaaattggttgaacttgggaggcgcaggttgtggtgagctgagatacaggtactgcactccaggctgggtggcagagtgagactctgacngaaaaaa

SEQ ID NO: 256500 - DNA, 641 bp, Homo sapiens
ggctaaagcaggataattgcttgaaccctgggaagtggaggttgcagtgagccgagatagcgccactgcactccagcctgggtgatggagcgagacttcatctctggttcaaaaggtattttagcttttagaattctgggagatagatcttcacagctattttaacttgcaaagcagcctgaggggatggggcaggtcccttctccccctccaactccccaccatcagaataccccatggctgcccagttggttcccaggtcagtctgagatccaaacaaaaggggaggaagcaacctcaggacgtttcccgtcaccctgtttcccatcacccccagctccgggaagtccccacgtggcaaccagttcccttgccaggctggcttcggatgccaccatccctgggagggggttgtggaggaaagaagggtggttgagggcccagctgggttctggcctctgtcccaccatgaggggccaatttccctttgtgtaggggacggcttcttgcctgctctgcctgcctgcctgtaggcctggcaactcagcagagggtcggatccacggttcagaatccccacctcctcacccacccaaggctctgttccagttcctcttctgtctggggtctctgaggcccct

SEQ ID NO: 256501 - DNA, 405 bp, Homo sapiens
caacccaattagctccatgagggccttgaaaagcacagaatgacttcctttaaggaaaaacagtgctattttagaaaactttaacagtgtgatggtcacagaaaataccatgatcttaaggtttgttctttcagatacatcctatggtctcaccgagaggacaaaaatatcagggaaataaaaaagacatagtacaaaagtaaagaaagggggagaacagaaattgaagcactgaaagaagattggatctggcaactgagactttatgttgggggaggaagaaactggtagagagagggctaaagaggtgaagcagcagctcctcgctggccggggtggaaaggaggcttgactgccacagatataggtggcgactaatgggctcaaggctcagtgctccacagt

SEQ ID NO: 256502 - DNA, 342 bp, Homo sapiens
ataattacaattagtttttcctgtctaaatgactaaaaggaaaagttcaaacaataaatgaattactgagactgtttcttgcctgcccctgttctggacgtgaccaattttagcctcaaagaattttgtgatccccaagggtctaggaagaagaaaagagctcaaggaattaaagtgttcagagatgaggagaatagacttgaaataagtagtgtaccaattaatggcagatctttactaaccagactgcaaacaatagatatttttgaaatgtcacaaaattaaagttacgaagtctatagaaaacaaattaaacaatggcacattggtaagaaccatata

SEQ ID NO: 256503 - DNA, 489 bp, Homo sapiens
accctccccaccttcctgtgtcctttgcatgaatcatgctgtggacgagctgagcccccgggcttctcctggttctagttctcgcttttccccgcagtttcctgaacctgtaagcatccccttcctcttttttaccctcactgcagttccagtgtagttcacatgctggccccagcaagactgcttggtgactttcttgtcccttgtttggattgaatatcgatcacgcgttttccttccccaatagtatgatttgcatgcagaattcatgtctggcccttcacagggctgcccctaatggccatgaccccagcgttaagcaattacaagtgccggtgagttttgagtttaatttcttaagaatttttagttttttaaaataaaaccgtattttaaaagcatgaaacagatttttaaatgtctaccaattttgagtttagaaaagttgccgccaataaaatggaacagaaaaaaatcaattgtattcct

SEQ ID NO: 256504 - DNA, 334 bp, Homo sapiens
acatttgcagactgaacaacaacaatctgccttggcaatgtttgacagtaaaaatcgctcacacacctatacagtaaagtcaagtccagaggaaggagacctttctcatctcgttaaaggtttatggttccaaggcgttttacaaaaattaagtctctaatttagtgcaaaactttaaagacagattattaaattatttgaagacatcataagctaaatggggtttcgagaatattaacagaggagtacaaataagccattcacaggaaaagaatgcagcttaactgtttgtttttgtttttttgtttttaatatagccgccttaaccccttcc

SEQ ID NO: 256505 - DNA, 686 bp, Homo sapiens
gtagaagaagatacaactcttgtcctgatctaactttgtagatgcactgccaacttaactgtatagaaattgtattaacaaattctatctcttcgcagaagaatcactgccatttctaaaacaaatttagaatatttccagaagtatcatcctaataaccccacgtaataataaaataataatcccaggtaatcattttttacagtgttcaaaaatcatttttactacttgtaggtgttttcttgtaaaaagaaaaaaatttttaaggtgatttttacccttgaattttggagctaatagccatctgagttttctaattgcaaagtgacaagtctattcaatatctgtaaatagaaattaatattttcaggaaagcaaccctgatttttttattaaagcatcttttatcatttacagttaatttcagctataaaagtgtgaccccaatgaactatagcagttccaaaataattgttgtaggtggtactttagagagaaagagagaaggaaaaagaatactacttcttattaggaataccttattagaattttttgttgaatcgcttttcaatcacataaaataagctgcacatataattgtagtcatagttgaggagttagacataaatggaagattctacatttcacaaacataaagctattctttaaaatctatttcaatacaa

SEQ ID NO: 256506 - DNA, 501 bp, Homo sapiens
atagtaataaatgcagtaaatatctcagaaatcaaacgaaaaaatgtttccaacaataggcagtgattatgattaatttattcaaatgctgctgagagcaagaataactgaatattctatttggtggtgtaggggttattggtgacattgagtggagcagaatagtatcgacaaagtcttgattgaagtggattttaagagagagagagagaattcatttctaaacaactctttcaaggtctacagaggaattctacttgagggtgctgccttgcacctctaatcctagctcctgtcgcctctggaaaactctgaatttttttcttttttggagaacaatcctcataattttcaactagaagaagtcagttggtctcctttgattttttcttcgtaggtatctctgtggatttccaggaaaaaaattttgctatctccaacactagtcttccatctagatgctatctccaaaggttctttcactttttatagatattattt

SEQ ID NO: 256507 - DNA, 462 bp, Homo sapiens
ctgagaaatttggttttctaaactgcatgttttaaaattcttgtccttcttaggcattattttgttgttcttggatttttttagattactaaatcattgggctataaataatgataatcttaacatttgtttttttcttagctatccatctatattcagttcttttacaaatgtccaggtctggtcccctggacataaataggggccctaactagctaactccaaaggtgtggggaaaacaaagttgtttgtgaactttgttctgacagcagaggaaaagaagcagacacttctccatggagcctcctaactcagtgctacatgcagtgttaggccaatagggatcaattaccccctgggaggagattttccctggcttccttcctggtgactagcatcttattatgaggacctcactttagcctattgtctttagaaagattaaaagctgcagcttcaaaa

SEQ ID NO: 256508 - DNA, 555 bp, Homo sapiens
gcaacctccttgaaacccatttcttttcatactccagagaaattatgtttgaaacaacagaggtggtagaactttgcaaaaagtgaaaatccattgatcttttaaagatccagaaagcaatgtttcttaaaatacagatcaatagcataagaccatattttaatattgtcatgtttacccactcatactatttataccttagtatgtgctattaggagtgaagaaaagcaaatagtcaaacttgtctaaagagaaatgacaatagattccggaatagcagtaaaaacaattaagattagtagctgatacaaatgaaaacatcttaggttacttaagaagggttcttttatataatcaaaggtagtaagaagagatggaattaagactccaaacagaaacaaattaggggaagcatgaaaaaaatggagcaagaatagttttgaatacataaagaggaggaagacataggagttcaacatgcctgttgagagagaactcaagtaaattttcataaaagtgggagaaatggcttgagaaatgaaattacttttttgt

SEQ ID NO: 256509 - DNA, 454 bp, Homo sapiens
ctctcgcggcactcacagttgaagagggggggcaaatgttaatcaaaggtaccacctctaggcccaattattaacttaggctatgacctagagaaaagggccccaattctccagaaagttgtaagatatgttcttgacatagattggaggtttggagagttttccatgacctagggatgctgtgctgagatctgccagggactaagcatttcatagaggctcccataaaggccctgcctgggtcaagggggaacataccatgttagaagggtcactatggctgaatttcagggagcaagtggggagtgtggcacaatgagactagagatgtaggctgtgataagaagacagagactggcaggtcatcttaaggatttgggggttttagtcaaagactgataggagatgattaaagcctttaaatgcattaaagcagaacaaaaagacatttaaa

SEQ ID NO: 256510 - DNA, 685 bp, Homo sapiens
cttgaatccagttgcccttttttttttattgtttctaaataagagagtcagcattttgataggcttaaatgaaacgtatgatttatgccttgacaacctggacaagagagcagagtttgagttaatctttgcatgtcagtcagtgcttcatcgctagtatattcccaatgactggtggttgaattgtatttaaaggtgttgaaagggaggtggaaaggccattaaaagacatactccaacagttctactatttttttccctgagtctacaaaccatgccagatccttaacaaaggtaggtattcttggaatttcatgaatggcaccatttgaaaagcagagtgtttagtaaatattgaaaaataataatgagataatttgtgtatttcccaccatctgggagttttcacactagtattcagctttcaggctcttattcatgctcttctatttaattatgctctttgtatgaacataaataattcttttcactgaagcaaattcttaaatattctcattctttatttttaatcttaaaaattaaaataggaattatataatttcatattcttgaagttattccttctccttttactttcaaatcattttattttatattaattactttgggggattaatgctaattatttgattccatgttagtaaatgataagatataatcacag

SEQ ID NO: 256511 - DNA, 709 bp, Homo sapiens
atgtgaaggcttgtaatgggattggaggagccatgcataaagctatcctaatggctcaagcaatgactggggttgctttaggaggacaagttagaacatttggggggaaatgttataattgtggccaaattggtcgtctaaaaaagaattccccggctggctcagtcagtggatcatgagactcttaatctcagggtcgtgggttcacgccccacactgggcgccaggtgaaggaggcctgccgctccacacctatggatatttctcgtcaggtggagatgagactgataaaagaaataagacacagagacaaagtatatagaaaacagtgggcccaggagatgggcactctatgtgcgaggacccgcactggcgctggtctctgagttccctcagtatttattgatgactatttttactatcttggcaaggggagtgtggcagggcaacagggtgatggtggggagaaggtcagcagggaaacatgtgagcaaaggaatctgtatcatgaagaagttcaaggaaaggtactgtgtctggatgtgcatgtaggccagatttgtgtttcacttcacacaaacatctcagtgtagcaaagagtaacagagcagtattgctgccagcgtatcttgcctccagccacagggtggttttctcctatctcagaatagaacgaatggtcggctttacactgacagggtaccgagtt

SEQ ID NO: 256512 - DNA, 408 bp, Homo sapiens
gtgatcatagggtaggaagggggatgtagagagatgagccaggagagggaagtgggctctaattatatgggacctaatagaccatgtcaggaattgggactttatctaaggagtaatagaaggctggacatggtggctcacatgtgtaatcccagcactttaagaggctgaggtgggagtattgcttgaagttaggtgttcaggaccagccagggcaacatagcaagacccagtctctaacaaaaaaaaatttttaattagctgggtgtggtggtacacactggtagtcccagctacttgagaggttgtgctaggaggattgctcgagcccaggttattgaggatgcagtgagctatgatcatgccacagcactccagcctgggtgacagaatgaaaccatgtcttta

SEQ ID NO: 256513 - DNA, 642 bp, Homo sapiens
aggagtaaaacacaccagaggaaggtgatgtgggtttatacttgggaacaacattaccttgccatcttagggccagaggcattaatcatggcttccccaatgcataatttcgatgttggcatttccttccccattcctttcagaatcctaccctgtcaggtattatctctgatgaaatattccctgggccaggcacagtggctcatgcctgtaatcccagcactatgggaggccaaggtgggtggatcacctgaggtcaggagttcaagaccagcctggccaacgtggcaaaaccctgtctctactgaaaaaaaaatacaaaaattagccgggcatggtggcagttgactgaaatcttagatactcgggaggctgaggcagggagaattgcttgaacctgggaggcggaagttgcagtgagccgagatcactgccattgtactccagcctaggcgacacagcgagactctgtctcgggggggaaaaaaaagttcatatcaatttctaatattctataattattgtttttggtcacatatactttttccatgtattgaggtgaacagattggtcttattctgtgttaagttatattgattgattcaaattataaataaacctttcattcctgttataaaccca

SEQ ID NO: 256514 - DNA, 670 bp, Homo sapiens
gatttaagcctgatcagtctaactaaaaaaccagagctctttactcttgtttacacttagatatgccgctcccctttattcagtaggaaggggacaaataggaagaaagaaaagattttattaattttgaaaacttaccaattcatgtgacacagggtgtggattagctctgcctttagggattccccccacctccccccgccccatggcgttagggggttataatggtttacggtccctctctctccatcttagcccttctttctgtacttttccctctttccctcctcaacagtcagctttatctcacagagcagactctcgtcccaaacttggtttgttatcccttgtggtgctggcttgaatttattttctgggtgaggtattcctcccagggctgaatctggatcttccccatgaattttccattcgaatatcgtgagctagtttgttttccagtctggaatttggacgtggtctgttagagggccagctggacagcgagcagctcagcgtagttgctgtgacagccctttcttttcttggccagcccccatatttttccctcaaccatggaaaggcatttttttattttttcaagcagggaaaggagaaggaatagatcacacccaccaactcctcctaggttactacatactctaggaaacgt

SEQ ID NO: 256515 - DNA, 588 bp, Homo sapiens
cttttcatgtcatgcctcactgatagaactcttgaactttttttctgaatagcccatctgtttatttcccatgattgtgatttctcaaggtcatggttagtccaaaggtccccaagaatgaacaagtaagacggtaatgctgtatgtcaggacccaggcaggacaggaatatctctgagaagccataagcttctgctcagttttaaatcttgatgggaaaacattcagaatagggaaattcaacatatttgccccaaggtaaggatgaaagccttgcttcagtactccagcggatgtctgggttccctgcagatttcccttgggtggtttggcactgccccctcactcctagtagcagatcttttgcctgtggtgggcgcgtcaggctgaagttatatctggtgctggctccgctgtcctccagcaggactggaggtgtggtaggctgcatcgcagcttccctgagtcatttcccagcctacagtagtggcttctaatgccttccagttgtcctgacaggaatggaggaattttatcaaatcgaagtttgtgagtaggtttttttttttttgagacggagtctcgctc

SEQ ID NO: 256516 - DNA, 478 bp, Homo sapiens
aattcttgcactatatgtatggtgagagaggtttcctgctttcaaggccaatgacagtgagtgttcaacttaagagttaagaacaagaagacaacaataagacagatgtcccaagaaggcatatgactcacaagttcagtggaaacatcgtaggaggtgaggcttgcaggatgtgataagatatggaaagttgaagaagggggtggacgggaaatgtttgagcagaggtgtataggaaagaatgtatgcagtactgaaatcattgcggatgaaacgatacatccaggatttgcttcaagacacctggcatgggtgtgatatgaattgatcattgttggagctgggtaaatggtatatgggggacccttataatattattcatacttctatatacattagaaaatttccatagtaagaattttttttaataaaaatggtatattatgtgttttttgaacaataggttaggctagcctat

SEQ ID NO: 256517 - DNA, 698 bp, Homo sapiens
tcagaaatgcccttctgcttttgtttccgtggaagaagttggcctggaactctctctgggcaccttctgcgccctctggcaaccagaaaagcaaagtcgttcatcaaaatctcagactggagcaactccttcagcttccacagttcttgcacatactcctttcttgatttgttgcatatcatttcaggcacctcttttaatgcagctattcaggctgcctaaggcagtggtccccaacctttttagcaccagggaccagttttgtggaagatagttcttccaccgatggggtgggggtggtggtttggagatgattcaagcacattacatttattgtgcactttatttctgttattattatattgtaatatataatgaaataattatataactcacaataatgtagaatcagtgggagccctgagcttgttttcctgcaactagatggtcccatctgggggtgatgggagacagtgccagatcatcaggcattagactctcataaggagcacgcaacttagatacctcgcatatgcagttcacaacagggttcgctcctatgagaatctaatgccaccactgatctgacaggaggtggagctcaggcggtaatgcaagtgaaggggagcagctgtaaatacagatgaagcttcgttcacttgcccacagctctcctcctgctgtgcagcaggttccta

SEQ ID NO: 256518 - DNA, 459 bp, Homo sapiens
cttacttttcatatcaaatatagatagatagatagtagcttaatttttcactgggttatattgcatggagatagacccaactggatctgttgtatttgcatgtatctgtgtgtgtgtgtgtgtgtgtgtgtgtgtgtgtgtgtgtgtgtgtacacatgtacatatatatacacatagtatatatattttgtatctgtaagaaatgatattaatatcaaccatgtcaatattaactgatttaaaactgtttcactaaattcatatttagtttcattactttaatcattttttattgacagtctttagtccaaatataatccttatcaatatgattttttgatagtgtttggagttaaataaaagacagtgaggtttataatttataactaaaatagctggcttgctagaaatattcttggaggaaaaaagtcttcaaaaagacaattttttgagagtgat

SEQ ID NO: 256519 - DNA, 399 bp, Homo sapiens
cgggtttctttgttttggttggtagcattctattgtagggatgtgccaaaattcatccattcaactgttgatggacactggggttgtttagttttttgctattacaaataaaactactataaatatttgtgtacaagtctttttgtagacatgttttcatttctcttaagtagatatataggagaggaatgactgagacatacggtaggtatgtttgacttaaattgttttgccctggcaccatagctcatgcctataatcccagcactttggaagacagaggcaagaggattgtttgagcccaggagatggagaccagcctaggtaacatagcaaaacctcatgtcaatttttaatttaaaaaacattagtaaataaactgctttacaattctatgtg

SEQ ID NO: 256520 - DNA, 316 bp, Homo sapiens
gcacttgctatcagatgtctggagggcagggttggctttggccatagatggacctcggttcaaatcctggctggccataccacttaccagctctagacctagagcaggttaacatcatgaatctaaactacttaccacttaacaaagtgagtgactatctataactgttgccgttgttacaagaaatccacttagtaactgcactgaaagcccctcatccccaaaaggcaagaaatggggaacaaccgggtgactaaggaaaactgcaagtgaaagcagctgtaatttctctcgctgtggtttgcggtgctcaaca

SEQ ID NO: 256521 - DNA, 277 bp, Homo sapiens
tgctatcagtgtctttgatttcacacccttcttaatactttacattattaccatacatttttgccccatcttgtttgcttttctttgctgtgctatgacttcacaagtgtttctcaaatttttacatgaaaatttctgggcattcagtattcttcttccaaaatttatctggcaatactgttcttcggctacttctatatcctagacctttcagaaagaatgaatttctagactgatggcacttaactgaaacatgataagtcaaaatgccaatatt

SEQ ID NO: 256522 - DNA, 245 bp, Homo sapiens
ccggagcccagtgcacacagtcagtagcagcaacactaactttaactcaggccccgacacccattctgtaaacttctctacgacggtgtcccctcactaggggggaacaggggactccacaggctctctgcctcatggctgctgcaaggtgccacccctggactttccgctggggctctgatgcccatgtcaccatggcctctccccaaagggaattcaggtcagagctgaaagggggacccagg

SEQ ID NO: 256523 - DNA, 410 bp, Homo sapiens
tatttattgagacggagtctcgctctgttgccaggctggagtgcagtggtgcaatctcggctcactgcaacctccacctcccaggttcaagtgattctcctgcctcagcctcctgagtagctaggactacaagcacgtgccaccacgcccagctaatttttgtatttttagtagagacagggtttcaccatgttggccaggctggtctcgatttcttgacctcgtgatccgccctcctcggcctcccaaagtgctgggattacaggcgtgagccaccgcgcccggcccagacatgacatctttttctcacctgtcttaagatacctgcagcctctgtaacttatttttaaaaggagacaataaagactatttttaaaagtcaatccttgcctctgaaaacctacctctgc

SEQ ID NO: 256524 - DNA, 824 bp, Homo sapiens
tcatcgagctcggccctggatgataaaatgaacacattgcgggggcttggctaatgcaatgccccaagttgactcagatactattaaaagcactcaagcatctacttagaagtggtatgccctgagatttaaaaaatacttgtttgaaaagattaggaaaagcccccgcaatgaaacagtgactaaagcccctttttgagattgtattgctagctacctgtgatctggccctgagctaaaagcataactaacaaacatttaacaacagactaagttcgggtatgtagtgaagctgacatatgatatcataaagcttttccatactctctacttatagagattctcctagagtttatggttaaaactacaataatattttcaggtctactgtagtatctgtttctgcctttttgttgcatgcgttcgtaatgtgttacccatttctgactaatacatgctaagttgacagtttcttctaagagtcctttgctgtgttatgttgcttgaggctgtgattaagtgtgatcatcatatttgtctcttcttgcctatgtacctctggtaatcccagttaagtgatagtagctcatgagttctggttttattcaacctctgtgtgcatctggctcagttgacttctctgtattaaacatgtacaaatgggttacgttcctggatcttactgatcttattaatcatgtttgtttttccattaaatactaagcaataacaacttccttattacatgtacctctaacttgaaaatactgtgaattctacacatccaagacctttgtagaaggaagcaaaaaaaaaaaaaaaaa

SEQ ID NO: 256525 - DNA, 218 bp, Homo sapiens
cacctcgatcgaagtgtgggacagcacgcgctaacaacagactaagttcgggtatgtagtgaagctgacatatgatatcataaagcttttccatactctctacttatagagattctcctagagtttatggttaaaactacaataatattttcaggtctactgtagtatctgtttctgcctttttgttagcgcgtgctgtccggtacagcacgcgctaa

SEQ ID NO: 256526 - DNA, 596 bp, Homo sapiens
cacctcgatcgaagtgtgggacagcacgcgctaacaacagactaagttcgggtatgtagtgaagctgacatatgatatcataaagcttttccatactctctacttatagagattctcctagagtttatggttaaaactacaataatattttcaggtctactgtagtatctgtttctgcctttttgttgcatgcgttcgtaatgtgttacccatttctgactaatacatgctaagttgacagtttcttctaagagtcctttgctgtgttatgttgcttgaggctgtgattaagtgtgatcatcatatttgtctcttcttgcctatgtacctctggtaatcccagttaagtgatagtagctcatgagttctggttttattcaacctctgtgtgcatctggctcagttgacttctctgtattaaacatgtacaaatgggttacgttcctggatcttactgatcttattaatcatgtttgtttttccattaaatactaagcaataacaacttccttattacatgtacctctaacttgaaaatactgtgaattctacacatccaagacctttgtagaaggaagcaaaaaaaaaaaaaaaaa

SEQ ID NO: 256527 - DNA, 127 bp, Homo sapiens
taaaaataccacctccagtgaattcgtttggaaaagaaactcaaagcaaggccagacaaaggaaacaaaaagaaaagaaacgaaagggaaaggacagggaagaaaaggcaagaaaaaacaagacaga

SEQ ID NO: 256528 - DNA, 574 bp, Homo sapiens
cattcaacctagggtaagccacactgataacaataaagtacctcacgttggatgatagaaagcagtcagtgtggccgggcacaatggctcacacctgtaatcccagcactttgggagaccaaggcaggtggattgcttgaggtcaggagtttgagaccagcctggccaacatggtgaaaccccgtctctattaaaaattaaaaaattagccgggcatggtggtacacgcctgtagtcctagctactctggtggctgaggcaggagaatcgcttgaacctgggaggcagaggttgcagtgagctgagatcgcaccactgcactgcagcctgggcgacagagagagactccgtctcaaaaaaaaaaaacagaaaaagaaaaaaaaaaaaaaaaaaaacccgcggggcgttttttgtgtggggggggggaaaaaggggccatgaaaggggcccggggccacaggggttccccggaacccattttggggtaccaagggggaaaacccggggggccccacaaaggggggggcaaaataattggaaaaagcccgggggtaaccggtagatgggcggaaaa

SEQ ID NO: 256529 - DNA, 451 bp, Homo sapiens
ggaagggtcagacattggtgccgtgtgcaggccctgtgtgggggaaagtatcttctctagggagaagatctcataatataggctggagggagacttaatattgttctttacattcttttatgccatttaaaaaatattcgttttaccgtgtgcatatattactttttcaatgaaaaattagtttattaaaaaggagaaattaggaaaattatacttccttaacactaatgggcttgcatacttttcatatattgtcagtctcttttaatttccttttattttatcgatatgctagagagttgggcaaaattttgtagtaagaagtttttgataattttcttgttatatttctaatgtattcctgtaccttatccttttattagttgaacatttttatcataagattaatttcattaaataatttttttccccccggaagatttttttccct

SEQ ID NO: 256530 - DNA, 428 bp, Homo sapiens
ttcataacccatccactagtaaattccgaggtctgtgctttgcactgcttcccagagcttccccatggggtaacgccccagcagccaactgcgggcactggccttaaagctccccctgtatctggctgccttgcatcattcctgtattccttgtatcagcccttccgtgtattattttacccgtgtcccttgtgcttcccaactctttggctcagagtttgcttctgggagaacccaagcgaagatagaaagatgaatacaagcagaggtgtatgagaaaagcagacgttttctctactacattcaacatgaagggatttctccccacaccaaccgattctccagctctctgaacaccaaagtgggtgtcctacaattcaatcatgatgctaactacctggggttagtgcaccccccacaggacaagg

SEQ ID NO: 256531 - DNA, 193 bp, Homo sapiens
tatggttgtggctgtcccattagagaacatggtccccccaacagtgactgtcctaaaccacatttagtttcttagtcctgtaacagtgtttttcatgtatatatttctttagttctgttcatatatctatttacaaaatataacttatttcccaaggtttttagtaagagggaaattctttaggcatggattt

SEQ ID NO: 256532 - DNA, 442 bp, Homo sapiens
tccaggctaccccaataaagcaaatattgcaataaagcagtaaatcaaatatttcaataaagcgagtcacatgaactttttggtttcccagtgcgtataaaagttatgtttacactatgctgtagtctattaagtgtgaaatagcattatgtctaaaaacaatgtacataccttaattaaaacatacttcattgctaaaaaatgctaacgatcatctgaaccttcagcaagccatatctttttgctggtggagggtcttgcctccatgtcagtggctgctgactgatcagattggtggttactgcaggttggagtgattgtgacaatttcttaaaataagacaacatgaagtttgacatatcagttgactcttctttcgtgaatgattctctgtatcatgcgatgctgtttgatagcattttacccagagtagaacttcttt

SEQ ID NO: 256533 - DNA, 132 bp, Homo sapiens
ctgcattaaaattaggatacaaattatgtgcacagcagaagccagaaggctgggatgtgactccatgcatgcttagctctaaggcttctgtgtgttctctgagtgggtttctttgtctctgccataactatc

SEQ ID NO: 256534 - DNA, 471 bp, Homo sapiens
ccctggtcccacaggttcctctgatctccagaagatgtgcttgcccctgcagaagggcagagagtcaggagggagcagggaagcccagggaagcccagggagggatcccctctagcagagctgagagatgcctggcctcccctcaaccccactagatttaacattcagagcagcacgtggatcaggcaggatgacttgctcggagccctcgccagcccaaggcatgtcaaatgcagctgctatttccagcagctattctaccagagaagccctgtcacatctgatatggctgaatccatgattttggaggatggatgtgcagtcagcaatggctatacaacagatactagaacagttgctgggagctggggaggaaggggaatgaggggaccccttaggagcttaacacttgatacaattatccatcttcaaccccatggactgacggtgggaaaggtggagagacaggtg

SEQ ID NO: 256535 - DNA, 342 bp, Homo sapiens
tctcatggtgacaaggaagtggtggggtcttgtctgtattcctaaacttccttgaagtttacacctgcttctcactttgtccttttcttttgcctacttttgggtggaatgaagtggtttatcctattttaggctactaacttttgaggtgtttatcctgagcagcctgagtcttggttagcatttctacttggctgagatccacccatccacactccttaacttgtttccctgtcattgcacactggaaactgaagcacctgtagtcatgctataaaacaaatgtgataatatgtgtgaagcagtggtaaaaaataaaaactcaaggttcaagataaaaaa

SEQ ID NO: 256536 - DNA, 627 bp, Homo sapiens
tgtcttcagttgtttagacgaacgatttggatgatcctaaatttctttgaaacttttacatttagagttccaaaaatttgtttttctccaagattaaagcaattctagcatagtagcagcatgctgcatcaacaagttgatttttttttaaagtgtatgtcttctattgaagagctcgatgaagttcttaactgttgtctctttaattaaacagagaacagcaaagcttgtttttttgccaatcgcaaatttatactcaatttaaaccatggcttttaacaaaattcctatactaaaataactcttcacacaagaatcttagtggattttttataggttcttggttaaccagcaaaactcaacaaaatttgttggcattagtaacaaatactttttaaatatgcttctatttctcccatcagaactttgatttctcttcaaagaagcctcatcatagacttactcacacatttgtgagagttattagaattgccataatcaatggatactgaagaaaagggaagatttgagggttggtttttgtttttaatttttaaaaaactcgtatcatgattctggagctaaaagcagctcacatgggccttatatgagctttgcctctctttg

SEQ ID NO: 256537 - DNA, 1368 bp, Homo sapiens
atggccacagcaggaaatccctggggctggttcctggggtacctcatccttggtgtcgcaggatcgctcgtctctggtagctgcagccaaatcataaacggcgaggactgcagcccgcactcgcagccctggcaggcggcactggtcatggaaaacgaattgttctgctcgggcgtcctggtgcatccgcagtgggtgctgtcagccgcacactgtttccagaactcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggcagaatgcctaccgtgctgcagtgcgtgaacgtgtcggtggtgtctgaggaggtctgcagtaagctctatgacccgctgtaccaccccagcatgttctgcgccggcggagggcacgaccagaaggactcctgcaacggtgactctggggggcccctgatctgcaacgggtacttgcagggccttgtgtctttcggaaaagccccgtgtggccaagttggcgtgccaggtgtctacaccaacctctgcaaattcactgagtggatagagaaaaccgtccaggccagttaactctggggactgggaacccatgaaattgacccccaaatacatcctgcggaaggaattcaggaatatctgttcccagcccctcctccctcaggcccaggagtccaggcccccagcccctcctccctcaaaccaagggtacagatccccagcccctcctccctcagacccaggagtccagaccccccagcccctcctccctcagacccaggagtccagcccctcctccctcagacccaggagtccagaccccccagcccctcctccctcagacccaggagtccagcccctcctccctcagacccaggagtccagaccccccagcccctcctccctcagacccaggggtccaggcccccaacccctcctccctcagactcagaggtccaggcccccaacccctccttccccagacccagaggtccaggtcccagcccctcctccctcagacccagcggtccaatgccacctagactctccctgtacacagtgcccccttgtggcacgttgacccaaccttaccagttggtttttcattttttgtccctttcccctagatccagaaataaatcccctagatccagaaataaagtctaagagaagcgc

SEQ ID NO: 256538 - DNA, 563 bp, Homo sapiens
aactcaagttctccatgggagatccatgcagagatatgaaaataggacggacgtctcttccttcttaaaagttgctccagattttggcttcaagtgcttcctgttttttgccctcccttatccctgggagttccctctatttactttcacaaggactcttggtataaaagatatttgtatacctgggtgtgtgggaaggaattgaaggcaaaggtagcagtcatttcaagctgaacatgttaagtggtaatcgagcacttggtttttgtagtacctcctgtggccatctccacagtgtcatatttgaaagaaatcttgtgtaagcattggtctaagggtcactgactgtgaataatgaatgcggtgacagcatggccatcttagagacaggcaggccagatattggttactttgattttagttgacaaagtttatttgcttttaagttttaaagcaatacagcagtgtgaacttcaagttgtaaactttcatttagaaagtttaaaatttagttgaaatataaaatattctgaatttgaataaaaagttttaaaacttaaact

SEQ ID NO: 256539 - DNA, 4486 bp, Homo sapiens
gtagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggcaagaaggctgcttgatcttgccacggtgaaagcgaatggattggctgccttccttctacaacatgttcaggaattaccagtcccattggccctgcctttggaagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggacactgtgctggtggtgggtgaggcgggcagtggcaagagcacgctcctgcagcggctgcacttgctgtgggctgcagggcaagacttccaggaatttctctttgtcttcccattcagctgccggcagctgcagtgcatggccaaaccactctctgtgcggactctactctttgagcactgctgttggcctgatgttggtcaagaagacatcttccagttactccttgaccaccctgaccgtgtcctgttaacctttgatggctttgacgagttcaagttcaggttcacggatcgtgaacgccactgctccccgaccgaccccacctctgtccagaccctgctcttcaaccttctgcagggcaacctgctgaagaatgcccgcaaggtggtgaccagccgtccggccgctgtgtcggcgttcctcaggaagtacatccgcaccgagttcaacctcaagggcttctctgaacagggcatcgagctgtacctgaggaagcgccatcatgagcccggggtggcggaccgcctcatccgcctgctccaagagacctcagccctgcacggtttgtgccacctgcctgtcttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgagatgcaggaggagcggctggctcggaaggctgcacgtggcctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtatttgcgcgataacaatatctcagaccgaggcatctgcaagctcattgaatgtgctcttcactgcgagcaattgcagaagttagctctattcaacaacaaattgactgacggctgtgcacactccatggctaagctccttgcatgcaggcagaacttcttggcattgaggctggggaataactacatcactgccgcgggagcccaagtgctggccgaggggctccgaggcaacacctccttgcagttcctgggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctagaagaactctgcctggaggagaaccatctccaggatgaaggtgtatgttctctcgcagaaggactgaagaaaaattcaagtttgaaaatcctgaagttgtccaataactgcatcacctacctaggggcagaagccctcctgcaggcccttgaaaggaatgacaccatcctggaagtctggctccgagggaacactttctctctagaggaggttgacaagctcggctgcagggacaccagactcttgctttgaagtctccgggaggatgttcgtctcagtttgtttgtgagcaggctgtgagtttgggccccagaggctgggtgacatgtgttggcagcctcttcaaaatgagccctgtcctgcctaaggctgaacttgttttctgggaacaccataggtcacctttattctggcagaggagggagcatcagtgccctccaggatagacttttcccaagcctacttttgccattgacttcttcccaagattcaatcccaggatgtacaaggacagcccctcctccatagtatgggactggcctctgctgatcctcccaggcttccgtgtgggtcagtggggcccatggatgtgcttgttaactgagtgccttttggtggagaggcccggcctctcacaaaagaccccttaccactgctctgatgaagaggagtacacagaacacataattcaggaagcagctttccccatgtctcgactcatccatccaggccattccccgtctctggttcctcccctcctcctggactcctgcacacgctccttcctctgaggctgaaattcagaatattagtgacctcagctttgatatttcacttacagcacccccaaccctggcacccagggtgggaagggctacaccttagcctgccctcctttccggtgtttaagacatttttggaaggggacacgtgacagccgtttgttccccaagacattctaggtttgcaagaaaaatatgaccacactccagctgggatcacatgtggacttttatttccagtgaaatcagttactcttcagttaagcctttggaaacagctcgactttaaaaagctccaaatgcagctttaaaaaattaatctgggccagaatttcaaacggcctcactaggcttctggttgatgcctgtgaactgaactctgacaacagacttctgaaatagacccacaagaggcagttccatttcatttgtgccagaatgctttaggatgtacagttatggattgaaagtttacaggaaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttatactcttatagacaacatggccgtgaactttatgctgtaaataatcagaggggaataaactgttgagtcaaaaca

SEQ ID NO: 256540 - DNA, 4419 bp, Homo sapiens
gtagacagatccaggctcaccagtcctgtgccactgggcttttggcgttctgcacaaggcctacccgcagatgccatgcctgctcccccagcctaatgggctttgatgggggaagagggtggttcagcctctcacgatgaggaggaaagagcaagtgtcctcctcggacattctccgggttgtgaaatgtgctcgcaggaggcttttcaggcacagaggagccagctggtcgagctgctggtctcagggtccctggaaggcttcgagagtgtcctggactggctgctgtcctgggaggtcctctcctgggaggactacgagggcttccacctcctgggccagcctctctcccacttggccaggcgccttctggacaccgtctggaataagggtacttgggcctgtcagaagctcatcgcggctgcccaagaagcccaggccgacagccagtcccccaagctgcatggctgctgggacccccactcgctccacccagcccgagacctgcagagtcaccggccagccattgtcaggaggctccacagccatgtggagaacatgctggacctggcatgggagcggggtttcgtcagccagtatgaatgtgatgaaatcaggttgccgatcttcacaccgtcccagagggcaagaaggctgcttgatcttgccacggtgaaagcgaatggattggctgccttccttctacaacatgttcaggaattaccagtcccattggccctgcctttggaagctgccacatgcaagaagtatatggccaagctgaggaccacggtgtctgctcagtctcgcttcctcagtacctatgatggagcagagacgctctgcctggaggacatatacacagagaatgtcctggaggtctgggcagatgtgggcatggctggacccccgcagaagagcccagccaccctgggcctggaggagctcttcagcacccctggccacctcaatgacgatgcggacactgtgctggtggtgggtgaggcgggcagtggcaagagcacgctcctgcagcggctgcacttgctgtgggctgcagggcaagacttccaggaatttctctttgtcttcccattcagctgccggcagctgcagtgcatggccaaaccactctctgtgcggactctactctttgagcactgctgttggcctgatgttggtcaagaagacatcttccagttactccttgaccaccctgaccgtgtcctgttaacctttgatggctttgacgagttcaagttcaggttcacggatcgtgaacgccactgctccccgaccgaccccacctctgtccagaccctgctcttcaaccttctgcagggcaacctgctgaagaatgcccgcaaggtggtgaccagccgtccggccgctgtgtcggcgttcctcaggaagtacatccgcaccgagttcaacctcaagggcttctctgaacagggcatcgagctgtacctgaggaagcgccatcatgagcccggggtggcggaccgcctcatccgcctgctccaagagacctcagccctgcacggtttgtgccacctgcctgtcttctcatggatggtgtccaaatgccaccaggaactgttgctgcaggagggggggtccccaaagaccactacagatatgtacctgctgattctgcagcattttctgctgcatgccacccccccagactcagcttcccaaggtctgggacccagtcttcttcggggccgcctccccaccctcctgcacctgggcagactggctctgtggggcctgggcatgtgctgctacgtgttctcagcccagcagctccaggcagcacaggtcagccctgatgacatttctcttggcttcctggtgcgtgccaaaggtgtcgtgccagggagtacggcgcccctggaattccttcacatcactttccagtgcttctttgccgcgttctacctggcactcagtgctgatgtgccaccagctttgctcagacacctcttcaattgtggcaggccaggcaactcaccaatggccaggctcctgcccacgatgtgcatccaggcctcggagggaaaggacagcagcgtggcagctttgctgcagaaggccgagccgcacaaccttcagatcacagcagccttcctggcagggctgttgtcccgggagcactggggcctgctggctgagtgccagacatctgagaaggccctgctccggcgccaggcctgtgcccgctggtgtctggcccgcagcctccgcaagcacttccactccatcccgccagctgcaccgggtgaggccaagagcgtgcatgccatgcccgggttcatctggctcatccggagcctgtacgagatgcaggaggagcggctggctcggaaggctgcacgtggcctgaatgttgggcacctcaagttgacattttgcagtgtgggccccactgagtgtgctgccctggcctttgtgctgcagcacctccggcggcccgtggccctgcagctggactacaactctgtgggtgacattggcgtggagcagctgctgccttgccttggtgtctgcaaggctctgtatttgcgcgataacaatatctcagaccgaggcatctgcaagctcattgaatgtgctcttcactgcgagcaattgcagaagttagctctattcaacaacaaattgactgacggctgtgcacactccatggctaagctccttgcatgcaggcagaacttcttggcattgaggctggggaataactacatcactgccgcgggagcccaagtgctggccgaggggctccgaggcaacacctccttgcagttcctgggattctggggcaacagagtgggtgacgagggggcccaggccctggctgaagccttgggtgatcaccagagcttgaggtggctcagcctggtggggaacaacattggcagtgtgggtgcccaagccttggcactgatgctggcaaagaacgtcatgctagaagaactctgcctggaggagaaccatctccaggatgaaggtgtatgttctctcgcagaaggactgaagaaaaattcaagtttgaaaatcctgaagttgtccaataactgcatcacctacctaggggcagaagccctcctgcaggcccttgaaaggaatgacaccatcctggaagtctggctccgagggaacactttctctctagaggaggttgacaagctcggctgcagggacaccagactcttgctttgaagtctccgggaggatgttcgtctcagtttgtttgtgagcaggctgtgagtttgggccccagaggctgggtgacatgtgttggcagcctcttcaaaatgagccctgtcctgcctaaggctgaacttgttttctgggaacaccataggtcaccattgacttcttcccaagattcaatcccaggatgtacaaggacagcccctcctccatagtatgggactggcctctgctgatcctcccaggcttccgtgtgggtcagtggggcccatggatgtgcttgttaactgagtgccttttggtggagaggcccggcctctcacaaaagaccccttaccactgctctgatgaagaggagtacacagaacacataattcaggaagcagctttccccatgtctcgactcatccatccaggccattccccgtctctggttcctcccctcctcctggactcctgcacacgctccttcctctgaggctgaaattcagaatattagtgacctcagctttgatatttcacttacagcacccccaaccctggcacccagggtgggaagggctacaccttagcctgccctcctttccggtgtttaagacatttttggaaggggacacgtgacagccgtttgttccccaagacattctaggtttgcaagaaaaatatgaccacactccagctgggatcacatgtggacttttatttccagtgaaatcagttactcttcagttaagcctttggaaacagctcgactttaaaaagctccaaatgcagctttaaaaaattaatctgggccagaatttcaaacggcctcactaggcttctggttgatgcctgtgaactgaactctgacaacagacttctgaaatagacccacaagaggcagttccatttcatttgtgccagaatgctttaggatgtacagttatggattgaaagtttacaggaaaaaaaattaggccgttccttcaaagcaaatgtcttcctggattattcaaaatgatgtatgttgaagcctttgtaaattgtcagatgctgtgcaaatgttattattttaaacattatgatgtgtgaaaactggttaatatttataggtcactttgttttactgtcttaagtttatactcttatagacaacatggccgtgaactttatgctgtaaataatcagaggggaataaactgttgagtcaaaaca

SEQ ID NO: 256541 - DNA, 490 bp, Homo sapiens
taaaaatacaaaaattagctgggtgtggtggcatgtgcctgtagtctcagttgctggggaggctgagacaggagaatcgcttgaacccaggaggcagaggttgcagtgagccaagatcacaccactgcactccagcctggcaacagagcatgactctgcaaaaacaaaacaaaacaaaaacaaaaaaccttcatgcaataatatatcactaagaatttcttagagtgtttagtttcttctttgtgcagaaacagaaatatctaaaacatatagtgtggagtaaggaggattcaataacttggagttgagctcttggaagtgagaagtgcaaatggcataggggaaggcaggctttgagtgatcagccagctgagggatgcaaagtttttccaaataataaaccttcaataaatgattcacagctccagtaaatcttgaactatcttccaggtaaaataatttttcttactatgaatatttttaacaggag

SEQ ID NO: 256542 - DNA, 410 bp, Homo sapiens
caataattccatattttcttatattacctaaaatccacatactcttcaataaatttaccaccatagggttttcaaaccccatcaaaaaaaccacttctttcatgtaaatgcccagcagtttatctctttttactcctcagtaccctacacatcttcctaataaagtatataataaaagtaaatcttcccactagtgtgtttatagtgtgaaacacattgttattcccaccatggcagtggtggataaaatatacatatttctctgtctcccacaaccaccctttgatccccagccttttatcagcaaatccaaagtgctaccttctgcaaattagcactacctcctgagaaattgtgccaagttccattaaatgtaattagcattcctgttgtttccttcatattggaga

SEQ ID NO: 256543 - DNA, 539 bp, Homo sapiens
aaccttcagagagaccatggccctgctgacaccttaacttccagccttccagaacttacagaagagctttcggtcactttaagacaccatgtttgaggtactttgttaagcagcctgaagaaactaatatacacatggatacaatttaaattatacataagcacacacattcgcgtacccttcggagttttaattctatgtccctgcagtcaaatgttcaaatgctggtccatcacttcttagctagagattgaggatccctaatctgaaaacctgaaatccaaaatgctataaaactcaaagctttttgagcatcaaaattatactcaaaggaaaaactcagtggagcactgtggatttcccactagggatactcaacctgtgggttatttatttaacatttacttaacatctctatggctgtttctcaaactgtaaaattgggacaaagaattgggcagattaagaataaacatgtaaaatgcctggaactatcaagtacttaataaatattagctctgaggttgttgtcaaagtca

SEQ ID NO: 256544 - DNA, 454 bp, Homo sapiens
ttcttatggctttttcctctataagaactcaaagggggagagaaaaagacgaaaaatatcttcaaagaggagaagaaatctgatctttctctacgtctgcttagttggcgtaactttaggatgtccataagttgtagctttcctgggaaaatttgattttacactggttatcccaacataatattaatggtatcctcttagactctcaatagtgtccggtttggatgacaaattctgtggtctttttagccaactgctactgaagtggtcagatttattgcacaaaatatatttttaaaaataagtagcacaagatgaaatatggcctcaaatttcttggttagtttccactagaaagttttaaacattaaaaagtacaaaattcattacatttattgaatgataaagtataacattgtatgaagttgatgactattaaaactatttgagtgtt

SEQ ID NO: 256545 - DNA, 504 bp, Homo sapiens
aacgttaccttaagctgctgccctgggcacggagagacacagatggacagcaaggatgcagagggatgcctggtgttcccgacacttcgtggatggtcccagcgaaaggaggcttgtgcaaagtgttttatgatgcttatgcatccgggaagcttcagggacaaagtgattttggagaaaatcagttaaagatttttaaagaggggatttaattggagggaggcagaagaggtgccaacttgatttctgaaaattgtaatccctactgctctcagagccactgcctggtacggaaagtgtatcttctcccactggctttgcacaccatttaacaggaaattcaagtcgaaatatcagggggaaaaaaagcctcctagccttattactagaagaagacccctccctcccaccatttgtaatagaaccctcttcaggacgaggcctccggaattgctgtttatctcttattcgtgctctaataaaatcaatatgtgtgtcctacta

SEQ ID NO: 256546 - DNA, 427 bp, Homo sapiens
tatagtttgcctatagattaaaacatgcatagttttaaaactcacatgtgcacagtatttgagataagttatttatatttttctttcaaaatcaatttatgaaacctacgtttctgaaaatagaaatattggaaactaaagtacttacaaactaataaatccttatagaaaattttagaattattatttttttcaatagaatccctttaacccttttattttgcatattgagcttcatgaataacatcatgctgcagaagcagcgaccaggaaaagttatctcctacgaagcatagcaacagaggaagatgttatacagtgttttcattttcaattttcctactgagctttaagattttcatgtaattttcttcaataaactgaagagtctttctttaacataagattcttaaataatttattttca

SEQ ID NO: 256547 - DNA, 601 bp, Homo sapiens
tagatcgagctcggtacctacttttcacagggggaaagccggcattaataaggaccaggaaaactttgcataaaataaataggagatggaatagattgaatttgtatatgctgcttccatttcttcctccattttgtgttgtcttcctaagtcgagttactggcaaagtgggatttgatttgccacaaggactcataccttctgcagcctaggtgatgggcctttcttctttgtgggacgtttgtgtgaccattgatgtttccaggaaggaagaatctgatggaggggctgttaccatgaaatgttgatgattacttggtacaagtagtgcgtgggagacagaatcccaaagtgttgggattacaggcgtgagccaccacactcagctgatttttattctttaataagagcaacccatttcttttatcaacagacttgttttcttagcaaaaagggaggacgtattgatgtcactgctttccattcaactaagttggtatttgtgttcagatttagggattcctgcttgcccgaaccgttcatttatcttttaccttgtaattgtcccaacagcctgtggaaaagtagtccgagctcgatc

SEQ ID NO: 256548 - DNA, 1357 bp, Homo sapiens
agtacttccaccagctcaccttcccagagtcctcctgggccctctgaagacgtcacttaacaatggagttgttagtaggagaaaataaagcctttttctccctagatgtagttcagtgggaactgaaagtgtaccagaaatcatggttcaagcttgtgccagtgggtgcaaggggtggttcttatggaggagaaagcgcagttcatttagacttggcattgaaatcgaactctgttgttcggtggagtgaacattgatatggagattcccacccgccccccacctccgtaggatacccccttacacaggtcctgtatgcttttctttttcttccattttctttctttattttcttcttttgtcctcttagaaatagtctctctgtagaccggccagatttgtcaagttaccaccctctaaatttttacagctccgtatattcagacttggtatttgtgaattagctaaaagtgggctgccaatctgtactttatttacattcgaagccatattagtgagagccccagaaaaaaatgttaatatgcaggaagaggcaaaagggttgagtttctgactgttgctaacctcaccactgcctttaaaaccaatcatgaggcacacggctgatatttaatagcttttagctgattatttttcttctcctcctctttcttttctatccaagttgacctgggtgtacttgagtggaaatgaagtcatccaaatgctgaattagaataatcacaggcctctaagaatgaaatggaagcagagattaaatggcggagggaaagccggcattaataaggaccaggaaaactttgcataaaataaataggagatggaatagattgaatttgtatatgctgcttccatttcttcctccattttgtgttgtcttcctaagtcgagttactggcaaagtgggatttgatttgccacaaggactcataccttctgcagcctaggtgatgggcctttcttctttgtgggacgtttgtgtgaccattgatgtttccaggaaggaagaatctgatggaggggctgttaccatgaaatgttgatgattacttggtacaagtagtgcgtgggagacagaatcccaaagtgttgggattacaggcgtgagccaccacactcagctgatttttattctttaataagagcaacccatttcttttatcaacagacttgttttcttagcaaaaagggaggacgtattgatgtcactgctttccattcaactaagttggtatttgtgttcagatttagggattcctgcttgcccgaaccgttcatttatcttttaccttgtaattgtcccaacagcctgtggaaaagtagtccgagctcgatc

SEQ ID NO: 256549 - DNA, 1232 bp, Homo sapiens
agtacttccaccagctcaccttcccagagtcctcctgggccctctgaagacgtcacttaacaatggagttgttagtaggagaaaataaagcctttttctccctagatgtagttcagtgggaactgaaagtgtaccagaaatcatggttcaagcttgtgccagtgggtgcaaggggtggttcttatggaggagaaagcgcagttcatttagacttggcattgaaatcgaactctgttgttcggtggagtgaacattgatatggagattcccacccgccccccacctccgtaggatacccccttacacaggtcctgtatgcttttctttttcttccattttctttctttattttcttcttttgtcctcttagaaatagtctctctgtagaccggccagatttgtcaagttaccaccctctaaatttttacagctccgtatattcagacttggtatttgtgaattagctaaaagtgggctgccaatctgtactttatttacattcgaagccatattagtgagagccccagaaaaaaatgttaatatgcaggaagaggcaaaagggttgagtttctgactgttgctaacctcaccactgcctttaaaaccaatcatgaggcacacggctgatatttaatagcttttagctgattatttttcttctcctcctctttcttttctatccaagttgacctgggtgtacttgagtggaaatgaagtcatccaaatgctgaattagaataatcacaggcctctaagaatgaaatggaagcagagattaaatggcggagggaaagccggcattaataaggaccaggaaaactttgcataaaataaataggagatggaatagattgaatttgtatatgctgcttccatttcttcctccattttgtgttgtcttcctaagtcgagttactggcaaagtgggatttgatttgccacaaggactcataccttctgcagcctaggtgatgggcctttcttctttgtgggacgtttgtgtgaccattgatgtttccaggaaggaagaatctgatggaggggctgttaccatgaaatgttgatgattacttggtacaagtagtgcgtgggagacagaatcccaaagtgttgggaagaaatggaagcagcatatacaaattcatctattccatctcctatttattttatgcaagttttctggtccttattaatgccgcttccccctgtggaaaagtagtccgagctcgatc

SEQ ID NO: 256550 - DNA, 859 bp, Homo sapiens
ttatttacattcgaagccatattagtgagagccccagaaaaaaatgttaatatgcaggaagaggcaaaagggttgagtttctgactgttgctaacctcaccactgcctttaaaaccaatcatgaggcacacggctgatatttaatagcttttagctgattatttttcttctcctcctctttcttttctatccaagttgacctgggtgtacttgagtggaaatgaagtcatccaaatgctgaattagaataatcacaggcctctaagaatgaaatggaagcagagattaaatggcggagggaaagccggcattaataaggaccaggaaaactttgcataaaataaataggagatggaatagattgaatttgtatatgctgcttccatttcttcctccattttgtgttgtcttcctaagtcgagttactggcaaagtgggatttgatttgccacaaggactcataccttctgcagcctaggtgatgggcctttcttctttgtgggacgtttgtgtgaccattgatgtttccaggaaggaagaatctgatggaggggctgttaccatgaaatgttgatgattacttggtacaagtagtgcgtgggagacagatgaaagagtgtggggcacaggcacagtggctcacgcctgtaatcccagcactttggggggccaaggcgggcgaatcatgaggtcaggagttcgagaccagcctggccaacatggtgaaaccctgtctctactaaaaatacaaaaaattaactgagcgtggtggtgggcacctgtaatcccagctactcgggaggttgaggcaggagaatctcttgaacccaggaggtggaggttgcagtgagccgagatc

SEQ ID NO: 256551 - DNA, 216 bp, Homo sapiens
gtatttttagtagagacagggtttcaccatgttgcccaggctggtctcgaattcctgagctcaagcaacccacccaccttggcctcccaaagtgctgggattccaggcatgagccatgcgcctggcctgttgggttactttttaaatcttccggttctctcttcatactatcctgttactgcatgttgatctctcttccccttctgtcgtcttctc

SEQ ID NO: 256552 - DNA, 257 bp, Homo sapiens
acacgtgcatctattttcaacataaatacacaggccctcgtatgtctgtacacgtctagatttcaaagtcaactggtaactgtcccccagaagcccagttatcgtgtgaccctgcagttccacgctgcaactccactcctagctgtacacccaagagactgaaacttacgtccacacgcaggcctgcatacgagcgtccagggcagcacgactcagtggccaaaaggcaggagcaccctgagcgcccatcggcagac

SEQ ID NO: 256553 - DNA, 681 bp, Homo sapiens
aatatataattaatgttatattaattacatattgatacaatatataattaatgttatattaattacatattgatacaatatataattaatgttatattaattacatattgatacaatatatgttatatataattatatattaatataatatataacataataatataacatatattatatagtatattattatattatatactctctctctctctctctctctctctctctctctctctctatatatatatatatatatatatatacttttttttttgagacagaatcttgctctgtcacccaggctggagtgcagtggtgtgatctcagctcactgcaacctctgccttctgggtttgagcgattctcccgcctcagcctcccaagtagctggtgcccgccatcatgcccggctattttttgtatttttagtagagacagggtttcgccacgttggccaggctggtctccaactcctgacctcaggtgatctgcccgccttggcctcccaaaatgctgggattacagccatgagctactgtgcccggtctgtattatgtttatatatagaatattataattatacatttacattatataaatattatctatattatataaatattacatattatataagtaatattattcccatttcagagaagaggaaactgaggctta

SEQ ID NO: 256554 - DNA, 215 bp, Homo sapiens
agaattctaaatataaactaggaacctctggtctgcagtgcttctcaaattggttcctagactgggtagtatcactaggaacatgacaaaaatgtttttgggccaggcacggtggcttacacctgtaatcgcagcaatttgggagaccaaggcaggcaggtcacttgaggtcaggagtttgggaccagcctggccaacatggcaaaactccatct

SEQ ID NO: 256555 - DNA, 308 bp, Homo sapiens
cactggaacctctctaggtagccttatctgttagtggcccatggctggattaggtacagttgggtacctcatgcaaatccactctgtcataatcaactctttacctagttctcctcctctgaattcttaagctcactgagaacagggatgaagcctttcttatctctgtataacatgtctgacatctagtagatacccaataaatactggttagataagtaaatgactagatgaataaaaagtaaagcaagtgccaatttaaaatgtagcattttggctgggcacaggggctcatgcctgtaatccca

SEQ ID NO: 256556 - DNA, 819 bp, Homo sapiens
atttgtattaatgttattcaaaggcagtaatttcagcgaataaacttgttaaatgggcctaaatgtttataatgttgactaagcattaagaacaaacaaaaaggtataaggcagttatacctttttgctccagaaatacaagtaaagacagctaccattatacttcttgaaaaacgtctcaggtattgctaaattaatacttgcttaaattcttgggctttaaatgaatagcgtgatttcacactctagtgtgagtgagtgtacagatgatgtctattcgttggtttgattagggtatctagaatcagccttttctaattgctcagtaaagtatgaattaaaaccacatagaaaataatgtggtaaattctttcttacaatagtgtcattcctttcaattataattctttttcctgggatgattggtgtaactcactgaaagaaaacaaaacatttttttttcttttttttttggtgaaaatgttaccctctggtacctcagtttcttttatatagtggcaatttgaatagaggcagtcacataagatttacttcagctgaatggctaaaatttgagaaatactattgaaaaatctcattaaaaaatagtatgcaaataaaaactatcaaatgtccaaagcaatcatacaatgtagaaactaagagcaccatgaaaggtttcctggaacttaatgattctatctgtgcttttcaaaggagggatctgggttaagaatcaaaaaataaaaacaatcaaatattgtaactgacctcaaatgagtttcaatttattgggctcttctttgacattctaagctt

SEQ ID NO: 256557 - DNA, 415 bp, Homo sapiens
ttgggtcagcttgttaaaggaggcgagaaggcaggggagggaatatgcctgggcatgtaaggctcatcgggacctcggttaccatttcacctgtgcaaattttcaggactgagtcttttctctatactgccccacgaggggactgacattacttaaggcctctctccaggaccccgagctcaggcctagcccgatggagcagaaccatctctggagcagaaccacccctgaccagaagtccaaagatgtgagactggggtcaaatctaggtttactcctagtcgagaaaatgggaaggacaatgtcatatctcctctggtctgtgaggtcgatggctgtaaaagttgcccagtggtgaactcagttaggtcttatctgttgcagattatgtcactccacccctctgagacttcag

SEQ ID NO: 256558 - DNA, 295 bp, Homo sapiens
ccttagagaagccatccttgtttgctccatctaaagtagggcatcctcctccccttttctattatataactctgcttatgtgctcaatagcactgtttataatataaaattattattattgtattattattactttttaaattgtttcttgtttccctgcctcctcctgtatcttctcaagctccttcaatatcttgattgctttgtccaaatctatagctcctagcacaatgcttggaacatagtagagaatcaatacatgtaagttggatgaataaacaaatgaatacctaat

SEQ ID NO: 256559 - DNA, 516 bp, Homo sapiens
cagccaaaccatatcaatatgtggtagaatgtttaaattttgtccataaacaaatctgccactttgtggtttttgctactgggaaaatgttttaaaatagtattcacattccaatatttaaaaaatatattctcctctgatcccttatagttttttaaaacattgttaatggacttcagatattaaaaaaatggattaatgataatcgatggttcttgacacagtattattggtctatttatgtcatttcctttttaaataatataacaaatacatgtgaacccatcacccaacccaaaacctagtacattaccaataactcatatctacctgtggtatcttttctatcccattctcctacctccctaacagaagtatcctgagattatatcaatacttcccttgccttaaaaagttttatcttatatgtatgtatgaacagacaatatactgtttacttctgcttgtttttgaactttataaattgatattaaaccatatactgtcttttaagaa

SEQ ID NO: 256560 - DNA, 446 bp, Homo sapiens
atacatacttctggccaggaaagatggagagagaaacccagttctcttcctgttcagcaagtataaaaaagtgctagacattttatgtgtgtctagtaaagacggaccgccgccggccccagaattagctatgtctgaatggaacatttttgctctatatgaatgaggcaaccccaagacacataatgatggcaggcagtacagttggcagttaagggcatgagctttagcactgggcagctatagtgtcaaatcccagctctgccacttactaactatgggatctaccaaattattcaatctttcaaatattttgtatcctcccttacaaaatgggggtagtaaaagtatccacctcactgggtttttgtggggatgtaaaaaggtaagacatgaaagtattaacacaatgttattcatctaataaacattcaataaactcatta

SEQ ID NO: 256561 - DNA, 832 bp, Homo sapiens
aaagaaaagaagtatggaaggcaggggtagcaaggcggagctgtgccctgtcacggcacacagagaatgcccatggattttcacaaatgctgttaaaatgtgaaaagaaggtgtttcttttttcttcaatctgagcttcaagctaatatgggcattcagctaaatccctcctgggtcctgaaacagtatgtggttttggatttcaaagataatccctacaacttctgggagaggtgcaagtatcaaccagttggagacacagggaaagggtgatataatgcagaaagtgacttgaacaaatttacacagaaggcagtgaagtgtgattcaaattcaagcagtctagactgtgccccacacaactctgcagcataaccttgcagtatgaaaataatgcctctcatgcagatacaagtctgacaggaaaaccactgctgcttctgctgccaatttgttaagcatcgtgacaagaggagtgaccgagaagatggaaaagcccggtctgcctagtgccccttcagttggcaggattgctggcacagggccgtctaactgtgctggaaggtgttttagaagggacaagtggcactttggggagaggagtcacggatctcctggcttggccatgattcagcttttggagatttcatttagaatctgtgatctttcccatattcttcctaaaaggtattgcccttcctggcccctgcaatatagcaaggatggattttcaacaaagcaaataaaggactgattttcacaagatctgaaccccgaggagcagattgtcaacctttcttctctgctgaggacaaagacaagatcacagacc

SEQ ID NO: 256562 - DNA, 643 bp, Homo sapiens
aaagaaaagaagtatggaaggcaggggtagcaaggcggagctgtgccctgtcacggcacacagagaatgcccatggattttcacaaatgctgttaaaatgtgaaaagaaggtgtttcttttttcttcaatctgagcttcaagctaatatgggcattcagctaaatccctcctgggtcctgaaacagtatgtggttttggatttcaaagataatccctacaacttctgggagaggtgcaagtatcaaccagttggagacacagggaaagggtgatataatgcagaaagtgacttgaacaaatttacacagaaggcagtgaagtgtgattcaaattcaagcagtctagactgtgccccacacaactctgcagcataaccttgcagtatgaaaataatgcctctcatgcagatcagggatatgagatccagtgacttacccaaagtttcaaaggaaagatgtaacagagccatctctgaacttctgctcttgggaatctacacactctttccactagttctgaccttagcaggtgtttgacccaggacttgcccaacttggtttccatttgtatagaactaatgccaaatttcaaaagaaaatattacataccataatcaataaaaacaaaatatcaaacatgtat

SEQ ID NO: 256563 - DNA, 684 bp, Homo sapiens
taaaaacaaaaatcaaggaaacaaaaaaatttaaacagttttttagtgagatgagaacattgtgtttataacacctaagccacatttattactttccccaataatcagttatttaattgtgataaaaaattatagattcaatttacatgaaaaaaattgatgagtagcgtgtttcttataaacagttactacaataatggataattgtctcaaatgcatgctcctaaataatgttagctctcaccatcttcactgactggtagggtataagagagatggtaaaagtaagatattaaataaataacaaaaataatccaaaatagccttggcttcacccacacacacacagtactacttaaagtactggctcaaagatgctgatattaactctttacttaaatgtcaaagccaaagccacatttaacagcaaagccacatgcaacagcaaagccacttggctttactctttcaatgcatctttacaaaaatacatgttcttatctatcatcctctccttttgttttatttattgtttcttttcaaatctttctaaagttcttatactctttttccttaaaattttctcctaaaacttctctctgctgtttacaagattcctctgaaattcagttattagattaatttgtccctaactttctgtgttgtagtatgtattattgagat

SEQ ID NO: 256564 - DNA, 405 bp, Homo sapiens
gtcccagccccagccaagggaatattgagtgagcgtgctgttgtgtgcgcaccccagaaactttacggctctgtcactaaagggagccactccagtggttcttcccaaagaagtcagcttcaagatgactcagtgtccccatgccagaaatagaaatggctggcaactttcacatgtcagtttcttctgctaacaacaattccacaccctgttacatgcccattgaatttaacaacgggaggtccttagcgattttggacacagcagatggattttcagtccaaagcattcaggaagcactgaaatccgtgaccccatccccacctccgttgtggggctttgtaatgcatatcagcatattgaagaccgtggaaagcagtctccaacattttgtttaattcaaac

SEQ ID NO: 256565 - DNA, 421 bp, Homo sapiens
ctgtggagaggaccagtgcagacatggccaagtctaagaaccacaccacacacagccagtcccgaaatggcacagaaatggtatcaagaaaccccgatcacaaagatatgaatcctatttttttttctttgagacggagtctcgctctgtggcccaggcgggagtgcagtggcgccatctcggctcactgcaagctccacctcccaggttcacgccattctcctgcctcagcctcccgagtagctgggaccacaggcgcccaccaccatgccggctaattttttgtatttttagtagagacggggtttcaccatgttagccaggatggtctcgatctcctgacctcgtgatccgcccgcctcagcctcccaaagtgctgggattacaggcatgagccaccgcgcctggccgataagaatct

SEQ ID NO: 256566 - DNA, 426 bp, Homo sapiens
taatgtaattttgtgtgcatctttcataatttttcctttgaaaatataaataattataaattaatgtgtatattttttgaaactggaattatagaacaaatagcagccattctataattttttgttggtgtttaaattgtattgcagatattcttacaagtcaatatgtatcaatatggattgatcttataatggttgtatattatttcatagcaatatgtataccagaacttattatttattcaaccaggtttctgtggattgacattcagatttcttttttcctattacaagcaatgcagcaatgtgcatgtccatattatggtaccataaattctctcagataagtttccagaaataaaattattgagtaagggggtttgtgtattttttaattttaataaattataccatattattttgcaa

SEQ ID NO: 256567 - DNA, 367 bp, Homo sapiens
cacaccacaggcgccaggcaggctatggggtggcagcttaggcaggtgcctgagtacactgccaggtcgttcttccttgtccctagtccccaagggattagaagggtttctggcacttctgtgcttcctgagatgactccctgttctgtggttttggtgccagtaattgataaacctccaaaatgctgctgattggagcatgtcctcgctcctaacactcagaccttcaactcgggcctttgcctcttcaataagaccctccacggcccctccacacgtgtctccacctgttgcccaggacggggagtttacgtttgctaacaccatggttattaaagagcttttccgggctgcctgacttcaaaat

SEQ ID NO: 256568 - DNA, 348 bp, Homo sapiens
  misc_feature (331)..(331): n is a, c, g, or t
gtgcagaagaaaacatgatcttgtcattccactgtgcaaacccttttgaggatttcgatagcccttagaacacagcctaaacattttaacattgcctactggtcgtatttggtacatgccttttctcctgcagctgatatttaccacacacacacacacacacacacacacacacacacacacaagctaattgcaaatatacattttaacattgcctgctggtcatacttggtacatgccttttctcctccacctgacgtccaccacacacacacacacacacacacacacacacacacacacccccacctcctgctattaaacagtagcntcgcctcactgagaatc

SEQ ID NO: 256569 - DNA, 407 bp, Homo sapiens
agctggcaggacagaatcaaaagcaggggggtgtgggtgtggaataagtcagtgcagacccaggtccttgccgtcgctggagatctctgaactttgccgcctccctctttgctgaggtccctcaggtggcctcattgtttctattaccttggtagaaagcctgtgtgaagtccctgcctgcctggcagtctcgttgccatggaaacttccattccgcacacctgattcacacatcacgcttggctaagtccagacagaggtcacagactggcatttgccctttgtttccccttcttgtgttttccaggcacttaaaaatggatatagaaagatgagagggtgggcagtgttgtgtgtaagaacgctttgttgtcaactgtagaagtgtgtgaggaaaaaaaaaacca

SEQ ID NO: 256570 - DNA, 441 bp, Homo sapiens
tttcttttaataatttgctgagaatctgcaatgctgtaagtactttataatcattacttaatttaatcctcacaattgtcctctgtagtgagatgaagaaaattgtagtcactaaatttccacctaggaagagaattgcacttatttagaaatcatgccttgaaaactgcttgggttagaaggtagatccctgaactctccaagagtaagaacagtggaccttctgcaggtgaaactggagaaaaggtagatgagaaagaaagagagcgagagtaagacagagagcgagcacaagagaacacagaaggccccttccaccaccccaaatcttcagcaaattctacataaatcatgaaactcttaatgcgagtagatttctgtttttcttttttaattcaaaactgtcagggggctgggttctgtagtcagagtcttgtgata

SEQ ID NO: 256571 - DNA, 231 bp, Homo sapiens
ctcccctctgccatgatactcagggcctcgtgacataagctgagaaggagaattgggatagagccatcttaggggccaaaacaaggggtttgaaaaataaaaggagccacatggcagggtgagggcaagagacatgcagatgcataatcgtccatgggatttggaaattacaaggtcacctttgagcagtttcagtaacatgctgagaagagaaaccccatttctgggagt

SEQ ID NO: 256572 - DNA, 443 bp, Homo sapiens
ccccggtaccacctatgtgggagaggaggctttgtagcagtcagcaagggtggaagcaggtaggggctgctccaagcgatgatctgagaggggaagtccagcccaacctcagggggctctccccgcagcccagcacatgttcattggagggtaaagtattctgtagtaagtcctgctgtctttcctgctgtactttggccttaaggcaaacctcaggtctccaaagataagccgccctctggtgatactgggtctcaagtccttcatgcctaggacttcagggttaaaatcttcctttgctccatcaggggctggcaggcagggcaagcagccctagccacagaagtcaccttaggctgagcccgactagtctcagggataaccaccccaggctacaccagctgtgaatgctcgctagacctagcctcataaaggcagggcaa

SEQ ID NO: 256573 - DNA, 625 bp, Homo sapiens
gcctagagagtgaaagatactttggtgtggctcgatttttattatttttagccttatgatgatcctttaatttcatcctaacctgcttcattttactttagtaagaatcatcatatgatataaagagtaatgatgaaaagtaggtttctcaaacaaaatagaccatttctaatccctgacaatactatctccagacaggcatcaagtaaacaaataagcaactcttctatttttcaggatctagttctgaattatttgatttcttttatgttcgtttccttctaattatttgtgtccaatttcttgtcatctcatttatggcacatccctctcagatcactgggttgtcattccaggggaagtgagtactattatcccccattttacagatgaggatactgaatgtgaatcattagttcgttcaggatagctctactattaagtggtagaggcagaactgtctgggttgagaggccaagcatttaacttgaccctaggcacactgtaagatcaaattaacccattttggagcttgcaagctagtcttataatttaaacaaaattaaatattgattagatgagatgatcacatctagatatatgaagttattgagattttttaaat

SEQ ID NO: 256574 - DNA, 382 bp, Homo sapiens
gaattcactggatttaacccaactaaagagctttcacaaataggaaggttagatcggagttttgctggtcaagtgtggagcagggcataaacgattaatggatcagagaccatggagcctcctgtactcaagagatagctgctgctgaagacctggccccaggtgaataacataggcaaaggaacaacaaagccagaatggggaagagtgagcagagcatccagaaatggcggttgccagcaaaatagaactgctgaaaaagggcatggcaacttgaacagaaaaagtaattagtgcaattgaggagcttcaattacagcgttaaactggaactcaagaacatgattttttaagtttaaaaatatagcagatgtactgaaaa

SEQ ID NO: 256575 - DNA, 466 bp, Homo sapiens
cctgtttctacagtttgagcaggctctaaaggctacattctacatgcagctccttcttgctgccaagaaagaagaccaggccctgacttcatctagagatcctcagggaacattctttcctaatcatcctgagaatctttctgatcatcacagcacccaccattcaccatgccaaatgagataacttagttattctctcttacaaaccctatgcttttgtgtaccctcatttattcattctaccattgaacatttccctagaatctcttgggtgccagacactgtgcctagttactgaagaaacatatctcctatctgaggcaccaggcatataagtaaagaagaaaccatcttggacagtcaagcacacaccagatagagcggaagaaccacccagctaagcccaatccaaaatgctgaatcatgagaaaaaaaataataaactgttgttttaggcaactaagat

SEQ ID NO: 256576 - DNA, 370 bp, Homo sapiens
agggttcaagtgattctcctgcctcagcctcctgagtagctgggattacagaagcccaccaccacgcccagctaatttttgtatttttagtagagaaagagattcaccatgttggccaggctggtctcaaactcctgacctcatgatctgcccgcctcagcctcccacgttgccgagattaaaggcgtgagccaccacgcccggcccttccttctaaaattttaatagatatttactctcctttctccaaagattacccctccgtgtatgttctcagtcacatcccttcctaatttctgtggaccttagaactcatattttaccacttatgtccacggcatctttcctgcactgctggattcctatatgt

SEQ ID NO: 256577 - DNA, 370 bp, Homo sapiens
ctgcttgtccacattggaaactggcttaataatgtacctcttttagctgccttcccttcctctgtcatttcttttctctccattttacgtattttgaatgactaaactcccctgaatatttcttatattcacacctgtgtcttagagactgcttgcaaagaagccaaatagagacaagaaaaactaatgaaaacagaaaaatcagaaaatattgagctacagaaagaagaaaatgaaaatcatcaataatctaaacaccatttgtaatcactactaatgttttaatctctatccttccagacatttttttttaatgcagtcacttttttttttaaatggaaataaaatgataatgacaagtaaattatga

SEQ ID NO: 256578 - DNA, 416 bp, Homo sapiens
gtagttctctgagtgtggttcctggatcaggagccttggtatcactgggaatgtgttaggaatgcagattcttgggttctaccccggattgaattcagatttgggagcggggcccagttatctgtgttttaatcaccccctcccccaggtgaatctgatatgctaaagcctgagcctcactcccctggaaagtgacgcctgattcatctgcccagcccatgggcacccattaggaaggtgcttatgggagctttgacctgggctaggtgccggctcttgatccatctttttctaaggctgagggtgtccatagaaggagaagtaggtgcatccgcttagatgttatttaaccaaataaaggtttacagcttacagaaaagaggcaagattaactaataccttccaaaccataatgt

SEQ ID NO: 256579 - DNA, 167 bp, Homo sapiens
  misc_feature (6)..(6): n is a, c, g, or t
  misc_feature (9)..(9): n is a, c, g, or t
ggtttnggngagccctttactgcaccactcatgcctaactacctgctgtatcaccttccccaaccccttgggcctgagtcctccacatcattcagcagatggtgggtggttggagagttgagtgatgtacctgcttttcagctgccttgggctagaagtgaccgtat

SEQ ID NO: 256580 - DNA, 445 bp, Homo sapiens
tttacctctacctggtctcagtttattggattaaggttgaacacctaaaccaaagagacccaattaataagctgaagtaaagagcatcatgttctctttggacactggacaggtggatgttgatgagcttgtgtgcagcagttctactggaagtatgtacaaggggctcagccagccaatttggacggtgtatgtgataagcagagaaaggcagcagtctgcagagactgcagaatgaaaaaaaaaaaaaaaaaaaaaagcagaaacccagagagaaatcagacaaaagaccaggtggtgggcaggggtctggggattatccaagcttaaaattcagggtctctaaacttgaacaggctgatttcaaagctgtgggcctagcaatgtgttcacatagcaatttggctttgtaaaatttataaaagtaagatattttaaccacaaa

SEQ ID NO: 256581 - DNA, 1012 bp, Homo sapiens
actcttatgtttaccggaagcctccaagtacatgagctttaatgattgtagaattactagcttcataccttagagaagtaagcactacatgctaaaagagccaatagtttgtcagattatttcttgacaagttaccaggaagaacctttaatgctatgaatatgggcttataagttatgtcagatatttaatctccagtcattggcttgtattttatgatgaagaatatataacccaccctttttaattgatagcttgagttaaagtaatcttatcttttaagaaaactggcagaaaactaaaagatatattaaaagcataatcttttctggcaaggtgtgatttcatgcaaaagctaaagtgattaaaaactttttgtggacttcattaagattctcagaatactgagtttctgtttctgagtaatactgatgaaaggaagatgagcatttttccaaggacaagtatattctagacagcttttgtgaaagtaaatagttttgtctatatatctgacagtcatgacatgaccagggaagattccagatgatcatgcaattctgtacattctgtttcgtacaaatgtaattttaataaacaatttttaaaaatatcttgatagagaaaaacaaagagccgtgtctcctgttagccccattgtcagttagtgactgcaagtcagttaactgagcgaagcctgtgttcttttatttaagcaagaaaaataaatcagctgtgtatttataatgaaaaatccattcacccagcatgctctgggccatacaaattattaattgtactgaaattttatattttgttaccacgaaacatggtagtaatttaaataactggcataataaaagtatattccagcaacactatattgtaaatacattaaaatgtatcagtgtacggtatctgaagatgcatgtgtataagtaaattttccttagtttaaaagataactacctttctgttaagcactgagaggaccaaaaaaaaaaaaaaaaag

SEQ ID NO: 256582 - DNA, 454 bp, Homo sapiens
ccctcttaccccttaggaattcaaatctcctctgtgcctttgcaaagcaacatccatcttgaacataaatgaggttctggcttgatttctgggcttgggcatcagacatctcccttttgcggacacctacagctctgttcttgaattttgtgattgcggataagcacccgctccttctttttaagtcctttggcagatagtcattcatgcttacaggatgacccaggcaaagctaaacacagatctgggctccaatcccaccatggctgtgtgacctagtggaagttccttaacctctctgagcctcagctttcttttccacagattgctgattaaaacacttactttagtgttaacacaagggaaagctgggcgtggaggtctatgagaattctctatactatttttgcaactcttttgtgaatatgaaataatctaaactagaagatttaaa

SEQ ID NO: 256583 - DNA, 449 bp, Homo sapiens
ctgtgcagttctgttctcaacatctgcttagggtcagatacacacacacacacacacacacacacacacacacacacacacacagctcatgggtggtctcaggaacttgtaaacaactttaaagggtcacttttctgagttttcccttctccatcatctccctggtattttcaagttccttaaaacacccatttcagtcctctagcccaacatcttgggttttagttcccttgtttggctgcatactcaccttgactatgtccacgtctcagaaaaacagttgaggacacagagagaaaaaacagcaatggagtttgaccacctcttgagaccccagctcctccaattgcagaattaagttatctctcagggttttaagctactgcagttacttgttgccacctccaccatcactggatggggactggagtgcaagagaatgaagaaaa

SEQ ID NO: 256584 - DNA, 329 bp, Homo sapiens
ttgttgcctctttttctccatgcctttagtggcttccttaaatagcttaatctaaaatacatgtgttttggaaatattctctattccagtgcctcatttatttttccagttcaccatcctcgaaaaaattgggacctgggatgagttcaacccttcatctttgcagctacatttgggttgctcaatgctcttaggaaaacacacaatttctttcagtttcctttttccctcacagagcaatgtagcaggcataggttagaaactccctcagctctccgccaccctagttcgaaacgttacacattcacatgcatttccaactccatttc

SEQ ID NO: 256585 - DNA, 378 bp, Homo sapiens
  misc_feature (176)..(176): n is a, c, g, or t
tgaatggacttgggcagtctggtcagtgtcagcatggggcatagctaaggtgtgtgtaacatggctgaaggaataggcagatagctgtcgccttagaggtgacagtatgtaactgtgggaggtgaccagatggtcaggtgagacaggacaaagaaagtcagggcaccatagggagnggagggaccagaggagatcaagctagagttttccaaaggagtggtagccaggcaatagtgaccttgtaggtgtcaagaaggcagattggacgttgaaagaaacactgcagttgacgttaacatgatgtttacaattaatttggctttcaaatttttctccatttgaaatttttagtgtcatttgatttaaatgaaatctggt

SEQ ID NO: 256586 - DNA, 357 bp, Homo sapiens
ctagatgatttcacaggctattagacaagagaaaaggaagatcgtctgcccccttcgttttacagatgaaaagatctgcctgacccgttctggctctgcaattccatgaattatctaaaatgtctgtcattcacagatctttcccctcaaggggcccacacctttcttcttatctcccttttcttttttttttttttaacttctctaatagaagtgctacttccaaaagtagagtgttcttgtcaccagaggaatcgaacagcggctgaacagcctctctgagctgcgatggccttatctggaccgcatcccgcattccaaaggctggcaatgcaatatatacctatgtctctcaaa

SEQ ID NO: 256587 - DNA, 273 bp, Homo sapiens
ggctatgtggccgcctcagcacagctggggctgggactctgtctgtggggatagtccggcctcacggccacagcttcaggccaccatgaccctggacgtgaaggcagagtggtggcccctggcctggtgggtcctgcgagtgaggtcttcacaggcggctttggtggcacaagtggtgttaaaaaaaaaacacctggccaaagtccctcatgcagacaggagaccgaggcccaggcagcaccgagcagatgggggcactgcagaacccagcag

SEQ ID NO: 256588 - DNA, 147 bp, Homo sapiens
accctgtctccacccttcctccatctagctgcttgaaaggcagctgtgatggctggagctccttgggccgtgaggatacatccttcatctagggatggtggagtggaaagccaggttttggacaactgtggagttcctgcaacacct

SEQ ID NO: 256589 - DNA, 475 bp, Homo sapiens
agccccccaggtgtgccccaggccccagcagagtgagcagggcctgggcccatggtccccatagactccgtagctgtcagtgagattagcaggcaggccgggaggggagaccaaggacaaggacccagaatgttcccacactcagcaggccttgccagtgagccctcacacctccagccagccccaggcccaggctactgaactcacccggtgagatgctgtgggttaggagcacttcgggtgtcctggcaggttcctgcccccctggagaggctcccaggagccctctgggtgacttaagagaggacactctcctctcctactggagggaggagggtgtcctcaaggcccggggctctggattaaataagaagggagacaactcaagcgccatgtgactattgggcaaatatcacgttcatgtattatttcaaattaatatggtgacatgtttcagacatgcaaaaaaaaaaaa

SEQ ID NO: 256590 - DNA, 497 bp, Homo sapiens
aggtgctgtcaccctcaggccttgtttgattcccagaacaaacctgtgaagaacagaacctggaagcatgtcaccattttatagatgaagaagcagaagctcaaaagacagggacttgtccaagcctgtacaaccagcaagtgactcagcaacggaaagaatgcaggtttcctagttggccacactgagaatttggtgctttgacaactatacttcatctattgtaaattttccagcttcacacaatttcttttatttacaaaagtactaattattatagctaatctctccctaaggaatcacccactgagggaaaaacaagaacaccaatgtaggcacatctaatggccttatattttgttgctcacttatttcctgtatacttagttttatttgaaacttaatgttgattggatttgagaagactgttccccacaggatattttcaattgttagaaaaaaataaaataaagaacaccaccactgaacagttaaaa

SEQ ID NO: 256591 - DNA, 241 bp, Homo sapiens
agctcaaattttctttccagctggatcaacatttatttgtctggattaggtaccaccaaagttgaagtgaagtagatttcagtgtagacactgcttttgaaaacagtcttgaagtccttgattcatttatgtaatctgatttatttgtggcctaaaggctttatatttgtctttgtataatgagattgtatattataaaggtcatataattagcagaaataaaagatgtttaaaagttatt

SEQ ID NO: 256592 - DNA, 421 bp, Homo sapiens
tagtctacaaacagctattgtatattttgttcacgttaacatttctatcacctagacccatttctgacctacatcagggaatcaccattattgaccaaactgtccttttccattccagactctttaccaatgctcagggccttcaggaaacgggaaatacctccttttcaccctgtttctttacattaaaacctctacatctctgcctcttttacctgttggctattagttccaagtcctaccgctatccaccacctactcttttctgagaagttaggattaaggttccaaaaattacattttccagactcccattttcagccatctctgggtagattttgccagtaggaaatgtggacaggaggtggaagttggaagaaggattcttttctgacttccaggttgggtctccctctccatt

SEQ ID NO: 256593 - DNA, 282 bp, Homo sapiens
  misc_feature (31)..(31): n is a, c, g, or t
cgccgatgattccgaagatataacagcaggnacaggtatttcatgacaaaaatgaaggtgaatatgatgtgcgaaaatacaaagatggaagcaacaagctaaggatgctggggcagaaagatggaacctgggttactcatgacatcttgaaactgctgcagccatcctagactggctgcctctagacttaatatgtttagaaagtaaatcccaattttattaaactgttatctgttatgtatatatgaacacattcttagctaataaactatcatgtctcct

SEQ ID NO: 256594 - DNA, 670 bp, Homo sapiens
tcactggccaaagcaagtctcatggccaagctcagcgtcagtgtggggaggaactacacaagattgtgaatattgggaggtgtgacatattggtagtcatttagactagggacagaccaccttaatccaatcaagagaataattaaaagttacttccagggtatagcccagttccaacttaaaatctttcctccttaggtcctgaactcaatatttttacccacccaatcccacacccactccccttgaggcagttgaaaactctggctagtttctcagcctctctccattactgctttctgaatgttaattgcctcgaagggaaaagtggcaccaaattctggactcaaaatcttggatttaggcccctcagactgttgaagttctactgctccagaaaagagtaataacaggatggagatggagtttcatgacaaaaatgaaggtgaatatgatgtgcgaaaatacaaagatggaagcaacaagctaaggatgctggggcagaaagatggaacctgggttactcatgacatcttgaaactgctgcagccatcctagactggctgcctctagacttaatatgtttagaaagtaaatcccaattttattaaactgttatctgttatgtatatatgaacacattcttagctaataaactatcatgtctcct

SEQ ID NO: 256595 - DNA, 397 bp, Homo sapiens
acttatgggacactttcaagaaaaccaatgtacacatgtgtgtgtcccagaaggatagagaaagtcagaggcaaagagcttattaaaaacaaaacacacacacacacacacacaatggaaaacccccaaattcagagaagggaatgttcattgagcccaggagttccagatttatgaagcccaaagaaccccaaatagattaaatgtaaagagatcttcaccaagacacattataatcaaattctcaaaagtcaaagaaggagaggattttgaaagcatgaagagaaaaagcaacttgtcacatgtaaaagaacccacataagcgttcagcagcttcctcagcagaaaccttgcaggccgggagagaataggatgatatattcaaagtgctgcaagg

SEQ ID NO: 256596 - DNA, 430 bp, Homo sapiens
gttttctgtctctctatatttgctttttttggagatttcctgtaaaaggaatcatgcaatatgtgttctcctgaatggcttcttccactgaagcagctcttgaggttcacccgtgttgtagcatatatccatacttagttactttttattccctaatagaatgccattgcatgaatagacattttatttacccattcaccaattaatgtatgtttgagttgcttccactatttggctattatgaataatgctgctatgaacactcacatacaaatctttgcatatacccttttttgtatgtgatatggtttggttccctgtccccgttccaatctcatgttgaatttgtaatccccaatgttggagatggagccagatgggaggtgactgaatcatgggggtggatttccccttagtgccattcttgcaa

SEQ ID NO: 256597 - DNA, 793 bp, Homo sapiens
tacaaggtctttgtatttcaaagctcatgttgactctgttacccttgtgttacccaagtgacattagactgaaacatctagtttcacctatattacaatttgcttatttaaaaaaatttactcactctttataaataaatttattttaataaactctacatggttagcaagagaaaaatcatacatcgttttaaatatcatagcaatattactgaccacaaatggaaaggagcaatgaaaatgaagctgaattgttgggttttggttagataagaggcattttcaagggcttgagcctgaagtctgttctcactgttataaagggaaactagcaagtggtacccagaggtattagaaacatattgacacacagctgagacttttcccccctattatttaaatgaggaagaataaaagagaattcaaagggcaatgagttctcaacaggcgttagcgaccttccttttgtgcaccttctaaaaccacccccatatcactgtcaaagaactgcggctgtgtacggtgtttcttctctcaagagtgccttgaaagatcttgaagagacagacaaaatccagacaaatgccatgcagtatgaaaagtataatgtcatcatgctctccaaactttttgttcacgaactcttgtaataaatttttgaacctatgctctctacatacatttatagtcccccttttaaaatgaatatatgtgcaagggcatgccagtattttacgcatcttgtaaagcgaacaaaagtataatttttttacaataaatatttttttttccc

SEQ ID NO: 256598 - DNA, 446 bp, Homo sapiens
tgtaataaatcttcatttgagtaactctagtctcatccttcaattttgcttttgtttaattaacaacaaaattccaataccatttggattgcttcttgggcaaagggagagagccagctataacatttataatcgggggagcacttgttctgctcatcataaaagtgcattggccagatgtcacgcggcagcggagtactgaaaggaaatgtaagacgttcatcagtttcagtagatgatatacccctttgcttcatatgagtgctcagcctgtgtttgtgcaaatggagttataagagcacagggaggcttaaagggaatttctggcccgtagattcttcgtccggcctgattcatgtgcaaatgcaagactcctcaccactttgaaaatactgtatgtgttggtagtatgtccaactgtaataaatacgattctgtagttttga

SEQ ID NO: 256599 - DNA, 429 bp, Homo sapiens
ctctgggtcccctcttcggtccgggaaggagggacaggtgcgcgcagtggcgcagcctcgccttcctgccggcagtagattctccacttctccaactcccgcactgacctctcctaaggaacacccgcccctttttcttgaagttccaggcctgaggccgccctgcggcaagttcagcgttggggtcacgtcccagcggcgagcagggctgatgcctcctttcgggttgggcggcggcgcgatcttgattgaaatttggcagtgtcgagatagatatacctaatgtaaatgacaagttaatgggtgcagcacaccaacatggcacatgtatacatatgtaacaaacctgcacgttgtgcacatgtatcctagaacttaaagtattaaaaaaaaaatttggcagtatcggccaagatgttccgcagttgc

SEQ ID NO: 256600 - DNA, 455 bp, Homo sapiens
cagcctatcagctgtggaagacattttgtaagcttcaaagggccatctcttatacaataccagacacttagtagatgtcttttaaaaaccatattattccagtaaagaatgagtgaacatttgccttctggaatctgtggcattgtatctgagtgtattctgggaaagaaagcaattctgctttggagcccggtcaatctgtttcagggcacacattgccatactgcccatagatatagaatgtaacttctctgagcctcagtttactcattctctatatgaaaaataataatactgaacttaaagtaggggcttgtagcctggagtccatggatccttaagggtaccttaagatgcccttaaaattgaatataattgtctatatatatgaatttttatgagggaaagaattttagatttcatcagattcgttaactaggtcagtaacttctttt

SEQ ID NO: 256601 - DNA, 332 bp, Homo sapiens
cttagaaacctgctcgatatagaagagccgtaagttatgacagtaaagagtactacatgcgactggcctctggcaatcccgccattgtccaagacgccattgtggagagttcagaaggtgaagctgctcagcaagaaccagagcatggggaagacactattgctaaagtcaaaggtttggtcaagcctcctctaaaacgctcccgatctgcacctgatggaggagatgaggagaaccaggagcagctacaagaccagattgctgagggcagctccatagaagaggaggagaaaacagataatgctaccttactgcgcctgttagaggaagga

SEQ ID NO: 256602 - DNA, 3177 bp, Homo sapiens
accggtcccgcctcccttgacgccccgccccgcccctcctccctgctctcttagaaagagccaatcgctccgtctcattggcggccccgactcgtccagctgggtcgcgttagagtgcccgccccactcctcccagccacagccccgccccacctcccccaggccaatcagtttggttcctctcccctaagccacgcccccgctacctcgctcctcctcccacccaatcccgtcggtctctccccccgtgtccccgcccctgcgtccccgcccctcccgccccgccccccgtccaatgctgagctcagtctgcgtctcgtccttccgcgggcgccagggggccagcaagcagcagccggcgccaccgccgcagccgcccgagtccccgccgccgccaccgctgccgccgcagcagcagcagcctgcgcagcccggccccgccgcgtccccggcgggccccccggcaccccgcgggcccgggggccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccaggtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagccactggtgctcccccactgcccccccaagactggcgtaagccaggccccccaagcttcttgcccgacctcaacgccaacgccgcggcctggatatccccctagtggacgaaccccctccccccgggctcttgtcaccgcctgagacctcgcgagactttcggtcccccccgccccttccccccaggttagcaattgggaatggctgggagggggtgtccccaagacactgggcttcaaatctccccccaagccctccctcctacgatcaagacaccttttgtccagacagctcccttagcgttgcctggaaaagccacagagctccctgcgggggtgcagaaccctgcaggcagccccaggctttgcagaaaccacacacactgttgctggatcttgagtcccattagctgtgagatgcctgtgagagccttcccgcacccgtcagaagctcagagccttcttggaccctttaaagatgtccctctccccagccctccgcctcaccgccccccacccccgaccccgtccttagaatcttctggaggagcctccctccccccccaccccccccccactgctcctggagttctcatctgattccccaagggcactgccagcttcgctccactcagcccccttgcagaccccaccccctgcctgctctctttccctacaactaggtcagcccccagccccgccacggcggccgc

SEQ ID NO: 256603 - DNA, 468 bp, Homo sapiens
gagaactagtctcgattggagtttcttagagttctctgcctggatatggattcccccatcatattccatgagacagcccaacctgagtgtcttccagacctgaggtacagaaacccaagtcagcttttccattttatacccatctgtctctctctcacatactcaccaaaacctcatcctgggctccttacagcccggatacttgaaggcagcccaatgcttgcctttgtcgtagagctgcagtcatctccttattagtcccaggctcagggcccaacccgggagcagagattctatttgagttgagttgtgcagacagatcgcaaaacttcttttcactcctccctacacttcctttctcaccttgggttcttcttactcattcccagacattcagatttatttgctaattcattcattctttgtattgatttcttagggcagccaaaacaaactaccacaaacttg

SEQ ID NO: 256604 - DNA, 550 bp, Homo sapiens
acattatatagaaggtaatggtaagaatgtcatgggacacatatataggtcacaatttccatgcatcagtcactgtgttaaccacttcctaaggattatgcagttcttctcatttgaatatgtattagcttacaagtgtacaatacaagatcccattagaatcccattcaacagatgaggatattaagacagaaattttgtgatttgctcaaggcctaacagctggggtcagtgtttagaaatccatccctgtttggcctgactgtacagcaggacttctcaaccctggcactgttgacatttggggctgggtcattctttgtcctatacattgtaggatgtttcatgcaaaacatccttacttttacccactagatgctagtgggacagccaaaactatctctgtacaccgccaaatatgctctgttgggcaaaatcacctgggttgagacctgctttgtctttcattcattcattgaatactcattgactgcatggcctgtatcaggcactgtgcgtgtaccagacattgatggacaaaacagacatg

SEQ ID NO: 256605 - DNA, 953 bp, Homo sapiens
gcgggaagctagaatcacataacccacaagagtggaccctcccgctggggaagggcggggaggaccgggaacccacgagagtggaccctcctgctggggaagttcagggaggaccaggaacccacaagagtggaccctccctctggggaagttcagggaggactgggaacccacaagagtggaccctcccgctgcggaagggcagggaggaccagaggactcggggatgatgaagacgttccagctcctgacgctggcgagactcacgctgctgacacctgtcacagtgcacgggctcacacttaacttttgtgtgtttcacgttgttttcatattctggtgtaagtttgttttatttctctagaaagaagcaagggctgtgaatggtgattaaacgttccttctcaggtttgcctgtgcgtggggtagaggtggaccacgcagaccctccctgctgtgagctccgtggagggtcaatgcagatgcagggagactgtggggcccggtatccgcgacgctggacaagggggttcccgctctggaaggaggagtcaaggtctccagtggtgtcggattagaatatgaggaatccgtctgagctcattctccacaggatcccacgagggaaagcctggcttttccctgtgcagatgccaggcctctacaggttccagaaggttcctctgctcctctgagagggcagggcacttgcacagggaacaggcagccgaaggcagccacagccctactggaaccagggtttctctgcctcctgggaagaggtcagtggatgggttggggagggggacaggcggccttcctgtgggagtcaaagagcctggggcctcccctccttggaggcgaccagacaccttccctaactggaggaaattctgaaccccagacctggaaagttcaaagctgaaataaaatcgccccttgttttgcgaaaa

SEQ ID NO: 256606 - DNA, 410 bp, Homo sapiens
actctcagggccactccttccatcccttgacagcccctgctcaccctgatgtgatccatgcaggtgagagctgactcaggctctctctgccacccggaaactggcttcctgtggctcttgatggggcctgactggtttgacttggtgaggcagctgtgatttcccaatacctcctctctggggatcttcaggcacacaccatctggctctgtgaggacttaggaactatctgggtgcagagaggtggtattctcctcgctgtcatcaggctgtccttttctgggtttcccaccctcctctgtaaaatgttgttttcactaatctctatgcctagcaagagcatctagcaaacatatgtatgcaagatttgttgaaagaataaaagttgtaaagttccttccaactcctaa

SEQ ID NO: 256607 - DNA, 404 bp, Homo sapiens
ggcactttttggctaacggtgctgccattagccaaaaagtgactgccggtacataaacagattttgtgctggtggttgatggcttttatattgatcttattctcttgatgtgccactggaataaacatttaatagagtgtttggaaacatgtatctagttcaaaagaaggatctgggctgaggtataaatttagggcagtttacattgtgtagggaacaactaaattcatggaagtaaatgatgtatctgttcctaagtcaccctatctgctgagttacttgtgacaaattgtttaaacagtaaaagaatttaatatgaaaagatacacgttaagatgattctaggattaattcattcaggcatgacagcatcaccaaggacccaggttctttctatcttttaa

SEQ ID NO: 256608 - DNA, 336 bp, Homo sapiens
tagcagcacttacaatctaaggatctgacccaagtccatctgcatctctccctcttcgacagacagatggtatgtcggaaagtgttgagtgtggtaagctggagtttctattctggctctgctttgggttatacaacctctctgaacctcagtttcctcatctctataatgtgggttccagaatgcctaactctatagagctaagaccatatgctgtttatagaaatgcttattatgaaacctggcaccaaatagctccttgaaaaacataagcccctcttccttcgttccgtctttatgcctctggtccccctccctcttagagtataggatgag

SEQ ID NO: 256609 - DNA, 308 bp, Homo sapiens
gaacaaagggctcctttcttgagtgctactctgatcccatgaattcaaaaatgtttaaggaagctctatctccacaccagcacctgaggagatggagacttttagaatagaattttaaaatgttctcattgagccctccattctagaaatggctataagtaaatgaaactcggaagtgtctggagcctactgagctctacctagcaacactgtgtgttccttggcacacaagacagaaactcaaggcagacccatcacttcctcagataccatcttgtcccattttccttaagataaggtgtcctggt

SEQ ID NO: 256610 - DNA, 543 bp, Homo sapiens
cagcatagtaggatggaacttgactctgtggggtgggagtgaggactggcatgaaggtattttccttggggtgtagggagggcctcttcagtaaggggaaagtggaatagagacccaaaccaggtgagggagggagccaggctgatatctgggagaagagtatgccagacagagggaatagctgatgcaaatgatccagtgaggagtgcacttacttgggcagagcaaagcagtgtgtgggaggagtgagggaggtggtggagtgctagcagatgaggtcagaaaggcagctggggtaggtgatccaggcttttaaggggcttggattgaattctagagtaggataggaagccactgaaggatggggagtgatgtgacaggtttgtattttaaaaggaccatcctggatgccatgtgacagaggctaggagcagaagcagggatacacgttaggaggctcttacaggaagtgttgtgtgaagacgaaagcggtgatggggaggatggggcaggaacttgaacacccccatttcccatctctga

SEQ ID NO: 256611 - DNA, 538 bp, Homo sapiens
gagaaacaatgtttccagaggcatttaaaaagcatttccagtctctctgtctctctttttgtttttctttaaatcttctcccagaatgtaccatataatgacattgatgcctggttttcattttgttttttaatagaggacatggaccttgtatagtttgtggccatgaccttaacatttttgtatttccatgagtatcttgcaaggcaatttagaaaaatagagggatgggtgcagtggttcatgcctgtaatcccaggactttgggaggcagaagcaggaggattgcttgagcccaagagtttgaggccagcccgggcaacatagtgagactccattcctacaaaaaaagaaaaagccaggtatggtggtgagtgcttgtagtccaagctacttgggaggctgaggtgggaggatggcttgagcctgggaagtggaggctgcagtgagccgtgatcattgcactccagcctgggcaacagagcaagaccctgcctcaaaaaaaatagaaaccactttttatagaatttcttttgga

SEQ ID NO: 256612 - DNA, 695 bp, Homo sapiens
atgaactgataggagctacggaaagagcgtgcagcagactcccccagatcgagtcccggcttgacccctgacccccactgcatgccagctctggggaaaaacctttccaggcccaagtccaaaatagtattgtcttctgtttgtgtccccttcacttcccttcagaggaactcaccctgctgacactctgatcttagagttctggcttccggaactgtgagaaaatacatttcattgattgagctgcccagcttgtggtactttgcatggcagccccagcaaattaaaaccgagctgcttccaagagaagggccccagagaggcttggaggctccgactggggctgctgggggaacccctagtcctcctgcacactccagctttgacaacactttctcctgccacaaatattgctagagcttctatcatgtgccaggacctgttttagactctggggatttggcagagaaccaaagtccctttctcagagcttaaagctgagtgagtaaagatgggaaacaatgagtaggtaacatggctgatggtgaaatgcactgtgtggaagctgtaagggaagtggacagagacagaggccgatgctattttggtcttggttctggaaggcttttcccctaaggtgacattcagtggaagccaggcatcaatcctggtctctatttgggagactgtcttgt

SEQ ID NO: 256613 - DNA, 335 bp, Homo sapiens
tggtcaactagaatcagaatattatatctctttttaactactaaattgctgggaaagtgtttataaatactgaaaaggtatgggtggctcggcactaaactttactgtaacccaatagaggaggcagaaaggctaatactggagaatcagagtctaaggaacacacaatggaaatctgaaattatttgaagaactgcgatgtggatgagatgtagcttctatagctatatgtaagattgaagagtcagagtcacaaaagaaatataattttagttcaataaaataaaaaaatcaataattaatgtctgaaattaaatcacctttcttaaaagaga

SEQ ID NO: 256614 - DNA, 241 bp, Homo sapiens
tcgctaaactgtagacaactcctagccacagtcatttctgtatccctcagcagaggatctacaggctggtcccctaggacacaacttagtaggtgctcaagaaaagtctgcagattactgaatgctgggtgtgggtcagagcagggcagccatttctgtggcacagatcaacaaggacaggtgaaggccagggaagcaacagcaaatgaaatctccctttcctttcaccaaggagtgaatt

SEQ ID NO: 256615 - DNA, 405 bp, Homo sapiens
gtagattctctggaatttcctatgtagacagtcatgtcatctgtgaacaaagacagctttacttcttttcaaatatgtgtacattttctttttcttgtctcattgcaatagctaggactttcagtacaatgttgaacaggagtggtgagagaagacatccttgccttgtttccagttatctaggaaaaacatctagtttcttgctataaagtaggatatttgttgtaggttttttgtagatgttctttgtcaattgaggaagttctgctgtatttctagtttgctgagagctattacttgggaggctgaggcaggagaattgcttgaacccaggaagtggaggttgcggtgagctgagattgtgccattgcactccagcctgggcaacgagtgaaactctgtctc

SEQ ID NO: 256616 - DNA, 447 bp, Homo sapiens
caacagcccaacactcctttccaacgcataggcctgttttccgcagaaggcacacaactcacacatgctccgtttccattttgcaacctcacatccgtaggtttttctaacattgttatttcccacaaattgcatcttttgcggcacatgataaaacgaactaggttaagctgaaatcgtgtagccacttcccatggcctggtgaggaaatcagagtgtgttttgctttgtattctattcccacctcaaaggcaggattaaagtagcactgcttgtcacgtctcattatggaaatcggtgtggccctcacaggggcgcagtcagttcgggactaggagctgctctgaaggtgtgacctgcctgcagtccaagaccacaacctgtcatttcagagcagggaagaccagccaaatctcccagcagtcttaatcgtattcacaaaaaaaa

SEQ ID NO: 256617 - DNA, 154 bp, Homo sapiens
tctctttacaacctgttccagcctttgagagcctgtgttccaggtcaggactcagagatggaggttacagagacatggaagaactcaggaagattaataaactttgataacttttttggtattataaataaaaacattttacaattaattataa

SEQ ID NO: 256618 - DNA, 772 bp, Homo sapiens
atgaatgagggaatgccgtagcagttcaatcagctttcttcaaacaagttccctgctttgttctcttcaacttcaatccttttattcaattaaggtggatgtcaaactgtgggactgaaaacaaggtttcagtcatctgcttttcatgtctagcacctcactgaaagtgaggggtgtatgccatctattgtcccttgttcttggctgaaatggaaacagaaagagtactattttagcacccttttccatgtacttggaagtggtgcagagaagacagaaaactagtttccaaattcaagatactgcaatagaccttgaatggaacgcaaagttatatgagatattttcccaatctttcagggacttggaatctcaaactggtagaaaacatgttcacaaaacacattcacagcaaaacaggttttgaaataaaagaagtgtacaatcccacagactttcaaataggggaaaattcttttttgattgagaggattcaacagtatttaatgaaagaggtaatatgtgatatgagttttcattcaattaaaataaattctttaaaatatggatgagatgagataatgactgagaatgctttaaaataattcagtgagtgggagaaagagggtcatattatatttgaagtgaagttttctgagtgagtaatcattgaagctgtttgatgggaacggagtgttatactatattttctgtatatttgtattcacttaaaattctgtaatacataaatacaaaaatatagtaacacaat

SEQ ID NO: 256619 - DNA, 440 bp, Homo sapiens
tcaccaacaagactgtgagataaagttggcaaaaatatatttcatcaaagttaacttgaagaatagtttgggcttttttttaagactttgagaagggtgatcccttatatttgtatatagctttacattttcaaagaggttttattatattttgccaagtttgaacctcacaattactggtgaagttagaataggtaatgttgccctcattctatacaagagaaaacaaaatttagagtggacacatggcaagatatacagggttacgtggctgggaagttgctggccctaaggcctcctacttctctatctagttgtctttacactctactgaagctcaaagtttatcttgttaatgataaaataaaaagctgtagcttcatctgtcagaaacctactgtgagttagttgacccagcctctgttttaacgtgtaaatgt

SEQ ID NO: 256620 - DNA, 539 bp, Homo sapiens
  misc_feature (43)..(43): n is a, c, g, or t
  misc_feature (100)..(100): n is a, c, g, or t
  misc_feature (104)..(104): n is a, c, g, or t
  misc_feature (114)..(114): n is a, c, g, or t
cccatatctaaccttaattctggcaccttgacttcccatcaanaggacctctgttaagtccacccaccacacgccactgcagcaagcattaccatgcttnctanatgatttgcnagccatggccagttacaaagttacaaacacagcgaaaagaaaatgtcatgggtcaaaacacaaattagattaaaaaatgaatactagctagttgttttcttctttctttgttaaacaaaattatttctgctcaaccaggtgtgatttatatgacaagtcacagaacctaagccttaaaatgtatataataaatgaatatgctaggaaacattgcagaagagagatgcaatattcacttcaccaagcagttggcttccaggaaaataaataccatgtgactaaataaataatgagcaataccaatgtgatccaattccttgcattttgagtcccctatcttctaagaagtaggggaacagaacttgactaataagggtttatagattattggctacctggcttttaaatgtcagactgtgggcgtt

SEQ ID NO: 256621 - DNA, 493 bp, Homo sapiens
cgatgaacgcatcagtcagggtacctttggagatcactgacagtgacttaaacaataaggaacgttacaagaaatccagaggcagagtggccagtgagcagggtcccttgttcaacaattcaccaggggtctcagtgctgtctcccacctctctgtcgtgtcaccctcatcctcagttgttggtgatagctgcccaagtcacctgacacagctgcaggtgtcccctacagatgaggggatggccagtagaagggaacagtttacccaagcatctcctttaatcagggaggaaaaccctccgcagaacccctggggactcttcctttattcccctaggttgaggtcagggctcagacaaatcctggcaaacggggtgcagccgccacaagagtgcaggcctgccatggttcccacctgacggtgtggaagatgagctcccaagctgagggcttccatgcatggcaggggaagagtggggactgccaaaaaaaaa

SEQ ID NO: 256622 - DNA, 564 bp, Homo sapiens
tctaaggcaaatttcatttgccagtattctgtttgagctaccccacttgctgattaccagttcgtattgtactcaagattatcgcagcttccagacctggattgagattagggtttgactggtaggacaggactgaccagagactatcattctaaactttagtcaaagagtactgtgcccccaggatgggcatggagactgtggaataggaatatgggattgttggatgagggagttaaggacaatttggggcacatgagaaccaagctgatttggggatgtggatcacagtagagacagattaaactggcaagccaaggctgaaggttgggcagaagttagatggggcttataaacaggagaattccaagtatttgactagaaggtaagcccagaaggcagaatagccatggagggcatagagaggtagccagttaggagagatcaacgcaggttaacaagcgggtgagttagagccatcagcccagtaggcatttgagcattctagaagataaggagccactgggatgtattcaaccatcaagaaactcaggtttaagaaga

SEQ ID NO: 256623 - DNA, 628 bp, Homo sapiens
catagagtagcacaattaaaacaacagaaacgcttaacatttaattttctgaacatcagatataatgctacaaatgggtgggaaatgcaaacttgggaaaacaaataaattaataaggacatgaatgactgtactcaataccaaatatattattctcattttacagaggaagaaactaaaatcgagagaggttaataattgtgcccgaggctacacagctactaagcaaaccagatctatgctcaaagcccatgcaggactgtaaccacggtgcaagatcaatcctcctgcttggagaactgatccaactccacacctgtatcttcaggttggactcgcttcttcaacccatgtacatgtccagtattccttcatcattgacaaataccttcctttgactttactgattctctgactaccaccttttcaatgaaggtattttttcagtcaaccattttaacaaattcatctttgcttggtctccaattcctctccttgaagttgctcttcacatcactataaaccagcttttgatctcattgcttcttagagagttagtaaaaaaaatggatagaataatagttgcagctgttgtatatggcggtaaacaataaaaactaccatcaaa

SEQ ID NO: 256624 - DNA, 366 bp, Homo sapiens
catagagtagcacaattaaaacaacagaaacgcttaacatttaattttctgaacatcagatataatgctacaaatgggtgggaaatgcaaacttgggaaaacaaataaattaataaggacatgaatgactgtactcaataccaaatatattattctcattttacagaggaagaaactaaaatcgagagaggttaataattgtgcccgaggctacacagctactaagcaaaccagatctatgctcaaagcccatgcaggactgtaaccacggtactccacttccttcttagctttatactaagctatgccatttgccccagggctggcttaaaggccagccacattccctacacttcaccactaata

SEQ ID NO: 256625 - DNA, 320 bp, Homo sapiens
gcatgtatttatatttaaagtcaattaatttgttgttgaggactatgttattttgatttctaaccaattttaactggtgtcatgattcttttctagagtgtataaatgccttcttaggacattttttttttctgtgaagtatttttgatggacatttttttgtgtgtgagcatttaactttagttttatgaatctgagttttctaaaattcaaaatacaacggatggcctacatgtttttgaaagtaacttcaaaactctaaaatctgaagtttgtaatcttggcattaaaactcaataataaatccttttctataagca

SEQ ID NO: 256626 - DNA, 4688 bp, Homo sapiens
gggacgattattaggaactagtcagttgcaaagctcattatgatggtattactatgaagaagattattacaaatgcatgggctgtgacgataacgttgtagatgtggtcgttacccagaaggttgcctggctggcccagctcggctcgaataaggaggcttagggctgtgcctaggactccagctcatgcgccgaataataggtatagtgttccaatgtctttgtggtttgtagagaatagtcaacggtcgcgaacatctcctcggagcgcagctgggccagcggttcccacagccctggagcccaacgtgcgcagaagcgcctcttggagctcctctcccacagatctctcgtcctcttcctgggctaggccgccccaggcgcggcccctgcgactcctggcacggccccgtgctcggctgccgccctggcgcgcgccacactgtcgtccccggacgggcgcggaccggctcggccggggcgccggcggctggggaggggtcgctggccccggggccgcgcatgcgccgccaccaacttggggctgtcagtggagggcgagtgctggttctcaggggaggcgacgccttcgggccaacgggcctcgagccgaggcagcagtgggaacgactcatcctttttccagccctggggcgtggctggggtcggggtcggggtcggggccggtgggggccccgcccccgtctcctggcctgcccccttcatgggccgcgatgatggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaagggtgactattatatggttaaaaagattttggaggaaaacagttcaggtgacttgaacataaattgcgtagatgtgcttgggagaaatgctgttaccataactattgaaaacgaaaacttggatatactgcagcttcttttggactacggttgtcagaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggtttcgtcttgatatatatcgatgtttggccagtccagctctaataatgttaacagaggaggatccaattctgagagcatttgaacttagtgctgatttaaaagaactaagtcttgtggaggtggaattcaggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattgggatgatttggtcagacattaaaagactctggtatgaagggttggaagactttttagaagaatctcgtaatcaactcagttttgtcatgaattctctttatttggcaacctttgccctcaaagtggttgctcacaacaagtttcatgattttgctgatcggaaggattgggatgcattccatcctacactggtggcagaagggctttttgcatttgcaaatgttctaagttatcttcgtctcttttttatgtatacaaccagctctatcttgggtccattacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcaaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgttagtggctttttgcagaagcaaaacagattaagtagatagattttgttagcatgctgcttggttttcttacttagtgctttaaaatgtttttttttatgtttaagaggggcagttataaatggacacattgcccagaatgttttgtaaaatgaagaccagcaaatgtaggctgatctccttcacaggatacacttgaaatatagaagttatgttttaaatatctctgttttaggagttcacatatagttcagcatttattgtttaggagtataattttattttatctaaaataatagtctattttttcttttgtattttgttataatcttaagcaacaaagaaaaaaccctaatatttgaatctatttatgtctttcaatttaaattcacttcagtttttgttattgtaatatatttacttttacatggttataatcactttatatttttaatgtttttttcacttaatattttatatatacatttccatgtattgatgtagttagtccacatttaaatttttatagaattatatagtttttgaaaaatacagtcagtagatgttttattttttagctattcagttatgtttataagtttgcatagctacttctcgacatttggtttgttttaatttttttgtatcataatagtcctatttttttttcaagttggagtgaatgtttttagttttaagatagataggagacacttttttatcacatgtagtcacaacctgttttgtttttgtaaaacataggaagtctctttaatgcaatgatttgttttatatttggactaaggttcttgagcttatctcccaaggtactttccataatttaacacagcttctataaaagtgacttcatgcttacttgtggatcattcttgctgcttaagatgaaaagcattggttttttaaaattagagaataaaatatgtatttaaatttttggtgtgttcacataaagggatgtagctaaaatgttttcataggctattatatattctcgcagcatttccagttaagaggatattaggtatataattctcttcttaaccgaatgtcagatggtcttacgccacagggtgcaggtaacccttggtctgtaagcaccaccgatccagggatcattgtctaaataggttactattgtttgtttcatcttgcttttgcatttttattttttaatttccaaattttaagtgttccctctttggggcaaattcttataaaaatgtttattgtaaagttatatattttgtctacgatgggattatgcacttcccaattgggattttacatctggatttttagtcattctaaaaaacacctaattattaaaacatttatagagtgcctactgtatgcatgagttgagttgcttctgaggtacattttgaatgacagcatattgtaagaaaaaaaaaggtgaataaaatttgacattagattataaaaaaaaacccacgcgtccgccc

SEQ ID NO: 256627 - DNA, 5891 bp, Homo sapiens
gggacgattattaggaactagtcagttgcaaagctcattatgatggtattactatgaagaagattattacaaatgcatgggctgtgacgataacgttgtagatgtggtcgttacccagaaggttgcctggctggcccagctcggctcgaataaggaggcttagggctgtgcctaggactccagctcatgcgccgaataataggtatagtgttccaatgtctttgtggtttgtagagaatagtcaacggtcgcgaacatctcctcggagcgcagctgggccagcggttcccacagccctggagcccaacgtgcgcagaagcgcctcttggagctcctctcccacagatctctcgtcctcttcctgggctaggccgccccaggcgcggcccctgcgactcctggcacggccccgtgctcggctgccgccctggcgcgcgccacactgtcgtccccggacgggcgcggaccggctcggccggggcgccggcggctggggaggggtcgctggccccggggccgcgcatgcgccgccaccaacttggggctgtcagtggagggcgagtgctggttctcaggggaggcgacgccttcgggccaacgggcctcgagccgaggcagcagtgggaacgactcatcctttttccagccctggggcgtggctggggtcggggtcggggtcggggccggtgggggccccgcccccgtctcctggcctgcccccttcatgggccgcgatgatggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaagggtgactattatatggttaaaaagattttggaggaaaacagttcaggtgacttgaacataaattgcgtagatgtgcttgggagaaatgctgttaccataactattgaaaacgaaaacttggatatactgcagcttcttttggactacggttgtcagaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggtttcgtcttgatatatatcgatgtttggccagtccagctctaataatgttaacagaggaggatccaattctgagagcatttgaacttagtgctgatttaaaagaactaagtcttgtggaggtggaattcaggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattgggatgatttggtcagacattaaaagactctggtatgaagggttggaagactttttagaagaatctcgtaatcaactcagttttgtcatgaattctctttatttggcaacctttgccctcaaagtggttgctcacaacaagtttcatgattttgctgatcggaaggattgggatgcattccatcctacactggtggcagaagggctttttgcatttgcaaatgttctaagttatcttcgtctcttttttatgtatacaaccagctctatcttgggtccattacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcaaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgttagtggctttttgcagaagcaaaacagattaagtagatagattttgttagcatgctgcttggttttcttacttagtgctttaaaatgtttttttttatgtttaagaggggcagttataaatggacacattgcccagaatgttttgtaaaatgaagaccagcaaatgtaggctgatctccttcacaggatacacttgaaatatagaagttatgttttaaatatctctgttttaggagttcacatatagttcagcatttattgtttaggagtataattttattttatctaaaataatagtctattttttcttttgtattttgttataatcttaagcaacaaagaaaaaaccctaatatttgaatctatttatgtctttcaatttaaattcacttcagtttttgttattgtaatatatttacttttacatggttataatcactttatatttttaatgtttttttcacttaatattttatatatacatttccatgtattgatgtagttagtccacatttaaatttttatagaattatatagtttttgaaaaatacagtcagtagatgttttattttttagctattcagttatgtttataagtttgcatagctacttctcgacatttggtttgttttaatttttttgtatcataatagtcctatttttttttcaagttggagtgaatgtttttagttttaagatagataggagacacttttttatcacatgtagtcacaacctgttttgtttttgtaaaacataggaagtctctttaatgcaatgatttgttttatatttggactaaggttcttgagcttatctcccaaggtactttccataatttaacacagcttctataaaagtgacttcatgcttacttgtggatcattcttgctgcttaagatgaaaagcattggttttttaaaattagagaataaaatatgtatttaaatttttggtgtgttcacataaagggatgtagctaaaatgttttcataggctattatatattctcgcagcatttccagttaagaggatattaggtatataattctcttcttaaccgaatgtcagatggtcttacgccacagggtgcaggtaacccttggtctgtaagcaccaccgatccagggatcattgtctaaataggttactattgtttgtttcatctggaattccgagggtgcacaaattaccagcagcctgagggaggtcttattggaaggcttcctgcaggaggtggcatctgatccgggcctagacatgggagttggaattttccagacagggaagggcactgtgggtggaaaacaaagcacgaacaaacgtatggtgtgggaccaagcctcacatggtgcataaatgatcagaggtgaggctgaagcctaggtgtgtgtcaggggaagagctagaaaggaaggtggggcagggaagctcagtgagtgtctgctacatgtgaggcttcattctgagcaccaactctgcgcgctaatgccacgaagtggagtcatgattcttccattttccaggtgaagaaaccaaagcacggggagaattagcttgtccaagggctcatggccagtcggtggtgccactgggatttaaccagggattccagctgtggaagctgcatgctgccagctgagcactccgtctgtccaccctggcaaatgacatgctgagggctgggggcagtcatctttccagcagttgtcgaccagaaataatgataatgcatcagccaggtgggcaagaactcagactttgtggtcagacctcgctgtggcagggagcttagaaaagtcacttttcctccacagctgtgtaacatggggaaagggggatgctcagctcacctctcatggcccttgtgtggggatttcaagggtaaatgctggaaaagcactgaatatacagcacttagtagaggctttgcaagcggctgtcctcacccaaacggatccttccccaggaaagctctgcaaatggagccacttggctttttgcctgatgccatattccgttgtttaaaacggcgatcccaaacttaagagtatgaaaggggtgttttgcagacaatgcataattaaccacttctaaacacagggtgtgccaggctccctcaaagctgttaattattcttcattagtgatcttaagttaatgtaaaataatcctggagctctgccagaggctcgggcaggggaaggagcagagccgcttatttcaactagcaaacggaaagaaatcttcacggggcgcctctgcgttctgccttggttgtggggagatgcctctatagactctttagctctgcccaaaggccattgtgggaggcggcaagccctctcccaagttcccagagcccagccgacctcagggtactttggttaatgaaatagttcaggtgggaagaaaatatggaggagagtagtatacccatcgcccagcttccaaaataagctgttaatggtgtggtggactgcccctgtgggccaccccacaaatcttatccctttcctgcttccccagagctaagcctaaacagtccctcttgtttggtgtgtagatttcccatgcacatttttttaaattgctgtaggtacatagtaagtgtatatatttatggggtacgtgagatgttttgacacaggcacgcaatgtgaaatacacacttcatggagaattc

SEQ ID NO: 256628 - DNA, 4769 bp, Homo sapiens
gggacgattattaggaactagtcagttgcaaagctcattatgatggtattactatgaagaagattattacaaatgcatgggctgtgacgataacgttgtagatgtggtcgttacccagaaggttgcctggctggcccagctcggctcgaataaggaggcttagggctgtgcctaggactccagctcatgcgccgaataataggtatagtgttccaatgtctttgtggtttgtagagaatagtcaacggtcgcgaacatctcctcggagcgcagctgggccagcggttcccacagccctggagcccaacgtgcgcagaagcgcctcttggagctcctctcccacagatctctcgtcctcttcctgggctaggccgccccaggcgcggcccctgcgactcctggcacggccccgtgctcggctgccgccctggcgcgcgccacactgtcgtccccggacgggcgcggaccggctcggccggggcgccggcggctggggaggggtcgctggccccggggccgcgcatgcgccgccaccaacttggggctgtcagtggagggcgagtgctggttctcaggggaggcgacgccttcgggccaacgggcctcgagccgaggcagcagtgggaacgactcatcctttttccagccctggggcgtggctggggtcggggtcggggtcggggccggtgggggccccgcccccgtctcctggcctgcccccttcatgggccgcgatgatggcggccctgtacccgagcacggacctctcgggcgcctcctcctcctccctgccttcctctccatcctcttcctcgccgaacgaggtgatggcgctgaaggatgtgcgggaggtgaaggaggagaatacgctgaatgagaagcttttcttgctggcgtgcgacaagggtgactattatatggttaaaaagattttggaggaaaacagttcaggtgacttgaacataaattgcgtagatgtgcttgggagaaatgctgttaccataactattgaaaacgaaaacttggatatactgcagcttcttttggactacggttgtcagtctgcagatgcacttttggtggcaatcgactctgaagtagtgggagctgttgatatactacttaatcatcgaccaaaacgatcatcaagaccaactatagtaaaactaatggaacgaattcagaatcctgagtattcaacaactatggatgttgcacctgtcattttagctgctcatcgtaacaactatgaaattcttacaatgctcttaaaacaggatgtatctctacccaagccccatgcagttggctgtgaatgcacattgtgttctgcaaaaaacaaaaaggatagcctccggcattccaggtttcgtcttgatatatatcgatgtttggccagtccagctctaataatgttaacagaggaggatccaattctgagagcatttgaacttagtgctgatttaaaagaactaagtcttgtggaggtggaattcaggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattgggatgatttggtcagacattaaaagactctggtatgaagggttggaagactttttagaagaatctcgtaatcaactcagttttgtcatgaattctctttatttggcaacctttgccctcaaagtggttgctcacaacaagtttcatgattttgctgatcggaaggattgggatgcattccatcctacactggtggcagaagggctttttgcatttgcaaatgttctaagttatcttcgtctcttttttatgtatacaaccagctctatcttgggtccattacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcaaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgttagtggctttttgcagaagcaaaacagattaagtagatagattttgttagcatgctgcttggttttcttacttagtgctttaaaatgtttttttttatgtttaagaggggcagttataaatggacacattgcccagaatgttttgtaaaatgaagaccagcaaatgtaggctgatctccttcacaggatacacttgaaatatagaagttatgttttaaatatctctgttttaggagttcacatatagttcagcatttattgtttaggagtataattttattttatctaaaataatagtctattttttcttttgtattttgttataatcttaagcaacaaagaaaaaaccctaatatttgaatctatttatgtctttcaatttaaattcacttcagtttttgttattgtaatatatttacttttacatggttataatcactttatatttttaatgtttttttcacttaatattttatatatacatttccatgtattgatgtagttagtccacatttaaatttttatagaattatatagtttttgaaaaatacagtcagtagatgttttattttttagctattcagttatgtttataagtttgcatagctacttctcgacatttggtttgttttaatttttttgtatcataatagtcctatttttttttcaagttggagtgaatgtttttagttttaagatagataggagacacttttttatcacatgtagtcacaacctgttttgtttttgtaaaacataggaagtctctttaatgcaatgatttgttttatatttggactaaggttcttgagcttatctcccaaggtactttccataatttaacacagcttctataaaagtgacttcatgcttacttgtggatcattcttgctgcttaagatgaaaagcattggttttttaaaattagagaataaaatatgtatttaaatttttggtgtgttcacataaagggatgtagctaaaatgttttcataggctattatatattctcgcagcatttccagttaagaggatattaggtatataattctcttcttaaccgaatgtcagatggtcttacgccacagggtgcaggtaacccttggtctgtaagcaccaccgatccagggatcattgtctaaataggttactattgtttgtttcatcttgcttttgcatttttattttttaatttccaaattttaagtgttccctctttggggcaaattcttataaaaatgtttattgtaaagttatatattttgtctacgatgggattatgcacttcccaattgggattttacatctggatttttagtcattctaaaaaacacctaattattaaaacatttatagagtgcctactgtatgcatgagttgagttgcttctgaggtacattttgaatgacagcatattgtaagaaaaaaaaaggtgaataaaatttgacattagattataaa

SEQ ID NO: 256629 - DNA, 2965 bp, Homo sapiens
cgggatcagtcaaaaaagaaattagggcagtcccataggaggaaatgctgattttaggaattggtttagaattggtttcaaaaatcaggtgaaatactttgcctcataatgattttatgtttgtaaaatttaagaagccatgtaaatataagcatttatttctctttaagtttgagcagggtattttccttttatcccttgcaaattaggccttttcttaaatctccatatctctgcctctatctccataacaacaatgtcctctgaaaccctgatccaggttctaggaacgtgccatctaacactgatagtgttggtatgattagaatgactttttgttaggcagctggattttcgatgtttttaaaatgatctgtctcaaccagatgcaatagaagggatggcctgtggattatgtgtttgtcttcttccttttgttgctgggtcatttatatttaatattttgtttttctgataatcttaatgaacacctgtgtaatatattccacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcaaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgttagtggctttttgcagaagcaaaacagattaagtagatagattttgttagcatgctgcttggttttcttacttagtgctttaaaatgtttttttttatgtttaagaggggcagttataaatggacacattgcccagaatgttttgtaaaatgaagaccagcaaatgtaggctgatctccttcacaggatacacttgaaatatagaagttatgttttaaatatctctgttttaggagttcacatatagttcagcatttattgtttaggagtataattttattttatctaaaataatagtctattttttcttttgtattttgttataatcttaagcaacaaagaaaaaaccctaatatttgaatctatttatgtctttcaatttaaattcacttcagtttttgttattgtaatatatttacttttacatggttataatcactttatatttttaatgtttttttcacttaatattttatatatacatttccatgtattgatgtagttagtccacatttaaatttttatagaattatatagtttttgaaaaatacagtcagtagatgttttattttttagctattcagttatgtttataagtttgcatagctacttctcgacatttggtttgttttaatttttttgtatcataatagtcctatttttttttcaagttggagtgaatgtttttagttttaagatagataggagacacttttttatcacatgtagtcacaacctgttttgtttttgtaaaacataggaagtctctttaatgcaatgatttgttttatatttggactaaggttcttgagcttatctcccaaggtactttccataatttaacacagcttctataaaagtgacttcatgcttacttgtggatcattcttgctgcttaagatgaaaagcattggttttttaaaattagagaataaaatatgtatttaaatttttggtgtgttcacataaagggatgtagctaaaatgttttcataggctattatatattctcgcagcatttccagttaagaggatattaggtatataattctcttcttaaccgaatgtcagatggtcttacgccacagggtgcaggtaacccttggtctgtaagcaccaccgatccagggatcattgtctaaataggttactattgtttgtttcatcttgcttttgcatttttattttttaatttccaaattttaagtgttccctctttggggcaaattcttataaaaatgtttattgtaaagttatatattttgtctacgatgggattatgcacttcccaattgggattttacatctggatttttagtcattctaaaaaacacctaattattaaaacatttatagagtgcctactgtatgcatgagttgagttgcttctgaggtacattttgaatgacagcatattgtaagaaaaaaaaaggtgaataaaatttgacattagattataaa

SEQ ID NO: 256630 - DNA, 428 bp, Homo sapiens
cttcagattttgtgtaacactgtcagaattaaaatgttgctgagtaaaaacgtttttagtgaatatagcttaattagaagatggaaacgacgtttctgataatagaatgctgcattttataggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagaggtatgaggctttctgtaatatatttaaattattttctctacagtagtctagtggctcagggcaaaggctttggagtaactcatctgggttaagatcctagttctgcttcc

SEQ ID NO: 256631 - DNA, 302 bp, Homo sapiens
gagggtagaagagaaacaggaaaagagggtaaacatcttgaggtgatttgaaggtgggcgattacaacaaaaaatagtttaaatgctttcatgttgttgtaatcaaattttatttttaaggccaaatccttgttcatgttgaagttgttttgttgtgatataatccaatttcctattatgttctatttctaaaaatcatagtagaagtccgttctgccatattccataatatctattacactacacaataccttctgtaaaagggacattttaagggatctgggaaatggaattcatttgat

SEQ ID NO: 256632 - DNA, 1327 bp, Homo sapiens
agagattatataatgatcaaaggtttaatccatgaagaagacagcaattttaaaagtgtattcaccaaaaaataaagcttcaaaatatgtgatgtgaaaactgccagaactaaggcgggccgggctcagaccagcgctgcctcaggatgtgaagtgtaacaagagggccaggggaggtggtgggggacaacatgggcctgtgaggcctgtgggtgcccgcgttccccagctccccccgcagcccgctccacagtggtccgctccggttggttgtcacgtgcgcattcgggttccagacccaaggctgcgtgttctccaccgcttgttgtggccagtgttactgcggtgaccgccagagcagcctcgacgctatggaggagcctggtgctacccctcagccctacctggggctggtcctggaggagctacgcagagttgtggcagcactacctgagagtatgagaccagatgagaatccttatggttttccatcggaactggtggtatgtgcagctgttattggattttttgttgttctcctttttttgtggagaagttttagatcggttaggagtcggctttacgtgggaagagagcaaaaacttggtgcaacgctttctggactaattgaagaaaaatgtaaactacttgaaaagtttagccttattcaaaaagagtatgaaggctatgaagtagagtcatctttagaggatgccagctttgagaaggcggcagcagaagaagcacgaagtttggaggcaacctgtgaaaagctgaacaggtccaattctgaacttgaggatgaaatcctctgtctagaaaaagacttaaaagaagagaaatctaaacattctcaacaagatgaattgatggcggatatttcaaaaagtatacagtctctagaagatgagtcaaaatccctcaaatcacaaatagctgaagccaaaatcatctgcaagacatttaaaatgagtgaagaacgacgggctatagcaataaaagatgctttgaatgaaaattctcaacttcagacaagccataaacagctttttcagcaagaagctgaagtatggaaaggagaagtgagtgaacttaataaacagaaaataacatttgaagactccaaagtgcacgcagaacaagttctgaatgataaagaaaatcacatcaagaccctgactggacacttgccaatgatgaaagatcaggctgctgtgcttgaagaagacacaacggatgatgataacctggaattagaagtgaacagtcaatgggaaaatggtgctaacttagatgatcctctgaaaggagctttgaagaaactgat

SEQ ID NO: 256633 - DNA, 729 bp, Homo sapiens
tgaactagagagagtaacttagttggcaggcagggtagtccttgcccaaaacagtagcccagaaagtaatggatagctataatctgaaccaaaatataaacagtcttaatgaaacgtaattctaaaacaaaatgtaagacccaatattcaatactactcactaggttcagaatctagtgtaattttggacagatgctgaaatcaaacaagtggcataatctgggagaattgactaacgacataaacttggatatgacagtagcatatcttgagaagcagagttgtatctagataagtttatccaagataaggcaggaaaatgtggaacctagaactcagttctgggaaacaaagctagttatttaaaggcagaaaatcaggcaccaatcaataagtcaggatagagggctttgcccctctcatgctctaaaaacctgagacccaaaagataggtaggtaagccgttagtgtctcagaggcaaatccaggggattattagattccagtgtcatcaaggtgttgttactaggatcaattgcttgctagtcatttcagtccgtatctccatcctcttaccggcacccccaggttgctgaggactattataagccttctctattgcccttctaccaggaatttgggggaattgcttaatgttttctgtctagactgcccttaatacgaggtcaaggggaagaagcctacagatcacaggaagatcaatttctt

SEQ ID NO: 256634 - DNA, 440 bp, Homo sapiens
gcagtggagtaaggtcttgctaggaccttaattttgctttctgagataagctcccttgtcatttgtccttcatagtccctgaccttgctctttgggaattactcttggtctatgattctttgtgactgtatctaacatgggtgttagtgtactcttattggagacaccactgcattctcaccctgctttctattggtgcagatttggctcccagggatagtctttgttaggcttatggtagtatttcctagtcgagttccctccgaaatgtaggtttccattctctttttcttcctgtcagttatatgtgaaaataccacagccaaagatctcattttgtcatagttgttaagcctatgcacttattaatttactagttattttcctcagactatccacctctccctcaatttgataactgccttagtgtagtggctact

SEQ ID NO: 256635 - DNA, 190 bp, Homo sapiens
aaaataaagtctgaacttttcttccccatctcagtgatgctgaattgaccctcctcctctccaaatggagagatggcagctcctgccttgtggcacacggtagccttcaggaacctgaaaccatcactgaaaagtgcaggaggagggaaggcacccagagaatggaaggtagctctgcccttcctcaggc

SEQ ID NO: 256636 - DNA, 646 bp, Homo sapiens
gggaaactagatgtttctgccttttgaacggggtagggtggtttacctggttttatggccaggaatagtatctattatgtttgcttttaaataggcatgatgtggaaataccatcctggtttgagaggcatttgaggattttaatttatggaaagcacaacatatgcaattatatttattgaatacctagatgcagtatagatatttaaattgttaaaactttatgaaaacttgaaaaacattgttcaggttcataaatagctttagtgatgcctcccctctttaaatacctgtcacaccgtatgaatatggtgagatcagactccctaagactcttttcaggctcattttcataatgtttactttttagggcaaaacagtagctaaattaaagtaatagccagttcttactgattgagacagagtggaaagaaagacatcattgtacatcactgtcattccaaaggtacagtggaactccggatggatgaagaacttacctatcactacaacacttataaatgagaatttctcagaatttcattctagacaagttccacgcaacaccagaccaagcaattctatctatttacaatattagcctagttttctcatacaatcatcacaagcataggaagatacttca

SEQ ID NO: 256637 - DNA, 379 bp, Homo sapiens
agtgaaacttagcctcagaaaaagaattttaactgtcccttccccttctttcaggtgattatggaatccgtgatcttggaaaagtcactgcatccctcccccagcctctgccacaaccccccagcatgctgatgaacatctcttttaggtttaagaccaccagcaccctggaaaaggaaccaccatacccctcccaggtgttatgaagcaacgaaatgtactctcccttgtctgctctgccctgccttggcagttgggtcctaacttgaaatccatcttcgttgccaccctgtctgctgaagatctccgaggttgcccatgctgactactgatctccttgctacctcctggagataatggacttcacttgtccaccagg

SEQ ID NO: 256638 - DNA, 562 bp, Homo sapiens
tccattcaggttatatttaaaaagaaagtttctcttttgaatattgccacaagaataacgggcggtgggaaatctggaacagtgtcttctcagaaacaaccaccctcaaaggctacaagtgacaagacagattctgctttgaatatagctacagaaataaaggatggactacaatgtgggacagtgtcttctcagaaacaaccagccttgaaggctacaactgacgaggaagattctgtttcgaatatagccacagaaataaaggatggagaaaaatctgggacagtgtcttctcagaaacaaccagccttgaaggctacaactgacgaggaagattctgttttgaatatagccacagaaataaaggatggagaaaaatctgagacagtgtcttctcagaaacaaccagccttgaaggctacaactgacgaggaagattctgtttcgattatagccacagaaataaaggacggagaaaaatctgggacagtgtcttctcggaaaaaaccagccttgaaggctacaagtgatgagaaagattctttttcgaatataaccagag

SEQ ID NO: 256639 - DNA, 265 bp, Homo sapiens
actccaaaccccacatgtactgactcttggcttctttctccttcccaccccagtccctctcacagtcctgggggatcctctcttggtatgggaaagcctggatgaagttgaaggctggtctccctgtggaggtggtggagtttcccccaggtttgctgtggggacaggtggaggccactcctggctaaggcgctcagggaacagccacagccgtggaaagagcatacactttgtcgacgcggccgcgaatttagtagtagtaggc

SEQ ID NO: 256640 - DNA, 488 bp, Homo sapiens
taaccctgtagaataatttttgaaattctgccccccacccccaaccttttttaagtagaaatggagtcttgctatgttgtccaggctggtctcaaactcttgagctcaagcattcctctcgctttggcctcccaaagtgccgagattacaggtgtgagctaccacacctggccccattgttttacactgactttgttataagatgtcatagtgtatataattttttttaaaaaataagttttattgtgtaaagtataatgatgttataggatacgtagtaataaaaaggttattatagtgaagcaaattgacatctgtcatctcacatagttacctttttttagtggcaatagcagctaaaatcatttagcaagaattttataaatgtatgtgaattttcatattaatataatttgcactgattacacctaatttttcatgcaagggtggtgggtatttagaagaaacttagaaggtcttgttaatta

SEQ ID NO: 256641 - DNA, 383 bp, Homo sapiens
ctgggaggcagaggtggcagtgagccaagatcacaccactgcactccagcctgggtgacagagggagactccgtctcaaaaaaaaaaaaaaaagtgtggagagagcatgactatgctgataagcattttataaaaacactggcgttcaggctactgttagttacagtgctctgatttgctctaatttgactgaattacttttttgccatttaaaatcaattttacaaactttagcatgaagaaatttttactacaaaaagcggaaaaatggccaggtgcagcggctcacacctataatcccagcactttgggagatctaggcaggaagactgcttgatcccaggagtttgagactagcctagcgagatcttgtcgctcctacc

SEQ ID NO: 256642 - DNA, 330 bp, Homo sapiens
  misc_feature (39)..(39): n is a, c, g, or t
  misc_feature (54)..(54): n is a, c, g, or t
  misc_feature (267)..(267): n is a, c, g, or t
gatccccaaagagagcgaattttctggggcaaaggactntgtgggtcttatttnggtctgtgacttctagcccaatgcctggccccaattacactgtggcctatggtggcccctagctcttgctgtgggtttaattgtgggtggatgctcatagctgtgacttttcccagactcatctgtttctttcctggtgagactttgccccaagggctgctgtgagccaagcgtcttccgcagtcttccctccctgtgttttgagctgttccncagcctctcatgacagtgctgcatttatctcactgttagtcagtattctgaatctgcaatcac

SEQ ID NO: 256643 - DNA, 869 bp, Homo sapiens
ctgcaggaacgggtcggcagagtccgagagtcatcaaggacagctccagttggatgcacaagtttaactcttttactgccacttaaatcaagctatttaactgcatgttcaaaaccggttagctggttgcaagaagattctcatttctttccagaaccatctgtgatggaaggtggtcccgactttgaatgccttccgcagcatgctgggttgcccgtgacctgagcgccatctagtgaccacataaacatctttcttaccttcccaccaacacactcatgcggacacagagaaaggtgagggctcacacagcatagaaatgaagacaggtcgggggatgttaactctccatcagggggctggtggtaggcacggctgcagcgtcatgaaacacaactgtcggaaaacagtcagaaatgccacagtgtgcccccaccactgtctgcccctggattgagagatgagagacagtgccagtcagaaaactgaagacgaggttccttccataccaagagtactgacctgtgaggtgaccctctgtctgcattaccacccccaaatctctctacctgtgcaggagacagccctccttagaaactatctgaacagcaattagtgaaggggccacatcccggaacagattgttcccccagcgaggaagggaggggctggggcaggaagaggaagttcgcagtgccttcaggaaggtcgtttctgggactagtccaaagttccaacaaggaaatcagaaggcagagagcagctagatgtggaagctcagggagggtatctgggagtttactgtacaattctctacctttgcgtgtacttgaaattttctataattaaaagttgccctttaaatgttt

SEQ ID NO: 256644 - DNA, 478 bp, Homo sapiens
aacatagtgttttagaattaatggaaggatttatgtaatacttctgattgggttgagtttttttgaatttcttgctactcactaataacaagaagagggaaaaagaaatttggttttcttaagggaagggccacgttaaggtatcaaactttggtatttctataaaggaatattacagaagaattctactgaacattagtgtgccaactcagaatcaatcaaagttttataataattcttatttctgtcatagtcctcaccgtcttacaagcttagcacatcccctcaaagttcagtagtggctcctgctgaactttcacccatttaccttctttctagttaatgtgaatgggaagactgccctaaaggagttggtgtgaccactgcataagggatatgatctagggcttcccagcttttagaaaacactctttatttaataaaacacagctctttagtgttgtgtcttggttggtaa

SEQ ID NO: 256645 - DNA, 701 bp, Homo sapiens
gaggctactaagcctcagtaagaaattttgattgtacaaaccaaccaaccttcttccctagtgcaacattagagagagttctcagcaaatgacaaattgcttcttgccatggacttttggagttagatgggtctagtgcaaattagggccattaaattcctgagaatgtagaaggtccataagagtaaagtcatcacagagaaatgcaattcgctaggggagcaacggggtgggatgcacccaacaaactgtcttgtgacaaacttggaaattccagctttgcctaagttcctaggtgagaaggtagttgtctggggcttcaggagctgcgctggggttacgagttgttggctgacccaaacctaaggtgtatgttgtggggtggcaggcggggagagagagagagagggaaggagaaagtgggagggagagaggcaaagtgagtgagcattttgatggtgggcctgtggacttcttggtcaacagggaggtaactcataaggatgtcgagccaattcagacaaactctactacagattcaatcacagactgtatggaataacttccttagctcttattattaatctgaaaagttcagatagccgcctagagtaggacagtgaagccacatttttgtgaggctgaattagaccattagactgtctggcattctatgatgctctgtagacacttcccgttct

SEQ ID NO: 256646 - DNA, 467 bp, Homo sapiens
gcaatgtcaaagtgttttgtgacactcacattctgtactcttatacagaatggtaactaatggtttaggacactggtctgtggaccatactttggtagcaccagaagaccttactaacacataggcttacttttgtcccagtgtacttagttttattaatactaagtttctgctagattttgttgtcgttgttataggaaaatactttgcttataatgtttacaaagaattttaatatttttaaagaaagtggcaattttaggatttctgcaaatagagacatggactcagagaagaggaatgtaaaaatgttggagtaaaaccatattatctatccaagtcaaaaaattatacaaactaggaaatttatatcacaattactgcatatgagaatcataaatatggactagtaaaatgtaacaagtcaaacatataattactgtcaaaacaatggttaatacacaaac

SEQ ID NO: 256647 - DNA, 497 bp, Homo sapiens
cagtaacttagcatatacagctaaggaactgaattatgcagggaagaaacatactggtaggaagagactaaaagacattgaaaatagaacaaaacgatctaaatatatctcattaatttcaaaggaaagggtagataaaatgtagtggaggctatattaaagaaatattgctgacatttttccaaacctaataaaagacaccaaacttcataatcaggaatcccaccaaaatattaataggataaatgttttaaaatacacatttagggggcaggtgtggtgactcgtacctataatcccaacactttgggaggccaaggcgggcagatcacttgagcacaggagtttgagagcaactgaactacatggcgaaacccggtctctacaaaaaaacaaagtgagagatcaatggagcctgggagtttgaggctgcagtgagctatgatcccaacagtgcactgtgtgtcaccctaagtgacagaaccagactctgcgac

SEQ ID NO: 256648 - DNA, 673 bp, Homo sapiens
gctgaataaagagtttgagttgacaataattttctttactttcttttagcactttaaatatgtggtcccacttctttatggcctgtcatgtgtctgacgagaaattacagaaagtcaaatcattgttcctctataagtaatggatcatttttgtctggattattttaataatttttctttgtctttagctttcatcagcttgattatgatgtgtctggtcatggatttatttggcttcatcatgcttgaggttgcctaaatttaagtctctaagtttatgtcatttgccaaacttgataattttttagacattattttcaaaaagtttttttcagtactgcactttttctctctttggcactctgatagcatgaattttagatattttatcattgctccacaggttcctggggctgctcttagtttttaaaaatatctttttcctctgttgttctacttatataattcctattgacccattttcaagtccacttactctcatctgtcatctttattctgctcttgaccccattcagtgagaatttggtttggtttgttgttgttgctactcttttctcagctcttaaatttctaatacgttctcctgtatatcttctatttcttttgtaaaatcttctatttttacattcattgcagaagtgtttgcaattgc

SEQ ID NO: 256649 - DNA, 3964 bp, Homo sapiens
  misc_feature (193)..(193): n is a, c, g, or t
  misc_feature (299)..(299): n is a, c, g, or t
  misc_feature (310)..(310): n is a, c, g, or t
  misc_feature (674)..(674): n is a, c, g, or t
  misc_feature (677)..(677): n is a, c, g, or t
  misc_feature (764)..(764): n is a, c, g, or t
  misc_feature (1176)..(1177): n is a, c, g, or t
  misc_feature (1214)..(1214): n is a, c, g, or t
  misc_feature (1398)..(1398): n is a, c, g, or t
  misc_feature (1402)..(1402): n is a, c, g, or t
  misc_feature (1409)..(1409): n is a, c, g, or t
  misc_feature (1531)..(1531): n is a, c, g, or t
  misc_feature (1892)..(1892): n is a, c, g, or t
  misc_feature (2249)..(2249): n is a, c, g, or t
  misc_feature (2430)..(2430): n is a, c, g, or t
  misc_feature (2444)..(2447): n is a, c, g, or t
  misc_feature (2452)..(2452): n is a, c, g, or t
  misc_feature (2573)..(2573): n is a, c, g, or t
  misc_feature (2578)..(2578): n is a, c, g, or t
  misc_feature (2595)..(2595): n is a, c, g, or t
  misc_feature (2612)..(2612): n is a, c, g, or t
  misc_feature (2646)..(2646): n is a, c, g, or t
  misc_feature (2797)..(2797): n is a, c, g, or t
  misc_feature (3057)..(3057): n is a, c, g, or t
  misc_feature (3242)..(3242): n is a, c, g, or t
  misc_feature (3370)..(3370): n is a, c, g, or t
  misc_feature (3581)..(3581): n is a, c, g, or t
  misc_feature (3583)..(3583): n is a, c, g, or t
  misc_feature (3964)..(3964): n is a, c, g, or t
atgggtgccccgagcgcgtgccggacgctggtgttggctctggcggccatgctcgtggtgccgcaggcagagacccagggccctgtggagccgagctgggagaatgcagggcacaccatggatggcggtgccccgacgtcctcgcccacccggcgcgtgagctttgttccacccgtcactgtcttccccagcntgagccccctgaacccggcgcacaatgggcgggtgtgcagcacctggggtgacttccactacaagaccttcgacggcgacgtcttccgcttccctgcctttgcaantacgtgttctntgagcactgccgcgccgcctacgaggacttcaacgtccagctacgccgaggcctagtgggctccaggcctgtggtcacccgtgttgtcatcaaggcccaggggctggtgctggaggcgtccaacggctccgtcctcatcaatgggcagcgggaggagctgccttacagccgcactggcctcctggtggagcagagcggggactacatcaaggtcagcatccggctggtgctgacattcctgtggaacggagaggacagtgccctgctggagctggatcccaaatacgccaaccagacctgtggcctgtgtggggacttcaacggcctcccggccttcaacgagttctatgcccacaacgccagnctnaccccgctccagtttgggaacctgcagaagttggatgggcccacggagcagtgcccggacccgctgcccttgccggccggcaactgnacggacgaggagggcatctgccaccgcaccctgctggggccggcctttgcggagtgccacgcactggtggacagcactgcgtacctggccgcctgcgcccaggacctgtgccgctgccccacctgcccgtgtgccacctttgtggaatactcacgccagtgcgcccacgcggggggccagccgcggaactggaggtgccctgagctctgcccccggacctgccccctcaacatgcagcaccaggagtgtggctcaccctgcacggacacctgctccaacccccagcgcgcgcagctctgcgaggaccactgtgtggacggctgcttctgccccccaggcacggtgctggatgacatcacgcactctggctgcctgcccctcgggcagtgcccctgcacccacggcggccgcnnctacagcccgggcacctccttcaacaccacctgcagntcctgcacctgctccggggggctatggcagtgccaggacctgccgtgccctggcacctgctctgtgcagggcggggcccacatctccacctatgatgagaaactctacgacctgcatggtgactgcagctacgttctgtccaagaaatgtgccgacagcagcttcaccgtgctggctgagctgnggangtgcggnctgacggacaacgagaactgcctgaaagcggtgacgctcagcctggacggcggggacacggccatccgggtccaagcggacggcggcgtgttcctcaactccatctacacgcagctgccccngtcggcagccaacatcaccctgttcacaccctcgagcttcttcatcgtggtgcagacaggcctggggctgcagctgctggtgcagctggtgccactcatgcaggtgtttgtcaggctggaccccgcccaccagggccagatgtgcggcctgtgtgggaacttcaaccagaaccaggctgacgacttcacggccctcagcggggtggtggaggccacgggcgcagccttcgccaacacctggaaggcccaggctgcctgtgccaatgccaggaacagctttgaggacccctgctccctcagtgtggagaatgagaactacgcccggcactggtgctcgcgcctgaccgatccaacagtgccntctcgcgctgccactccatcatcaaccccaagcccttccactcgaactgcatgtttgacacctgcaactgtgagcggagcgaggactgcctgtgcgccgcgctgtcctcctatgtgcacgcctgtgccgccaagggcgtacagctcagcgactggagggacggcgtctgcaccaagtacatgcagaactgccccaagtcccagcgctacgcctacgtggtggatgcctgccagcccacttgccgcggcctgagtgaggccgacgtcacctgcagcgtttccttcgtgcctgtggacggctgcacctgccccgcgggcaccttcctcaatgacgcgggcgcctgtgtgcccgcccagnagtgcccctgctacgctcacggcaccgtgctggctcctggagaggtggtgcacgacgagggcgccgtgtgttcatgtacgggtgggaagctaagctgcctgggagcctctctgcagaaaagcacagggtgtgcagcccccatggtgtacctggactgcagcaacagctcggcgggcacccntggggccgagtgcnnnnggagntgccacacgctggacgtgggctgtttcagcacacactgcgtgtccggctgtgtctgtcccccggggctggtgtcggatgggagtgggggctgcattgccgaggaggactgcccctgtgtgnacaangaggccacctacaagcntggagagaccatcaggntcgactgcaacacctgcacctgcaggaaccggangtgggagtgcagccaccggctctgcctgggcacctgcgtggcctacggggatggccacttcatcacctttgatggcgatcgctacagctttgaaggcagctgcgagtacatcttggcccaggactactgtggggacaacaccacccacggnaccttccgcatcgtcaccgagaacatcccctgtgggaccaccggcaccacctgctccaaggccatcaagctcttcgtggagagctacgagctgatcctccaagaggggacctttaaggcggtggcgagagggccgggtggggacccaccctacaagatacgctacatggggatcttcctggtcatcgagacccacgggatggccgtgtcctgggaccggaagaccagcgtgttcatccgactgcaccaggactacaaggncagggtctgcggcctgtgcgggaacttcgacgacaatgccatcaatgactttgccacgcgtagccggtccgtggtgggggacgcactggagtttgggaacagctggaagctctccccctcctgcccggacgccctggcacccaaggacccctgcacggccaaccccttccgcaagtcctgggccnagaagcagtgcagcatcctccacggccccaccttcgccgcctgccgctcccaggttgactccaccaagtactacgaggcctgcgtgaacgacgcgtgtgcctgcgactcgggtggcgactgcgagtgnttctgcacggctgtggctgcctacgcccaggcctgccacgacgcgggcctgtgtgtgtcctggcggactccggacacctgccccttgttctgtgacttctacaacccacatgggggctgtgagtggcactaccagccctgcggggcaccctgcctaaaaacctgccggaaccccagtgggcactgcctggtggacctgcctggcctggaangntgctacccgaagtgcccacccagccagcccttcaatgaggaccagatgaagtgcgtggcccagtgtggctgctacgacaaggacggaaactactatgacgtcggtgcaagggtccccacagcggagaactgccagagctgtaactgcacacccagtggcatccagtgcgctcacagccttgaggcctgcacctgcacctatgaggacaggacctacagctaccaggacgtcatctacaacaccaccgatgggcttggcgcctgcttgatcgccatctgcggaagcaacggcaccatcatcaggaaggctgtggcatgtcctggaactccagccacaacgccattcaccttcaccaccgccgtcccccactccacgacaagn

SEQ ID NO: 256650 - DNA, 293 bp, Homo sapiens
  misc_feature (9)..(9): n is a, c, g, or t
accctctanagatcccctgattgccggtgctcgtactgaccgatgccgacggcccctttttccggtgcttttctgccgtgaagccgggaacgtactactcgaactgcatgtttgacacctgcaactgtgagcggagcgaggactgcctgtgcgccgcgctgtcctcctatgtgcacgcctgtgccgccaagggcgtacagctcagcgactggagggacggcgtctgcaccaagcctatgaccacttgccccaagtcaatgacgtaccactaccatgccagcaccaccaataca

SEQ ID NO: 256651 - DNA, 1399 bp, Homo sapiens
  misc_feature (447)..(448): n is a, c, g, or t
  misc_feature (485)..(485): n is a, c, g, or t
  misc_feature (669)..(669): n is a, c, g, or t
  misc_feature (673)..(673): n is a, c, g, or t
  misc_feature (680)..(680): n is a, c, g, or t
  misc_feature (802)..(802): n is a, c, g, or t
  misc_feature (1163)..(1163): n is a, c, g, or t
catggatggcaggggtgcccagcctggcccactgtgctccccaggagggcatctgccaccgcaccctgctggggccggcctttgcggagtgccacgcactggtggacagcactgcgtacctggccgcctgcgcccaggacctgtgccgctgccccacctgcccgtgtgccacctttgtggaatactcacgccagtgcgcccacgcggggggccagccgcggaactggaggtgccctgagctctgcccccggacctgccccctcaacatgcagcaccaggagtgtggctcaccctgcacggacacctgctccaacccccagcgcgcgcagctctgcgaggaccactgtgtggacggctgcttctgccccccaggcacggtgctggatgacatcacgcactctggctgcctgcccctcgggcagtgcccctgcacccacggcggccgcnnctacagcccgggcacctccttcaacaccacctgcagntcctgcacctgctccggggggctatggcagtgccaggacctgccgtgccctggcacctgctctgtgcagggcggggcccacatctccacctatgatgagaaactctacgacctgcatggtgactgcagctacgttctgtccaagaaatgtgccgacagcagcttcaccgtgctggctgagctgnggangtgcggnctgacggacaacgagaactgcctgaaagcggtgacgctcagcctggacggcggggacacggccatccgggtccaagcggacggcggcgtgttcctcaactccatctacacgcagctgccccngtcggcagccaacatcaccctgttcacaccctcgagcttcttcatcgtggtgcagacaggcctggggctgcagctgctggtgcagctggtgccactcatgcaggtgtttgtcaggctggaccccgcccaccagggccagatgtgcggcctgtgtgggaacttcaaccagaaccaggctgacgacttcacggccctcagcggggtggtggaggccacgggcgcagccttcgccaacacctggaaggcccaggctgcctgtgccaatgccaggaacagctttgaggacccctgctccctcagtgtggagaatgagaactacgcccggcactggtgctcgcgcctgaccgatccaacagtgccntctcgcgctgccactccatcatcaaccccaagcccttccactcgaactgcatgtttgacacctgcaactgtgagcggagcgaggactgcctgtgcgccgcgctgtcctcctatgtgcacgcctgtgccgccaagggcgtacagctcagcgactggagggacggcgtctgcaccaagcctatgaccacttgccccaagtcaatgacgtaccactaccatgccagcaccaccaataca

SEQ ID NO: 256652 - DNA, 269 bp, Homo sapiens
tccaagagttgtctcaggttgtaggaataggcatggcctgataatatagaaagagggaggcagagaagtaaagaggaactgccatgttgctgaggatataagtgcctttctggtgtgcattacttggtgcgtgaagccctcccatttccaggctcagagcaggtgaggttttgtactaagatgaatggaagcccgatgccttgtccccgcacacacggcaatccagtgaagcgtgccgaaagagacgcgtcttcaaagggatcctctaa

SEQ ID NO: 256653 - DNA, 2278 bp, Homo sapiens
tccaagagttgtctcaggttgtaggaataggcatggcctgataatatagaaagagggaggcagagaagtaaagaggaactgccatgttgctgaggatataagtgcctttctggtgtgcattacttggtgcgtgaagccctcccatttccaggctcagagcaggtgaggttttgtactaagatgaatggaagccccacaatactgtcgccccacaccctacacgctgcagagaggcctctgggttgcttcatgaagggatcctatttataccatctttccatttccctccaatggtaaaaacctctcttctgtctgacctgtaaagacctagaatgtccctgagcgttgactcctcattcaatccagttaacccctagtttgatgtcccagggccagcctcctccatagattcagcagcagctttgcctgggttcttaaccctccaacttggaggacctaaattaaacttggtggacaatagcaggtttttacctgctcaccaagatctgccttgacatcaattaagaagcctagtggtctatgccttccgtactgtggaactcatttgcaggtctcataagccatggaataaatggttgaaggatgtgtatttgtatgtatgtatgcatggtgtgacaggaaaggaagggagaaaggagaagccagaccctgaaggcataaattaagaagcatggtcaccgtttggctttccaagagacgcaaaacggctggcagagaggaatcagaaagttatcctaggctgggcgcggtggctcatgcctgtaatcccagcactttgggagactgaggcgggtggatcacctgaggtcaagagttcaagaccagcccgggcaacatggtgaaaccccatctctactaaaaatacaaaaattagctgggcgcggtggcgcatgcctgtaatcccagctacttgggaggccgaggcagaattgcttgaacctgggaggcggaggttgcagtaggccgagatagcaccattacactccagcctgggtgacagagcgagactccatctcaaaaaaaaaaaaaaaaaaaaagaaagaaagaaagaaagttatcctagcttctggtggagaattaggatagtcagagttgattaaagcagttttcatggtgcttcctgggaagtacagagacactcatactaaatgaccatttcccttgtttggaagcagccattttgcatctttacagtggccctccttgacccagaaagacaaaggtagccagacactctacccacaaggaccatgatgttggctaatggttgtcagggaatctagctgtgtcattggctacctactgctatggccgttttggctgatgaatgctactgatgggagggcagggagtcagactcctttatttagtgttgagtctcctgggggagcagtagcctaggacagtcacctagaaatgaacctgagctgttctgtgagttaccaggagagttagaaaaaaaaaaaaaaaagaaatgaacctgaggactcagttggtagcctttgattgattgggactacagctttgggggaactagagtgagaaaacagaaaataattttataggcaacacttggattaagggcagaatgtgtgcaggctttgggcttgggcatggacttgattcttcttccatttgattctttcttccttctgaaaaacagtagttgaggaagctaagcttgaagtcaacttcaaagggaagtgaccagagccaggcaaatatctgatgccttctgtcttattcttggctcccacagctttgtctctggcctcgggaccctgagtcagcccatccccaggtggtatgtcctggtcctcttccatgtgtacaccaggggataacaggatgaagacagggaaaagatggaggttttccctacttggggtagagaatcactgaccagttccattggcctctataatcatgaggtccacactgactccatggagaggcatagggatagcaagattggtttagcaaacataggtctctctcctttctgctccatcaaatccccagaattactttcctacacatcagatgcctctgcgcaattaccctggattaccacagccaagggctctaggtggccagtggtggcatagagacagatcagatgctccagcactcaaggttcatgagattcaaaaccgattttcttccactccaaacatacactcttttctcttgggcagctataaatagggttttgctaatagaggaagaagaaacaaaaacaaaaaacaaacccaga

SEQ ID NO: 256654 - DNA, 2225 bp, Homo sapiens
tccaagagttgtctcaggttgtaggaataggcatggcctgataatatagaaagagggaggcagagaagtaaagaggaactgccatgttgctgaggatataagtgcctttctggtgtgcattacttggtgcgtgaagccctcccatttccaggctcagagcaggtgaggttttgtactaagatgaatggaagccccacaatactgtcgccccacaccctacacgctgcagagaggcctctgggttgcttcatgaagggatcctatttataccatctttccatttccctccaatggtaaaaacctctcttctgtctgacctgtaaagacctagaatgtccctgagcgttgactcctcattcaatccagttaacccctagtttgatgtcccagggccagcctcctccatagattcagcagcagctttgcctgggttcttaaccctccaacttggaggacctaaattaaacttggtggacaatagcaggtttttacctgctcaccaagatctgccttgacatcaattaagaagcctagtggtctatgccttccgtactgtggaactcatttgcaggtctcataagccatggaataaatggttgaaggatgtgtatttgtatgtatgtatgcatggtgtgacaggaaaggaagggagaaaggagaagccagaccctgaaggcataaattaagaagcatggtcaccgtttggctttccaagagacgcaaaacggctggcagagaggaatcagaaagttatcctaggctgggcgcggtggctcatgcctgtaatcccagcactttgggagactgaggcgggtggatcacctgaggtcaagagttcaagaccagcccgggcaacatggtgaaaccccatctctactaaaaatacaaaaattagctgggcgcggtggcgcatgcctgtaatcccagctacttgggaggccgaggcagaattgcttgaacctgggaggcggaggttgcagtaggccgagatagcaccattacactccagcctgggtgacagagcgagactccatctcaaaaaaaaaaaaaaaaatcagagttgattaaagcagttttcatggtgcttcctgggaagtacagagacactcatactaaatgaccatttcccttgtttggaagcagccattttgcatctttacagtggccctccttgacccagaaagacaaaggtagccagacactctacccacaaggaccatgatgttggctaatggttgtcagggaatctagctgtgtcattggctacctactgctatggccgttttggctgatgaatgctactgatgggagggcagggagtcagactcctttatttagtgttgagtctcctgggggagcagtagcctaggacagtcacctagaaatgaacctgagctgttctgtgagttaccaggagagttagaaaaaaaaaaaaaaaagaaatgaacctgaggactcagttggtagcctttgattgattgggactacagctttgggggaactagagtgagaaaacagaaaataattttataggcaacacttggattaagggcagaatgtgtgcaggctttgggcttgggcatggacttgattcttcttccatttgattctttcttccttctgaaaaacagtagttgaggaagctaagcttgaagtcaacttcaaagggaagtgaccagagccaggcaaatatctgatgccttctgtcttattcttggctcccacagctttgtctctggcctcgggaccctgagtcagcccatccccaggtggtatgtcctggtcctcttccatgtgtacaccaggggataacaggatgaagacagggaaaagatggaggttttccctacttggggtagagaatcactgaccagttccattggcctctataatcatgaggtccacactgactccatggagaggcatagggatagcaagattggtttagcaaacataggtctctctcctttctgctccatcaaatccccagaattactttcctacacatcagatgcctctgcgcaattaccctggattaccacagccaagggctctaggtggccagtggtggcatagagacagatcagatgctccagcactcaaggttcatgagattcaaaaccgattttcttccactccaaacatacactcttttctcttgggcagctataaatagggttttgctaatagaggaagaagaaacaaaaacaaaaaacaaacccaga

SEQ ID NO: 256655 - DNA, 239 bp, Homo sapiens
actacagtgctgtagatactgaggcataattctgaggtttaaatcctagtttctatttctcaagagaagaaagaagggctgcgaacaggtagatttgaagaactgtgtatgaagagatatgggttatatcctgatattagcacctgaaaaaattattctaaacccatcaactaaagaggcaagaattcttgacttgcctaagcaggaatgtgggtttgtggagttttttctgtaattcc

SEQ ID NO: 256656 - DNA, 365 bp, Homo sapiens
ggtcttgaactcctgacctcaggtgatccgcccgcctcagcctcccaaaatgctaggattacagctgtgaaccacagtgcccggccatctcctgcattattcttaataacgcattgtggtttttttgtaaataaaaatagttttattattttgttggatcataaattaacatatctacaggcttaccatggagatggtgcgggtttagttccaggcaacctagttaaagtgaatgtcgcaataaagggaatcatgtaaattctttagtttcccactgcacatacaagttttctttatactctactgtagtttaatgtgcaatagcattatgtctttaaaaagcaacataggccaggcacggtggc

SEQ ID NO: 256657 - DNA, 445 bp, Homo sapiens
gtgttggctagggtaattgatctaaactaccattggaaaatcatactactgttccacaatggaagtaagaaagggtgtgtctggaatacaggagatatcttagcgtgtctgttactatccatgctctgtggttaaggtcaatggaaaacaccaccaccacaacctaggcaggactacaaatgacccagattcttcaagaataaaggtttttttcaccccaccagattcttttggattgacaatacacaattattgattctactgtcatgcagaatctttcagaagccaatggaagtttataggagcagcactggtgcaacaatggtgggtcacatgggaatctgttcctcttttttcacgcagcttactagggccatttcatcctactgagggctgattcctgatatgctgctttaactgtataataaattattattggtcctgc

SEQ ID NO: 256658 - DNA, 404 bp, Homo sapiens
tacgattacgcacataataaataggaatgtctcctgactctgttccaatgacaacccagatgaataagacaaaagacataacctttgtgttcacgcagttttagaattcagatacaaagacactggcatgaagatacgtgacaaatgccaactgagtatacacaagctgtacaggtcccaaaaagggaacaacctcttgaagccatgaataaaaagcctatggaacatttaaaaacccattctgtataaaacactcagttcacaaataagaaacagcatgtgaaagggctctgtaggtcataaatgttatacaaatgttacttgttaataaaagtaataacagctactacttacttagcatttgctatgggtcaggcaccatgctcaatatttcacatacattt

SEQ ID NO: 256659 - DNA, 368 bp, Homo sapiens
aggcaaggatctcctcaccttactagttgtgcgacctcaggcaggttatcctcccagagccctgttttcatcatctgtaaagtagggctggtgtaataacttgctcaattgtatgaagattaaatgataagtatgtaaagcatttgcatagtattttacactatgttcaaaatgatgggcattatcaatattaattgatgttaatattaatattcatggactaatgaacagaggacccgctgcccggttcctttatggctgttctggcacacactgagggtcagcaaattacggcctgtgtatcaaatccaggttgttggccatgtggcccatgagctaaaagtggtttttacatttgtaaatggttg

SEQ ID NO: 256660 - DNA, 448 bp, Homo sapiens
gcacgagaaaaaaaggttggaacacgaagctggtgaagaaggccagttatttatttttcctttttttcatttgagttttttaaaactcctaaatcagtcttcttctctagaattcacttttctgttttattactcatctcttcaaaatactcaagtagtccttttttctttactgagtgtatcataccctgggatcagtaggacctcacaatgctagaattcctgttagtataataaaggaaaatttctttctgaaataatcttgttttttgcttgattgattggttggctttttcatggtaagtggaaagcgtaccttttttgcatcctttgctgagataaacttatataatgatgatgagagtttgtattgcttgctactacctttatggatggaatatgttaatatctattaaaattaaaagatgtgcttatctcttaattcagt

SEQ ID NO: 256661 - DNA, 110 bp, Homo sapiens
ccctcaggggtggggctgtggcccatattcatgctcgtcaaccccagttcctgtgttctttctattctgtgaccactgtctttccagggggtggggaatgtggaggaggt

SEQ ID NO: 256662 - DNA, 425 bp, Homo sapiens
cctccccaatataaccactagccccccaacactacacacattgctaatgaccttgacaccaacgcaaatagaagctaccttccaataaagcagacacgcctacactccacctcaaccccatctatctttaaatagagatgcttttccactctgggtacatggaaacataccctacctgcaaacacacagacacacacacaaaccaaacccatggactgaatcgactgaataggcagattcttgagccaaacagacataggtgggatcttggccccaccttttccttaccataggaccagagccagtcatatcaactcacgagcctcagtttcttcatctgtaaaatggacccaataagatcttctcttacaaaataaaataaagtaaaacaaaataggaagagtataaataagctcttcgaagga

SEQ ID NO: 256663 - DNA, 365 bp, Homo sapiens
gttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaa

SEQ ID NO: 256664 - DNA, 263 bp, Homo sapiens
gatcgaatgagattaagatgtcaacgccttatataaaaatgaattactctgattatcaagtagcacaggtaacattaggactcaagcagtggaaagaggctgggctcttccatatataaaggggctaggctctcctcaactcacctgtgtggccctgggcaagtccaggtctcagttttccaaagctcctgccaactctaagactgtgatattttgtgggctatgcctctggtgcaagaattctggtgctggccgccctgatc

SEQ ID NO: 256665 - DNA, 161 bp, Homo sapiens
actagcagagagctgcttgcaattgagatctgtcaaatgaggacttctcagacagctatgaggattctttgactcctgttgttaaaacacattttgtagatttaaaatatattcatagaaccaagtcttctgagttttcatcttctaggactagctttcgc

SEQ ID NO: 256666 - DNA, 478 bp, Homo sapiens
gactttcttctgagcagtcggggccctgtcactcccccccacctaccacacagcagcatctctatttccattcaggcccaactttaaaaaaaagaacccagatgagagatctggctgtggcacactgcgatctgggatatgttccatgaaggttcaggcgccacatacacaaaatgaatagctgatactcctccttcatcagagaacttgtgaggcagaaagcggggaaagcccatctgagtccagcagagctcctctgggggacatcaggtcaggccccagtatctgggccagatgcagtactcatcaaaattgcctctcagtccaggttggaagagggaagctgcagcaccccgtggctagaaacaggagaaagatatcccctacaattctctagatgataaatctcaagagagttgttccctaaagcattagttaactaaaaaataatataaaataagcaaacatgggctctaag

SEQ ID NO: 256667 - DNA, 329 bp, Homo sapiens
ttagctgagtggagacgtgaggtgttcatttttgagaatgttcccttgtgttcttacttactctgctcaaggatgagcaagaagtggccaagtagtaaagccatggaggttgtatgtgaaaacagctggttctgtagaaccacagtcagctctagctctgaaaagcaaaaagaagtgatactttaatagcgtgttttttttttttttttttttttttgacagggtatatagcacttttggtctttagtaatgtgagactgaggggaaaatggcttgtgtgattctgggattcattggctagaggagctctgttttatgaggactctagg

SEQ ID NO: 256668 - DNA, 555 bp, Homo sapiens
caggcctgcaggagactgaggaaggggattttcagagcctagtggttgacagaatggaggagggaggagggagagggaggagctgagtttggcacccagatttctgggtggatgactaagccaatggagcccacactaagtggtgaacccaggaccaggagcaggttgtggggcaggggatgagttcaatatgggcatggtaagcttgagggactgtgcagcaagctagtggagatatccacagggcagttggctgccgctgtggtctgaatgctgtgtccctgcaaattcatatgaaatccgaacccccaaggtcattatattaggaggtgggggcctttgagaggtgattagggattagtgaatgggattagtgcccttataaaaaagagccttcagagagctccctcactactcacaccatgggaggacactgagaagatggcatctgtgaaccagaaagcaggccctcaccagacaccgaatctgccaggccttgatctcggacttcccagcctccacaactgtgagaaataaatgtttgctgtttacaca

SEQ ID NO: 256669 - DNA, 298 bp, Homo sapiens
gcagtggcgtgatctcggctcactgcaacctccacctccctggttcaagtgattctcctgcctcagcctcccaagtaggtaggattacaggtgcacaccaccatgctgggctaattttttacttttagtaaaatggggtttcgccaccttgaccaggctggtcttgaactcctgacctcaggtgatctgcccacctcggcctcccaaagtgctgggattacaggcatgagccaccatgcccagacactaaggacaatcttgagtgccaaaataagacattcataattgattggataaa

SEQ ID NO: 256670 - DNA, 518 bp, Homo sapiens
tgctttcactggaggaggatggttatgaagaaggtttccattaaatgaaatgccagttttcttgagggaattcagagggcagagcattttatgaaaattgcttattgtctttgcttatccatagtatccaggagatttgagaagaataacctcagtgtgatcctttatttcatgccttatatttcatcccaagaagctaagttttgtattatatgaggaaaatcacatgatgaaccacaaaaataaaacatggattagagtaggatcactgaaaagtttacagtaatgatacagtcatatctgcatggcaatgaccagtatttcttacagcaaagaagcccataagtttgtagatgatattctttttcaaatacattttagattgtctaaaagtttctaaatcaatggtttcattctgtttcttttcgttatttttttacaaatatcgagtgcttaccatgttataggcccaaacttgaacaatttaaaagatcagtggagatgtccttgctttctca

SEQ ID NO: 256671 - DNA, 388 bp, Homo sapiens
ggaatgactttgcatcaatcacacaggtgatgtgactcttctgttacctgctgtctgctcacaggaaggattttgacctttcacagcatatagctgatgtgactcttcttttatttcttagtttttcctgaaaaacagactgtggaatattgctgaacctagcaccaaatggatattactctttttttttcttggtcctgcccatgtaagacattgtgacgtattgctgggccctacacctagatgatgttggattgtgacatacactttagcacagctcatggttgtgatgatgacacttacgccacaaaacagccaataggagagatactgccacttgtagctagacttacagaaatgaataaactcctgagtcttctgtagtaaa

SEQ ID NO: 256672 - DNA, 729 bp, Homo sapiens
acatatcgctgctgtcccctacaagttatgtgactctcttgcctgtgctctgccaacatgggccattgtgacatgttgctgggtccaaaacctaggttctgcctgcagaagagattgtaacatgttgctgggcaccttgggcctgccctcagaaggcattatgacatattcctgggtccaacaccaaggtgatgtgcgtctcctggctggaccctgcccacagtgggcactgtgacatatctcttggcccatcagattgttcatgttatccccttccctttttttcctggtgtttgcccatgagagacattgtgatgcatttctggacctagcacctaggtgatatcttcctgggacctgtctatatgggttattgtgatacatcatgtacgtggcccagtacttacttgatgtgactctcctctcatgcctagaccctgctcacaggtgatgctactctctacttatgcctgggccttgacaaaaagagggattgggacatatccctggacgctgaacctaagaggtggaggttgccgtggtgacagagtgagacttcgccaaaacaaaacaaaaaaaacaacaacaaaaaaggcagggtttcaccgtgttagtcaggatggtctcaatctcctgacctcgtgatctgcccgccttggcctcccaaagtgctgcaattacaggcgtaagccatcgcacctggccaggttggtaactctttaaccaaga

SEQ ID NO: 256673 - DNA, 427 bp, Homo sapiens
gtgactctttagcaccagcacagcctacagataggattgtgccacactgctggacccagcacctaggtgacgtaactctattctcctgctttggtgctacccaaaaaggacattgtaacatatctcagagccttgctcccaggtgatgctactctctacttatgcctgggccttgacaaaaagagggattgggacatatccctggacgctgaacctaagaggtggaggttgccgtggtgacagagtgagacttcgccaaaacaaaacaaaaaaaacaacaacaaaaagttggattgtgacatacactttagcacagctcatggttgtgatgatgacacttacgccacaaaacagccaataggagagatactgccacttgtagctagacttacagaaatgaataaactcctgagtcttctgtagtaaa

SEQ ID NO: 256674 - DNA, 198 bp, Homo sapiens
ttccagccttggtgctgcccacagggtggattatgacatactgctaagccctgcactcgttggattgtgacatacactttagcacagctcatggttgtgatgatgacacttacgccacaaaacagccaataggagagatactgccacttgtagctagacttacagaaatgaataaactcctgagtcttctgtagtaaa

SEQ ID NO: 256675 - DNA, 434 bp, Homo sapiens
cagggagcttgaatatcaagagattgcccctggaatgactgagtccgagatcatcggccaaggtaatgctagtgcaaataagatccaagatcaagtagctggtatctgggaatcactggcaccacagcaaatgccccttaccacccacaaatctggagagactggacaccagaccacttcagggatttgtgaggaactccatcctctggctatatctgacatcagaaaacagtcaagagagcaagagaaaaatgctgcaacctcatttctaccttccagtttccaatgaagcatctcattgtcaggacctaatttgcatccagaaccttacctgcaggaaagtatcaaaatatagtttgtttatgtgttgtaaagctttccaatttctgccatactggaaggtgcactaaaatgaagaggcaatgactactgag

SEQ ID NO: 256676 - DNA, 784 bp, Homo sapiens
tctgtgtgccagagatagacccacatggccaacatgggaagaaatgggattttcacacctaagctagctaaggttgaccactaagctgtgatttctattttacttttgagagaaaaagaaaatttctcccacactttaaaaaacaactgtatttgcttaggataattttttggactcggggtaaaatgctactttacttttcactttgcctgaacaagtatctgcaagcttttctgcatctgtaactaaatggcacttccacatacaatctatgtattgttatagagaggctgaaatgccaaataaaaatgtaaacactcgggcaggctgaaaacaagctttccaacttctattcacagaacacaaacaaataaaaaggaaggacttgggtagcaaagcattagtcaacaaaagctaaaaatgaactgaaaatgctatacactagaatgtgcaataactgcctcctggaagagtacaatgaacacctctcaaggtcagtgcttttttttctctagtgcgttattataggtatttaaatggacactagtaccctttatgtaacttttaaaacacagtatcagtattctagcagttaaaaggtaacctcgttagttttctgcaaagtcaaaatttcatcatttctaataccagcaacataaaatggcagaaaaagattcaggtcctaactcaacagtgagaaatgcaaagaaaatatgtataaggagtttaaaactaagagaaacagtaaagattcagtttagacctcacataaagtcacttatgt

SEQ ID NO: 256677 - DNA, 577 bp, Homo sapiens
cttaagtgacttcacacacacacacaattgtaacgatgtgtgattattaatatctgaatataatgtaatcattacacaatggattcatgtacagaatcatcacattgcacgttttgaatatattcaatttttatatgccaattatgcctcagtgaagctggaagaatgagagtgctctcgtgcaaatttcatgacctctttacaattttcagtaaatggaaatgataaaggaacctatttcacagagttcattgaagagttaggtgaattaataaatgaaaatcacttagtacaaggccaaacacttggaaagcactcagcatacttagtagttatttttagtgaacaagattatagcgactacatctctgctatagcaatttcttctgtaacctcaaaagcttgccactcaatttgatatagtaaaatgtaaaattatgtcacttaacagtttgcagattccaacaaagctcttatgataaatatgaagcttataaacctcagccataaatttggggagaaatgctggactcacttcaaaatggatggaaactatagtttaatgcaatgactacta

SEQ ID NO: 256678 - DNA, 292 bp, Homo sapiens
tgtgtgtgtgtgtgtgtgtgtgtgtgtgtgtgtgtgattctccatccaagtgtttacttcctttctcatttcatgactttgggttattgactcctgtccctccccaacctctgccctccccagttgggtgacctgggaccaactccccaacctccacatctgtctccttattagtgaaatggagctatgacagaacccatgatgtagggatgctctaagatttaaataaagtaatccaggtaaaatgcctagtcaattgtctggcacctaataagcattcagtcagtggtag

SEQ ID NO: 256679 - DNA, 318 bp, Homo sapiens
ctagtttacagagagattgtatcatgaatgggattaaagcttgtcaaatacttttttctgcatcaaacagtataatcacgtgcctttgcttgttttgatttttaatttgtagaatacttcgatttttaaaatatggattaagccttgcattagtggaataagggaataaagtccacttagttttagtgtattactcttcttatatgttgttagatttgatttgctagtactgtattgggaatgtttgtgtctatgctcatgggggatattgttctgtacttttcctacggtaactgtctttggttttggtatcagagt

SEQ ID NO: 256680 - DNA, 400 bp, Homo sapiens
gcaatcaccagcaactgtacaaccaccagcttggcgctgctgtcccagaaacagctccagagcgctgcacacgcatcacccaccccactgccaacagccccccacaggcaggtactattattatctcccttttatggaaaatagtaactgagccagaaagggtgctgcctaaattcagcagcaagccagtgagtagcagagccaggactagacccagaggaaggctgcactctcccaggggaatgtcccctcactgaggccctaggctgaatgtgacgcaagacagaaggtaggagcctggtctggcatttggcaaaggagcccagagccacgactgtcactcaccagcatgcctcatccccattgcccttcctggcccatcagccccacacactgctcc

SEQ ID NO: 256681 - DNA, 347 bp, Homo sapiens
tctgtaatcccagcactttgggagccgaagcaggtggatcacctgaggtcaggagtttgagaccagcctggccaacatttcaaaaccccgtctctactaaaaatacaaaaattagctgagcatggtggcgggcgcctgtaatcccagctactcgggaggcctgagacaggagaatggtgtgaacccgggaggcggagcttgcagtgagccgagattgtgccactgcagcctgggcgacagagcgagactctgtctcaaaaaaaaaaaaacacaaatggaaggaaggctggggctggggttgtggggcccaccccgtgtacactccacgtggcccagctgagagctcc

SEQ ID NO: 256682 - DNA, 783 bp, Homo sapiens
tattgtcccttcacgaagatatttctgggtagacatctgggttcgtgtgtgtgtttctccctgtgtctgtgttcatgagcgacacctgggcgtgcagtggaaggagcacaggctctggactgcacacttgggtgaggcactttcagctctgaagacacagaaactcagcttgctcatctgtgaaactgacagcaattcccacctcccaagctcgttgtgcttcagtttatataaagcccctcacacaggttctgcaaagtgggcactcagttaatagtacttattacatatgagcctttcataaaatattgtgttaattataaatgtttctacttgcatcaaattatgtgagtccatggaaatgtcctaagtgtccgtcagcacataaatgaatacatgtgatatattaatataatttggcgaaaaagatgaactttttctatatgtgtgacatggctgacacttaagaaataaaacgaagtgaaataagccagacgcaaaaggacaaatgtggtatggtttcacttatatgagttacccagaataagcaactaactctataaaacaaaagtagaagagaggttacaagggggcagggcagagcctggggagttatttcttgatgggtacagaatttttgtttgaaatgatgaaaaagttttggacatcgatagtggtgatggtggcacaacattgagaatttacttaatgccactgaactttacacttaaagttaaaatgatttaacttcatgctatgtatattttaccagagtaaaaaaaa

SEQ ID NO: 256683 - DNA, 196 bp, Homo sapiens
acaactggttctggaggtggggtgaggtgggaggctctgagttgtagcattttcaggtgtccaggaagtaaatatccccaccatggccaatttcatcctgtttaagtgatgtcactgaacgttgtccccaagctttagcattctgctttacattctcattttaatcctcaagcaactctgaattagttgctgttat

SEQ ID NO: 256684 - DNA, 496 bp, Homo sapiens
actggcttcccccactttgaagtgaatcatcacatccgtattagaccctagctgttgctcaggcaaaaatgatgatttagaagaagatggagagaagaggagagttaatttaaaagcacttatatttggccgggcacatgctgggattacaggtgtgagccacgatgcccggcctgcaataagtatttctaaataagatcacattctcagctactagaatttaggatttcaacatcttttgaggaggactcaatttaacccataagaatactatgtgggccacacatggtgcttcacatctgttatcccagtatttcgggaagttgaagcaggaggatcattgctcagggcctatggggacaccgggtgcataagaccacagtgttgactggtgtggggactcacacctgtaagtttgggaacctaaggcagggcaatcgcttgagctcaggagtttgaggccagcctgggtgacatactgagatctcatttctta

SEQ ID NO: 256685 - DNA, 329 bp, Homo sapiens
atttccattttttctccatccatttcctcttctcaaaataacacatttcccctccctccctccctatctctctctctttttctttccttcccttccttccttctttccttccttcctttccctcccttccttccttcttttcttttttcttttcttctcttttctttcgtcttgctctgttgcccaggctgcagtgcagtgctgcgatctcagctcactgcaacctcagcctcccaggagaattgcttgagcctgggaggcagaggttgcagtgagccgagatcataccactgcactccagcctggatgacaagagtgaaactctgtct

SEQ ID NO: 256686 - DNA, 687 bp, Homo sapiens
ctgggcactagaaacagccctgggaaggggccacggggaattctagatctgggcagcatttcatggcccgggggatggtgtgctcttgcctaagcctagcttgctgatgccccacattcccctggccctggctcgcccacacagagaaaagactttgctggtcttagcacatactccaaacactcttaggcacacaggccaccttggcctctcagctgggtgtgtctggtctgagttgggcaactactcagcttctctggcttctgagggaacactcagggaacctcagaagggataagggacaaaagaattgtggggcataggttgtcagctggtgagaacagttcttcctttctcccccccacttccatctgagtgcctgctggtacccactgagaccccagagctccagcatgtggactcttctgagaccctgatgctcatatatgtgcatgcgtgtgagtacgtgtctgccttcaggtataggcatccaccagcatgtgaacagccagtgttacccatagggggcgtatgcagctgcatgtgctctggggcttcacacccccactcccggccccctggccccagcatgaggttatctgtttgcacagacactggttctctaattttagcatgtgttagaatcacctggagggcggttaaagcagatttctggaccccacaccc

SEQ ID NO: 256687 - DNA, 334 bp, Homo sapiens
cactgcagcctcaacctcctgggatcacataattctcccatctccctggccctgaagcctttcataatctgatcccacccagtctcacaagcctttgctctctggccactaatgtccctcctcctccccattacccacaccaaacttcctcctagaacatactgtctttgatagttctactgtttctcctactacctagaatgttctcttttccctggcgggtaacattaatcctggcactcaaaaaaaaatagcctctgttgtaaataatttttattatttaagatacaactgaggctgagtgccgtagctcagttggaagaagaaagaaaga

SEQ ID NO: 256688 - DNA, 428 bp, Homo sapiens
tgagatatgtttctcaacttttgagatctaacaacattttcacttaaaccaataatgagggcaaattaaattcatcaattattttccaggaaacagaatgagttgggaaaaggtattgggaggcattgaaccaaacagaaatacgcacatatgcttgattgcaaatgatctctgggactgttttcaacccatacagaatggtatctttcagaactgtatggatgcactatacatctttaacaacaggctaaagaactgccatccttgaaatctggattccaagggtgtgtcacagaaagtgtatcttcttaatacccacaagatccaaagctagatgaagttttccatgatagggtcaggatagctccagctgtagcccatttgggaagcctggctccagctacatgtccacagaatgcgtgcattag

SEQ ID NO: 256689 - DNA, 343 bp, Homo sapiens
  misc_feature (4)..(4): n is a, c, g, or t
gacngaagctcaggcccttcctggccccttgatctcctgcactgagctgtggtgagcacatccgggtcccgctggatgtatgtgtgggcagggggggtgccctgggttgggtcaatgatgagaaccctatattgtgttgaagagaggtgatgacttaaaattaccatgctcaatgattacgctgaggcccaacctaggtgagaaatttggaggaggatgctgggatcccgagatttccggcagggccactgtattttgggctggagccctggaggccctgaaagtatctggaggaggcccaactctgtctctgcactcctctgtgagcagcccaggctcctgt

SEQ ID NO: 256690 - DNA, 211 bp, Homo sapiens
acctgccactaaacacaattaactaccagcccaaacattaatatcttcattccagctttcttgtgactaaattcacattacttttttacttacttaactcaatggtttcttctcaatcgttctgagtctctcagctatatactttgttgctaaccaccacctctttaaaactctatcccaggtttctctaaacagtgtattcctcagtatc

SEQ ID NO: 256691 - DNA, 382 bp, Homo sapiens
agacaggtaaagaagtacgaatgttgtttatatttgttagaaaagagacaggatgaagtctcatggacacaggacacaggtaggtcaggtcctacaagggcgccatcaagaaagagttttgaaagctatatgactcaatatacttgaaaatcaatttgtttcagagattcacaaaatatcacttagcatacaaaaagaggacaaaaaagataactgaattaaaataagtacaataacccatcaaaaataaatctgcccctaaaatgcacagacaatatattaaacaagtaaaatgcttgtggtttgaatgctcctttttgtaaaatgtctctttgaaagtaacaatactagcatgctattaaatccaaaatatgtgttcaac

SEQ ID NO: 256692 - DNA, 312 bp, Homo sapiens
atgtgcatccagttttgtttttttcaatgaacaaatacaaaatcacgttaacctacctttttctcattctgtattctaatgcctttatatgaaaattttaatattttacaattggtgattaatgccctttcctgaaatttggaaaaatgtatatagaaaactataaagaagaaaaatgacctattattttaccacccagagataatggctatcaatatattttagttcctttccatttttaatgcatccatgtttttcctcaaaattatcatgctatatacacacaaatatatgatgtttactgaatattca

SEQ ID NO: 256693 - DNA, 364 bp, Homo sapiens
cagcagtaggaaatatgttaatgtaattcactacttaaccgattaaaggggaaaccctatatgataatttcattaaatgtatggggaaaaaaaagttgtccagtatgattctacacccatatttatgataaaacttttagcaaacagaacagtaggaaatcttccttaaccttctttagggtttaaaaaaaaatcccatagattacttttccctgtgatcatgctatgaggtctggtctacactcacaggcagggactgcgccttgaatatgccagtagttgcataggagtgtgaggtttccatctctgaactctaccatagtaaacaagagcctgggacatgagctgactttcaggtactgga

SEQ ID NO: 256694 - DNA, 399 bp, Homo sapiens
tggactattggaataatttccttgttccagtgtcagtacatccaattcacccatcccctccttgcttctggagtgctctttctaaatacaaataggctaatgacattttgcttttaaacttgtttagcacgctatttcacaccttcaagatgaaagtcaaattcattagattggtggataaagtccttcccaatccagtcatttcttcatctccagccacgccacactacctgccacttcttgcacagagcaatctgccttagcctcttggtcttgcactcttgtatgttcgggtacttctgcctggaatgcctctttcttattcaatcaggaaactctcataacaggtgtgtgtgtctgacattaagtgtcacctccttagcatacatcttggattta

SEQ ID NO: 256695 - DNA, 1872 bp, Homo sapiens
tccccaggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggagggggggacaccgagcgcggagagcgcggagagcgcggagggaggcgcgcgcgggagcgaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaataatcttgacacagaagagctatgtgaatatttttctcagcacttgggcgagtatgagaatgtactagcagcacttgaagacctgaatctttccatcctgaaggcaatgggcaaaacaaagaaagactaccaagaagcctccaatttggaacaattcgtaactagatttttattgaaggaaaccctgaatcagctgcagtctctccagaattccctggaatgtgccatggaaactactgaggagcaaacccgtcaagaaaggcaagggccagccaagccagaagtcctgtcgattcaatggcctggaaaacgatcaagccgccgagtccagagacacaacagcttctccccaaacagccctcagtttaatgtcagcggtccaggcttattagaagaagacaaccagtggatgacccagataaatagactccagaaattaattgatagactggaaaagaaggatctcaaactcgaaccaccagaagaagaaatattgaagggaatactaaatctcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatctcgtgcc

SEQ ID NO: 256696 - DNA, 1895 bp, Homo sapiens
tccccaggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggagggggggacaccgagcgcggagagcgcggagagcgcggagggaggcgcgcgcgggagcgaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacactacctgacggacgacgcagaccaacaactgactgactggacacacacttactccttcgacacgaccttcaaacgcacctacttttggcacgacctgggtgattacatcagtggacgaccgccccttacaccgacggctatttccaataccacacttgactaccccacttcactaccttacctacactgcttggacccagcacggaccacgaggcctacttgctggaacctaccttaacgcctacaacgagcgcctatgagcgccgacggtacttgaacgaccacttggtacgctacgacccagacaagcttttgcaccccgaacccacttggacactttccttatatccacactaccccgttggacaacggggacgaacgtggtcgaggacacacgcagccaccacacaggacaaaacgacaccttaacgcgcaacaaacggcacaacggaccccattcgccgacaaaattgatatggaggacaacaccaacgcaatgtaccggagataacgaaccattacagcgcaagttgccaagtggacacgttttcgggaaccacggaggcacacacgaagatgccgccattgtcaaacgattccgaaaccgagttgtccgaaggaaatccagttcctgttccactcaacaacaaacaaattagtccccgcacatgcgggcacacaacttggatctgcgcccccacagtgatagcacacgaaaacaagtcaacggtgggcacgggtgacaagaccgcaaaagaatacaccaccccagagattcagcaagagggtataccaagcgtgcgccccaacacaggaggagagccacccaaaggaagcccagaaatacgagaccgccacaaatagcccgcaacgggatccccccggtgggaagacacggaaccagattgcacccaacacaccacctgggtggcaccccccgctggggggaaccaaacacaccacgaggacagctccgcaacaagaacccccgtgcacaccgggaaacaatctcacgaaagaaacagcagaacacgagccgacaaaaaacaacaagcagacattatcaccagtcgcaaccaccggaagaaagaccacaccggaggcgcgcacattacaaaagagaaagaatgctacaccagatggatatcacctgacgacaggagagaacccacccatgagaggaagattaaacagattagcaagaccccaaaggacacaagggacacacaacagaccccaaaagacaggggcgacacattgcgcaaaccgccccaagagaaacgtacacaacaataaaaacacaccaatctccgcacagacccacaacacaccacccaccatgggaaaactctagcgaaacacaggatggcacacaacagacagaaccaacggaggaacaaacacgtccacacacaaacccagcacgaaacgcacaccaagacacgacaaagga

SEQ ID NO: 256697 - DNA, 1828 bp, Homo sapiens
tccccaggctatctccagccgtggccgatggccgtgccgggggcagagcccgctcccctccgcgcgttgctacgtgcggggatgacatggatccagacgccgtcaactacgggaaggaggaggcgagagttggagcgcgtgggagcgcagaggccggaggagggagggggggacaccgagcgcggagagcgcggagagcgcggagggaggcgcgcgcgggagcgaacaccctcccggatccagagcccggcggcggcgaagcagcagctgcggccgcgcccttgccagagccggtgcgtccgcctagccccgctccgcctgaggccgtcagggctcccgaggatggaagattcccaggagacatcgccgtcctccaacaactcctcggaggagctcagctctgctctgcacctgtccaagggcatgtcgatcttcctcgacatactgaggagagcagacaaaaatgatgatggaaaattatcctttgaagaattcaaagcatattttgcagatggtgttctcagtggagaagaattacacgagcttttccataccattgatacacataatactaataatcttgacacagaagagctatgtgaatatttttctcagcacttgggcgagtatgagaatgtactagcagcacttgaagacctgaatctttccatcctgaaggcaatgggcaaaacaaagaaagactaccaagaagcctccaatttggaacaattcgtaactagatttttattgaaggaaaccctgaatcagctgcagtctctccagaattccctggaatgtgccatggaaactactgaggagcaaacccgtcaagaaaggcaagggccagccaagccagaagtcctgtcgattcaatggcctggaaaacgatcaagccgccgagtccagagacacaacagcttctccccaaacagccctcagtttaatgtcagcggtccaggcttattagaagaagacaaccagtggatgacccagataaatagactccagaaattaattgatagactggaaaagaaggctaaatctcacatcatgcttgtgcagcggcagatgtctgtgatagaagaggacctggaagaattccagctcgctctgaaacactacgtggagagtgcttcctcccaaagtggatgcttgcgtatttctatacagaagctttcaaatgaatctcgctacatgatctatgagttctgggagaatagtagtgtatggaatagccaccttcagacaaattatagcaagacattccaaagaagtaatgtggatttcttggaaactccagaactcacatctacaatgctagttcctgcttcgtggtggatcctgaacaactagatgttcctagacattttctttatggttccaagtgcaaaacaggtgttcttatctaaaacgtcaattagaaaattatctgcggttgttaatctactgtatatttttgtttggtatatttactaagtgcactctttcaaaacttattctataactttatcaattcatgtgaattttagctcaattttcaaagttcactaatattctcaatatttaatgctaaatgctttgctacattgtaactcacctaaaaccttttagtgacaaaatcctaatatgtggaaaaaagcatatgcataaaggaataatattgtgaaaatgaatctgttatgataaagaaaaaataaagtggaaacttttagagtattacttcatagggcagattttgtaaactgtcgtatactgtaaagggttaaatcagcgttttgtgatttttaagtaactgtgagtgaagtttattcttcaacaatctcgtgcc

SEQ ID NO: 256698 - DNA, 3681 bp, Homo sapiens
ggaagccagacagctggctcgagcctctcctgctcagcaccatggctaagacccctagtgaccatctgctgtccaccctggaggagctggtgccctatgacttcgagaagttcaagttcaagctgcagaacaccagtgtgcagaaggagcactccaggatcccccggagccagatccagagagccaggccggtgaagatggccactctgctggtcacctactatggggaagagtacgccgtgcagctcaccctgcaggtcctgcgggccatcaaccagcgcctgctggccgaggagctccacagggcagccattcaggaatattccacacaagaaaacggcacagatgattccgcagcgtccagctccctgggggagaacaagcccaggagcctgaagactccagaccaccccgaggggaacgaggggaacggccctcggccgtacgggggcggagctgccagcctgcggtgcagccagcccgaggccgggagggggctgtcgaggaagcccctgagcaaacgcagagagaaggcctcggagggcctggacgcgcagggcaagcctcggacccggagcccggccctgccgggcgggagaagccccggcccctgcagggcgctagaggggggccaggccgaggtccggctgcgcagaaacgccagctccgcggggaggctgcaggggctggcggggggcgccccggggcagaaggagtgcaggcccttcgaagtgtacctgccctcgggaaagatgcgacctagaagccttgaggtcaccatttctacaggggagaaggcgcccgcaaatccagaaattctcctgactctagaggaaaagacagctgcgaatctggactcggcaacagaaccccgggcaaggcccactccggatggaggggcatctgcggacctgaaggaaggccctggaaatccagaacattcggtcaccggaaggccaccagacacggctgcgagtccccgctgccacgcccaggaaggagacccagttgacggtacctgtgtgcgtgattcctgcagcttccccgaggcagtttctgggcacccccaggcctcaggcagccgctcacctggctgcccccggtgccaggactcccatgaaaggaagagcccgggaagcctaagcccccagcccctgccacagtgtaagcgccacctgaagcaggtccagctgctcttctgtgaggatcacgatgagcccatctgcctcatctgcagtctgagtcaggagcaccaaggccaccgggtgcgccccattgaggaggtcgccctggaacacaagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagggctaagacagtgcctgtccctgaaaagtggaccactcctcaagagataaaacaaaagatccaactcctccaccagaagtcagagtttgtggagaagagcacaaagtacttctcagaaaccctgcgttcagaaatggaaatgttcaatgttccagagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcactgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgcctggccatgattcttaagagaattgactgggcctcatgaataaaaaaattagaaaatctggtcatttgcatttgtcactcaatcactgtggaatcccatttcccgactgcatttcaggaagcagatgggactactgtatggaaaaacatttggcatgtattccaagtgtcagattattctgtcttggtttgtatgggaaaatctgcgggttgtggaatattaggttctacttcacac

SEQ ID NO: 256699 - DNA, 2269 bp, Homo sapiens
gccaaattcaagcttttcaacaagtgctgtttttccagaagaaaattcagaagcagctggagcatctgaagaagctgagaaaatcaggggaggagcagcgatcctatggggaggagaaggcagtgagctttctgaaacaaactgaagcgctgaagcagcgggtgcagaggaagctggagcaggtgtactacttcctggagcagcaagagcatttctttgtggcctcactggaggacgtgggccagatggttgggcagatcaggaaggcatatgacacccgcgtatcccaggacatcgccctgctcgatgcgctgattggggaactggaggccaaggagtgccagtcagaatgggaacttctgcaggacattggagacatcttgcacagttccagagctgattggcgctcaggcacatgctgttaatgtgattctggatgcagaaaccgcttaccccaacctcatcttctctgatgatctgaagagtgttagacttggaaacaagtgggagaggctgcctgatggcccgcaaagatttgacagctgtatcattgttctgggctctccgagtttcctctctggccgccgttactgggaggtggaggttggagacaagacagcatggatcctgggagcctgcaagacatccataagcaggaaagggaacatgactctgtcgccagagaatggctactgggtggtgataatgatgaaggaaaatgagtaccaggcgtccagcgttcccccgacccgcctgctaataaaggagcctcccaagcgtgtgggcatcttcgtggactacagagttggaagcatctccttttacaatgtgacagccagatcccacatctatacattcgccagctgctctttctctgggccccttcaacctatcttcagccctgggacacgtgatggagggaagaacacagctcctctgactatctgtccagtgggtggtcaggggcctgactgaatgcccaacactgcatctctcttcctgcttctggccttgtatcttgcattcacactcaatagtcacggaatgccgactaggtgctagctgctatgggaaatgcaaaaataacaaaatagttactgtgcccacggagcctacccgattatagcagaggtaagttaggaacgaacatgttagtcaatccgggtgaagacatgtactgatgacacaccatggatttcagaggaggaagtacggagtcgttgcataatccgcccctggtgggtggcactctcaggtgctcctgaacagaagatttggccctcattttccctcagaaccccacggcaaggatatatgtccccttgttctctctgcttctgtcttgaggatatgggaagcctagagaaacgcaagcagactggattgggatagaagtatttgtgtacctggattaatgaactatgattttttttttttttttttgagaccaaatcttgctctgtggcccaggctggagtgcagtggcacgatctcagctcactgcaacctccacctcccaggttcaagcgattctcctgcctcagcctcctgagcagctgggattacaggtgcgtgccaccacaccaggctggttttcttgtatttttagtagagacgggggtttcaccatgttagccaggctggtctcgaactcctgacctcaggtgatccacccgcctcagcctcccaaagtgctgggattacaggcatgagccactgtgcccggcctatgattcttttttttttttttttttgagacaaagttttgctcttgtcacccaggctggagtgcagtggtgcaatcttggctcactgcaacctccgcctcccaggttcaagagattctcctgcctcagcctccgaagtagctgggattacaggcgcccgccaccatgcccggctaattttttgcatttttagtagacatgaggtttcatcatgttggccaggccggtctcaaactcctgacctcaggtgatgcacccacctcagcctcccaaagtgcagggattacaggcatgagccaccatgcctggccatgattcttaagagaattgactgggcctcatgaataaaaaaattagaaaatctggtcatttgcatttgtcactcaatcactgtggaatcccatttcccgactgcatttcaggaagcagatgggactactgtatggaaaaacatttggcatgtattccaagtgtcagattattctgtcttggtttgtatgggaaaatctgcgggttgtggaatattaggttctacttcacac

SEQ ID NO: 256700 - DNA, 344 bp, Homo sapiens
gttggctaggctggtcttgaactcctgacctcaagcaatccgcctgccttggcctcccaaagtgctgggattacaggtgtgagccactgcacccggctggaataaagtctttttgaaatgcgtccaataggacttaaaacaaagggactttttaaattttcttcctagcactagaatttctattatcttttgtcctctgtactaaagctccagtgccattcctttgctttgaaaattaagtactgcagtactatctcctggccacttgtgggtccttgttagactaccgactcttctgttcatttttattcatccccttactgtttctgttttaaaccctggcc

SEQ ID NO: 256701 - DNA, 341 bp, Homo sapiens
gttggctaggctggtcttgaactcctgacctcaagcaatccgcctgccttggcctcccaaagtgctgggattacaggtgtgagccactgcacccggctggaataaagtctttttgaaatgcgtccaataggacttaaaacaaagggactttttaaattttcttcctagcactagaatttctattatcttttgtcctctgtactaaagctccagtgccattcctttgctttgaaaattaagtactgcagtactatctcctggccacttgtgggtccttgttagactaccgactcttctgttcatctaaaacgtgaaagtcacagatatcccaggtagaggaa

SEQ ID NO: 256702 - DNA, 527 bp, Homo sapiens
atcttggggttctgatcaagtcacaaaagggcaaaaagcacacactccagcctgggtgaatgcacagagaactgtccacaaggaaagattaaataattactgttaaatagctcatcaaagctttgggggtgggggtaaaaagttaagcttctttaaggagagtcctgctgcaaacaagaaatgcaagcttctcctgaaagcttttggattggggtgagtagggaggggttaggatagaggtcagggcctggggagttagagctgcaggttggggagacagccggagagccacggtaagaacaggaggaggattttctggattcggggtggtggagtagctggagctgacataggcccctgccctttggatattaccgtggtcctgccagtgacctcccccaacagggccataccccaaggtttcaagtcctttgtaagagtcaggcaagtcgatcccaaatgatacaacacagcaaagcagcattggctccccaggcatcatgaccagacccagaggaggtcgacgc

SEQ ID NO: 256703 - DNA, 175 bp, Homo sapiens
ggcccccctttccccacatccctcctgcctcccccaggcggacagacccctcggcctccacagccgctcagcggctgccctggggaaagccttccatggccttcgtcctggtgagcccttatttgtcaaataaatatttgcccagggtggggcttgccactcagggtcaggcatt

SEQ ID NO: 256704 - DNA, 331 bp, Homo sapiens
cttcttttaaatattcaaaatttgaaggggtttaggcctcttattaaggcctgtttcatggcagaatgtacttagtccttgcttaatgttgcacatcttgcctttgcttccactttgcaagagttttgagggtggtaaagagtgtgtgtctgaaatttgttttttacagctttagatacgtggtgaaaattttgttccataaaatagaagctttggtctgatttcatattaagaggaattttccagtgaaaaaatgtattcctgaagcattaaaagaaaaaatcagtaatagcactatcctcctattgcagaggaaagccttgggccatcc

SEQ ID NO: 256705 - DNA, 614 bp, Homo sapiens
gtgagactctgtctcaaaaaaagaaaaaaaaaaaaattagccaggcgtggtggcatgtgcctgtaatcccagctacttgggaggctgacaaaggagaatcacttgaacccaggaggcagagattgcagtgagccaagatggcgccaccgcactccagcctgggcaacaagagtgaaactccatctcaaaaaataaataaataaataaataaataaataaataaataaatatagcaccactgccattgctgccatttccatgtcttcctcctgggcccagccctgccttgcactcctatgccctttatttttctccatagctcttctcaccattccataccacacattgttaattgtctttcacatgagggcactgacttgctctgttttgttcaaagctgtattctcagtgtcttgaacatgtcttgcacctaataaatgcttagcaagtatctgttgagtgaattagaatttaacagctatatgataaggaaaaaggagttactttccccattctcacttaactctccaaccccactcttccgcccccacatgccaaaaccaagcttatgtcaagaaattaagcttggcaagcatctgcctgggggtttacat

SEQ ID NO: 256706 - DNA, 389 bp, Homo sapiens
gctccgggttatcaagggctggaattcaggggctttctcaaagtcaggagctgagtggagacttgtccccagggccagggccaccttcagtaggaaggatggtctcagtgctgtcttctggggataagggggacagctgtggcccagtggctggcaggtgtgttcctctgtccttggccccagtagaggagcacgggccctgagggttgccattggttttccccgtgctgctggcactaagcctcatagatgtgagggcccaacaaacagattgcagtcctgctgagcgtttgtcagcgagggctcaggcccctcggaacacatccctaactccttgtctttcctggcagctgtgagagaaacgtgcattttacccaaggtagaaatac

SEQ ID NO: 256707 - DNA, 603 bp, Homo sapiens
tagggggaaaaacaaccacagacaaaccatacttccctgagaagcaggagcatagtgctggctagtgaattgctttcacaaaccgacctcataactctgtgccttagaaaaattagaaatgggaacatttggagatcacttgggaaaacttgaaattatgaatgttaatctgtgattgctaagggaacgtggtatttcctgcctattttgtctgtagtttgtctctttctcttctaattcatttttaaaactctgctagattaattttgctaaaataacgttttgcactcctcatttcctgtttaaaaacatgtagtgactcaccatcagttttagaaatcgatttaaaggacttcatgaaactggtttcaggccacccacagtttggcccatacctatctcctgttctccttcataaacctttcaaatctagccaaattgctttgttctttgtccctggagtatggctttctctttcttctttctttcttttttttttgagacacagtttcgcttgaacccaggaggtggaggttgcagtgagccgagattgcaccactgcactccagcttgggtgacagagtgagactccatcacaaaaaa

SEQ ID NO: 256708 - DNA, 389 bp, Homo sapiens
ccaaggcgagaggatcgcttgaactcaggagtttaagacctgcctgggcaacataatgaaaccctgtctcttaaaaagaaatctgtgagaatccagttaagttccttttacagataccatccaggggcctgacttatttatctatctattcctttagggttggggatttgttttgtttttacccttaaagccttaatgtggaaaagtgcctgaagtgctgattgtagggaatgaaacttgattcaaggtttaaacaccttatcccagccactcgggaggctgaggcaggagaatggcgtgaacccgggaggcggagcttgcagtgagccgagattgcgccactgcactccagcctgggcaacagaacgagactccgtctcaaaaaaaaa

SEQ ID NO: 256709 - DNA, 621 bp, Homo sapiens
ataacccatctagcctctgttacatacatttctctagtttcacagcaagaattagtcctcaggaaaaaaaaaaaagtatacatgtaacaaaatatcacagggtaccctgtaaatatgtatgtgtcaactaaaaataacaacaatactattaaaatcttgttgctggaagatatttaaggagccctcagagtcagaggcttagcaccaattcagcctcattctgtccaactctcaccttctaagccattcctagtatctagactctttctttattcctagtaatctaacctctctctcttgaaactcacttcccagaaatcagatgctttgccatttactgtacaaggtaacaaagtttctctaggaacaagacactcaccgtaaacctccggcctattttcccagggcctaaaaatactggccctgaaacttgtttctactttataatgtgggctgctatccattaggtcaactctgccattttgccaacatgctgaaatggccgtcttgcacgcatggctggatctcctacacgccaaataccatcatctacttattgcctgtttccatattcccctaacattcaacctgcctgtccacatttcttcctcagacccacta

SEQ ID NO: 256710 - DNA, 435 bp, Homo sapiens
gtacatctggaactagaaccagggcctccggtacgcaccttgtgtatttaaggggtaggcagcatcgtgggcttcttggatgcctgggccaatcctaagagaggactgcacacacagaatttagggtccacacaggcaaccgcctgagcatggtttctgcacaccatgatttcctgctgctcctctggtaccaggggagtattcatcccttgaaacctacccctggtattagagctcctcacctttgtcctgccacttgaatgtatcccttcccagtgttagttgcaatgcagtatgcagcatctgccgtgaaactaaacaaccgtttaaaaactgttcggcagcaatggaattacaaattgtatatccagtttgggtaattttaaaaaatttaataaattatttcatttttattattgtgagaccccaggtctc

SEQ ID NO: 256711 - DNA, 456 bp, Homo sapiens
ccttttctaagaaacactccatccaatgcatggttgtagccagagcagtcatgaagatagaaaggcatgaagaaaaactgagccctggccatagctgtgtgcaccagattgggcacctgacttgagctttaccaatcaaagccttttcccaggagtatgcaattgagagagagattggcctttgtctgagtgactgaactataagtgaggaataacattggcaactatggttagtaagatttcaccagtagaagggaagtgctcatcttcagagaaagagaaaagtgaaaagacacaaggagaggagcacagggaaagaagagggaagatccggatagtacctgtatcctcaatcttgttcatgtctgatgtccaactgtaatcctgtcctcagttccttgtacaacctccccgccaataaacttataataaattctcctctttgcctaacctaat

SEQ ID NO: 256712 - DNA, 328 bp, Homo sapiens
tagtagcaatgggatttcaccatgttggccaggctggtcttgaacgcctggcctcaagtggtctgttcatcttggcctcccaaagtgctggcattacaggcgtgagccacaatgctcgactttcttttttttaaagcttctcttatattcttatcaggggaatatgtgcagatagtataaagagccaaatagtattaaaagaaaggaaaataagcagcctcctagtcctttcctcctccctctctgtctcctgtcctcggaggcagccattgtcaactccttgtttcttgttgtatttaccagcattaaaaagacaatgtttccagtc

SEQ ID NO: 256713 - DNA, 322 bp, Homo sapiens
atctctttgtatacacattgcaaaagaaaaataaaatctcaggaccccgaattcaccaagctaaagggaaagttaagcttaacaaccaagttacgcaaaagaaaagctgccttcttttctttcccagataaagtaatttacgtgcttatttatcgcaggtaaaatgcagatttactgtgcggagaaggcgtatgtgactctgccccactcccttcttttcacatgtaaaatgtagattcactgaatggtactaaaagcctcacaaaaatgtgaccactggcctcattgcctactccacctccttttcttcccctcttcccct

SEQ ID NO: 256714 - DNA, 589 bp, Homo sapiens
tagttcaaccactgtggaaagaagtctggtgatttttcaaataatttaaaacacaagtactatttgacctaacgattccattattgggtatatacctaaaagaaaataaatcagtttaccataaaggcacaggcacatgtttgttacctcccacagggtctgtcccacaacacgtggtgactatgggagctataattcaagacaagatttggctggggacacagacaaagcatatcattccaccactggcccctcccaaatcttatattctcacatttcaaaaccaatcatgccttcccaatagtcccccaaagtctcaactcatttcagctcaactcaaaatccaagtccaaagtctcatctgagacaaggcaaggtccttccacctatgagcctgtcaaaccaaaagcgagttagttacttcctagatataatggggatacaggcattgggtaaatacattcattccaaatgggataaattagccaaaacaaagaggctacaggccccatgcaagtctgaaatctaatagggcagtcattaaagcttaaggtttcaaaatgatctcctttgacttcatgcctcccat

SEQ ID NO: 256715 - DNA, 169 bp, Homo sapiens
gccaccacgcccagcctcacatttttattttaaaaacctctccaggctgggcgcagtggctcacgcctataatcccagctgttagggaggcagaggtgggaggacagctcgagcccaggagttccagatcttctgcctgggcaatataatatagcatgaccctgttcta

SEQ ID NO: 256716 - DNA, 448 bp, Homo sapiens
tacgaagtaattgaaatctggagaagtaagcaagctttgttgagatctcagagctagtgactaacacagcctgaactgcattttctgacttaagttacagtatttttttactgcttattgtatataattattcaagtgggatatttggttttgttcgcagaacctgggtttactttgaactttttctataaagtgacattctgtgtttgcagcttgtacaggataaacagggagcccttagaaaagttacagctgaaagatttcctgaaccctccaacattaaacattaaggccccctgggcagttcacagttgtccaggctccagcaattgtagtgccctggtgtttctaggaatacattatcttggacctaattgagatcaacataaccaatgtttcattttattattagtccttattggtggctgaaggtccgaggctactgctg

SEQ ID NO: 256717 - DNA, 5746 bp, Homo sapiens
cgcacaccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttgatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaagaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagcccacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 256718 - DNA, 664 bp, Homo sapiens
agaggatttctcctctctctgtctcttaattgcaaattctgccatttgcaatggagaatggctgatttgatcatgttcataatgattttatgcattttctttgacaggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaacctgagtagatgcatgtgatgtaccagatt

SEQ ID NO: 256719 - DNA, 284 bp, Homo sapiens
acctggcagacgcgcggcggcggcggcgagcggtggcgctcggctcgggcgaccgcggcgggggagggcgcggcgcaccgatgggcgccactgagaagggaggccagaagagccggaagctgttttccttgcggcggccgtggaaggcgacccggcggctgtggaggccacgctcagctcgccaggcggcgcagggtgagtgtgggcgcggccggtcgggacctgttaccctgaggcaggggcgcagcggcggcggggccgtccccggcggtctctcgggtcgc

SEQ ID NO: 256720 - DNA, 5763 bp, Homo sapiens
acctggcagacgcgcggcggcggcggcgagcggtggcgctcggctcgggcgaccgcggcgggggagggcgcggcgcaccgatgggcgccactgagaagggaggccagaagagccggaagctgttttccttgcggcggccgtggaaggcgacccggcggctgtggaggccacgctcagctcgccaggcggcgcagggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaagaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagcccacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 256721 - DNA, 5859 bp, Homo sapiens
cgcacaccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggagtggttattattgagtcgagaatttttgggaaaagtaacacgtggagagtcaatttttgagtggaaggagtctgaagagagggtaggaaccaacctcctactacccaccaggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttgatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaagaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagcccacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 256722 - DNA, 3703 bp, Homo sapiens
gaataaggcaagacgaggccgggtttaatcggcacaggccgctgtcaacattcagccagatgtttctggaggttgggactggcatgctaaaccaggaggctttggaatgggaagcgtggacacacgtctcgcatgctccatcacaaccgctctactgccgcggcactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 256723 - DNA, 5710 bp, Homo sapiens
acctggcagacgcgcggcggcggcggcgagcggtggcgctcggctcgggcgaccgcggcgggggagggcgcggcgcaccgatgggcgccactgagaagggaggccagaagagccggaagctgttttccttgcggcggccgtggaaggcgacccggcggctgtggaggccacgctcagctcgccaggcggcgcagggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaagaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagcccacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcagtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 256724 - DNA, 4798 bp, Homo sapiens
acctggcagacgcgcggcggcggcggcgagcggtggcgctcggctcgggcgaccgcggcgggggagggcgcggcgcaccgatgggcgccactgagaagggaggccagaagagccggaagctgttttccttgcggcggccgtggaaggcgacccggcggctgtggaggccacgctcagctcgccaggcggcgcagggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaagaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagcccacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacctggtaacaccagagcaggtgaagaaggtgtacaggaaggctgtcctggtggtgcacccagataaagctactgggcaaccctatgaacaatacgcaaagatgattttcatggagctcaatgatgcctggtctgaatttgaaaaccaaggccaaaagcccttatattaatttatgagcttttccatctctgctgcagacctgtgctaatgcttagtgtgtgtcacaattctgaggttttcgcagatgaaccaaaaactccagtaacatgttttcagtactaaaccgttaagttactcatgaattaatttctcattgataaggaatgtggatgtttggtttctccaaagttcccaccataaaagatccaaagcatgagaggaacttctagtcagatgaccttgcagaaccaccgcattccaccctgccctttggggagcctactcagcattctacctggggaaatggaaaacagaggccaccacccatgaaggcataacacccatcacattgtctgagaataggattaatgagcaaaagttatgataatagagttatatgatggtttaatggtttctagatttttcttggaaagatataatttgagcagtggctttatgcagactccaagaacaaaaccaccaggtatttttttttaagtaaaaatttactaaggcctttagcataatactgtaaatgtcttttggtcaagagaactaacaaatataaaggaacttgaaatgtggggagtgataatagtccagtgattaaactacagtccagtgattaccaccaactttctgactaagctaaaaatgaatgaaaatggtggctaaagaaaatagggactctgaagatgtcgaaatctttattcctggttaggaaggtgggccgctacccttctttccctttagaaaactgtgattaattaaataaaaagtcttactactataacaactctaaacctggtttaaatgaaacatctaattttgctgtaaggcttaatgctcttcttttgtttagccaagaaaacattcttagttggaaacaggtggtaaagtagtttggcctgttcacaacttatcaggaccaatatctagtgtggactcagtgttctctaggtttgtgagcagttgtggtaagagaatggaaggcaacactgaataggagttaagggaatggcacgatcacagtgagagagctgcactcacctgcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaatttttgatcatggttggataatcatcaatgttact

SEQ ID NO: 256725 - DNA, 4547 bp, Homo sapiens
acctggcagacgcgcggcggcggcggcgagcggtggcgctcggctcgggcgaccgcggcgggggagggcgcggcgcaccgatgggcgccactgagaagggaggccagaagagccggaagctgttttccttgcggcggccgtggaaggcgacccggcggctgtggaggccacgctcagctcgccaggcggcgcagggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggatggacgggcggcatcatcaattctggttggtgctatgttcattttctgtaatctctactctactcctggcccagccattcgattgctatatgcaaagcgaccaggaattggactttcaccatcccataggagatacctgggctatatgtgtgacctactggcagacaagccctaccgccctcacttcaagcctctcacaattaagtcgatcactgtcagtccaataccctttttcaacaaacagaggaatggatgtcgcccttactgtgatgtactcattggagaaaccaaaatatattcgacttgcacagattttgaacgaatgaaagaatatcgtgtccaagatggaaaaatcttcattcccttgaacatcactgtgcaaggagacgtggttgtttccatgtatcacttgaggtcaaccattgggagccggctacaggctaaggtgaccaacacacagatattccagcttcagtttcacactggattcataccactggacacaacagttttaaagttcaccaagcctgagttagatgcatgtgatgtaccagaaaaatatcctcagctatttcaggtgacactggatgtagaactacagccccatgacaaagtaatagacttaactccaccatgggaacattactgcacaaaagatgtcaatcccagcatcctcttctcttctcaccaggaacatcaagatacgctggccttaggaggacaggctccaatagatatccctccagacaaccccaggcattacggacaaagtggtttctttgcctctctctgttggcaagatcagaaatcggagaagtcattctgtgaggaagaccacgctgccctagtgaatcaggaaagtgagcaatcagatgatgaacttctgacactttccagtccgcatggcaatgccaatggtgacaagcctcatggagtcaagaagcccagcaaaaagcagcaggagccagcagcccctccaccccctgaggatgtggaccttttgggcctggaagggtctgcaatgagtaacagcttctctccgccagcggctcctcccaccaattctgaactactgagtgacctgtttgggggtggaggtgcagctggtcccacccaggctggacagtcaggagtggaagatgtgtttcatcctagtggacctgcgtctacccagtcaacaccacgccgctctgccacctccacctctgcgtctccaaccctaagagtgggagaaggtgccacctttgacccatttggagcaccttctaaaccatcaggtcaggatttgctgggttcttttctgaacacatccagtgcttccagtgacccctttctccagcccacaagaagtccttcgcccacagtacatgcttctagtacgcctgctgtgaacattcagccagatgtttctggaggttgggactggcatgctaaaccaggaggctttggaatgggaagcaagtcagctgccaccagcccaaccggatcctcgcatggtactcccacccatcaaagcaaaccccagactctggatccttttgccgaccttgggacactaggtagttcttcctttgccagcaaacccaccacaccaactggattgggtggaggattcccgcctctcagctcgccacagaaggcgtctccccagcctatgggtggcgggtggcagcagggaggtgcctacaactggcagcagccacagcctaagcctcagcccagcatgccccactcctctccccagaaccgacccaactacaacgtgagcttctcagccatgcctgggggccagaacgaacgtgggaaaggatcaagtaatttggaagggaaacaaaaagcagctgattttgaagacctactctctggtcaaggtttcaatgctcacaaagacaaaaaggggcctcggacaatagctgagatgagaaaggaggaaatggccaaggaaatggatcctgagaaattaaagattctggaatggattgaaggcaaagaaagaaatatcagagcccttctttccacgatgcataccgtactatgggctggggagaccaagtggaaaccagttggcatggcagacccagtcagatggcttgtcagtatctgctctgaggaaccaggtcccacctccccacaaggcaaatctagacccattaaattattacagtgggcttttttgttttaaaagtggttggggatccacaggaacgacattcatacagggacatttgtgaaagcaaagcaagaatgaatgctttcccgatctcagactggctggattcagatcagtgtgttggctggttctcattttaaggggtaagcagtttgctattctgtgactttagtagatctcttttgtgtgcacatatacaatgtgcattatacatatatattaaatatatccacaaagcagatgggcaaaaagattttcatgctaatcttcaaaggttcatgctcaatattgtgaaaagcttttaaaagttgttttgaaaagacaatcattttttgtttttgttttaactttcttgtggcaagctataccggaaaagcggcatgtcaaaaatactttaggttctacatagatctctttctctcttttgttttgtttgtttgtttgttaaagttcattatttattttaccttttactgacaatgtgaaactcgaagaaaatgttctctttttaaatatacagtcataaactgttcaaggtaaccataacaaactaggtgttatttattaacgtattataaaataatgtttgatccagtatgtgcttgtcttatttaaaattggaatgtgagacatgttgctgtgacctgtttttctttctcattcacatttgtagatattgtgtgaactacagtatataatgataacaattaaaaggatattctgtggatgtcacgtattttgaaatgatagaactacattagctttgtatcatgtttggataattcatcaatgttcacagtttaaaacatcattaaacattatgtaattacaatgagaaagaatcttacttaaatttggagattttcccccacatctcttttccggatacattataattctggacccctatttatctcaaaactcttaatatatgcagaccaacaggtctttgcattccttttaaataactggttgtgacaaagcttgttgttgatcagattcactgtttcatcatatttattgtaatatattttttgttttgtaaatatgttacaacaaaatgtgattggtctaaaatatttgtaatgtatattaaaaggttcaaaaatatttgtataaatctaagttatttgggtacttgtaggaatacaatgaggagcttgaatgccaccttctgacatgatttacttttaaggaaagttatgaggagagaatacaaaaagcatgcaccaaaatgtaatctgacaggatttctggatttatacgtaatcactcctgccccaacacacacacacacacacacacacacacacacacacacacatgcacgcacacatgattttgattatgctacatgatatatgtttcaaaaagaattagcatagaaatcctggtctcctagccaaaaaaatcaaaggattttcaaaaaaacgaatctgtatgttgaggcaaaaggattgaacctggaagtctgggactttatcatagaaacaaagtctcagatattttagttctttggaaacaaatgctgtaattcaaaagcatttgacctgtcactgtactatctacatgtggaagaatgttcaagttgaatcctaatgccgtgaatgaaacacagtctgtgtagggaatgagcaaaaaagttgaattccaattgctttttggccttttggctaaaataaatgtagcatctaattttatcagttt

SEQ ID NO: 256726 - DNA, 1049 bp, Homo sapiens
acctggcagacgcgcggcggcggcggcgagcggtggcgctcggctcgggcgaccgcggcgggggagggcgcggcgcaccgatgggcgccactgagaagggaggccagaagagccggaagctgttttccttgcggcggccgtggaaggcgacccggcggctgtggaggccacgctcagctcgccaggcggcgcagggtgcctcatctccagacatggagcccagctatgggggaggtctctttgacatggtaaaaggaggtgcagggaggctctttagtaacctaaaggacaacttgaaagacaccctcaaagacacatcttctagagtgatacaatctgtgaccagctacacaaagggagatttagacttcacttatgttacctccagaattattgtgatgtcctttcctctggacaatgttgacataggattcaggaatcaggttgatgacattcgaagctttttggattccagacatcttgaccactacacagtatacaatctgtcacctaagtcttatcgaactgccaagtttcacagccgggtctcagaatgcagttggcccattaggcaggctcccagtctgcacaacctttttgctgtgtgtcggaatatgtataactggctactgcagaatcccaaaaatgtctgtgttgtccactgcttggtgagtaaccttttgttgttggtggtgatggtttggtttggtcaaatatggatgagcctgtacacaatggtagacaggtaacatttgagttcaataggatttactgagcccatatttaggaattgggtaatgtgagagttgtaaaaataagaaagggatttattattcttgacttaaagcttgactactagtgggaaaggcagatgtatacacaactcacatagtgtggggactctagaatgtgctaagtattataaaggaggtagaaacaggagtagtgtgtgcacagctaaaaatgccattgacttttgtgtgaataaagttaacattaacatattggcgtatttattttttcttcctgtttgtgtttgaataaaaata

SEQ ID NO: 256727 - DNA, 448 bp, Homo sapiens
ccgacttgcatgcaattatcatagcccgagtgctcctccgttgagagacttcgcccccgagaccgctgactgtgaatgacaaatcaaaagtcagggttgcagaatcagccggactttcctgctcatttgcagcagagggaggaagcagagaatgaaagattctgaaaataaaggtaaggggcggactgcagaaagatggctaagagagggctaaaggctaaaagatgctagggatgcgatgtcactccacagacatatttagtttgtattaatggctagtttaaaattaccatacctatattaacattctagttatataataaacatgatgactttaaaaaatgactagcttctagtttccaaatattgtgtcattcagctttccatttttatagtcctaaatataactctatttttgcgttcttaatcttggctgagtaacacagct

SEQ ID NO: 256728 - DNA, 292 bp, Homo sapiens
gtccactgaattctcagtgaggtcagggagactgaggatgagcaatgaggacattaaggaaatgaggacatgagctgtgccctgcatacatctaggggaagagcatctaagcagaataaaggcaaaggccttgaggcaggaccatgcttggcctgccaaggaacaacaaaaaggctggtgttgctggtcaaagtgggtggagaagagtggtaagagaccacgtcagaggtagctgtgtgtgtgtgtgtgtgtgtgtgtgtgtgtgtgtgtgtgtgtgtgtgtgtgtgtgtgt

SEQ ID NO: 256729 - DNA, 410 bp, Homo sapiens
aggaaaggaaatggagaaacacaagttagtctagtagagattgaaatagaaacttcaactaaaactcttggctttagaaggagagagatttgcttgtttatttcagttttgcagaaagttatttctctactctgatccctccatgcttgtggtgtgtccctaaggacccccttttctttcatattctgtcttctttgctttcttttaccttcccttttggtttgtttcttttttaattgctggcttcatggcacctcctttgaattaacctcaaatgtttgatttcttgaagcttgtgtgagcctgaatataaattatatcttctctttacacctttatccttccgttgcaaatgttgccctggatggggtgggagggactaataaagttctatttgttttgtacctaaa

SEQ ID NO: 256730 - DNA, 493 bp, Homo sapiens
ctcccagcccttgggtcaggacagcaggaggccctgagggagcttgagctgactcctgcttctgcttctgcttctgctctgtccggagtctcaggctgcctttagcaagtattccgcatgagcgtcatccctgcggcttcaggagaagcagagtgaaccttggagaaaagagaggcacccaaggtggggacctgcgggcttgcctcattcatccctggacaagcctcccagaaacgaaatgggctgctcacctctgtgatcctcagagttagcaaaactgcttgctatgtcatttagacctcttacaaaatgatattcatctatcactggtgatgacattcattctgaattccactcataggcttcaggatacttgccctcatttttttttcccttcatttcaacagttttcactgagtgtcttgtggacatgagtcatcaaatgttttgctgcctttatgatccaatcccaaataaaaagtaaaacatttgt

SEQ ID NO: 256731 - DNA, 1049 bp, Homo sapiens
  misc_feature (4)..(4): n is a, c, g, or t
gggngaacgggccaagttccaggaaccgtagagatggcttctgccggaaaaggaggacaggatgctctggtccttttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaaaatgagaaaagagcagaagcacttgaagcaacacaactatatctaagattgctgttgctgaacattagagaagaattacgacggctacttacttttatggcaatggcatcagagcccaatgcctacaagttgcaaaaacaggtgaaaaattttgcaataagttttgccattttttttgctatttttttcctctaaaaaccatttatgctaatgttaatctttctgtttacagtatgataataaaacagtggtcctgaaaactcttg

SEQ ID NO: 256732 - DNA, 1585 bp, Homo sapiens
  misc_feature (4)..(4): n is a, c, g, or t
gggngaacgggccaagttccaggaaccgtagagatggcttctgccggaaaaggaggacaggatgctctggtccttttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaaaatgagaaaagagcagaagcacttgaagcaacacaactatatctaagattgctgttgctgaacattagagaagaattacgacggctacttacttttatggcaatggcatcagagcccaatgcctacaagttgcaaaaacaggtgaaaaattttgcaataagttttgccattttttttgctatttttttcctctaaaaaccatttatgctaatgttaatctttctgtttacagtatgataataaaacagtggtcctgaaaactcttgccaaatcagttttgcaagccaaatcattattaaaagtgcgggcagaacaactggtctggtttccactggagtaccactctgagctcttcaagacaccagttactttattggatctggttagtaagaaacttaagaagcttctacatggagaagatgcagatgccatatcagttggggaggaagttagtatacttccagtggaagacctgagagggtacctgaagagataccgggaaaatattggaaacatgccaccaagccctcttcgatagaagtctccttatttggaaagttgccattttaatgttcagtgtgaatcaggtagggatttgctagtcatcactatgaatggtggatactttgacaaatgctttaaggatattaccatgttgttgcgtctgctgttcagaaaattataaccttagacaaatatctttgcactgagcctcagttttttaaaaatctctaaaataaaaatacacatgcacagatttgtatttttaagatcgagctattcctttaatagtttaaggttg

SEQ ID NO: 256733 - DNA, 1335 bp, Homo sapiens
  misc_feature (4)..(4): n is a, c, g, or t
gggngaacgggccaagttccaggaaccgtagagatggcttctgccggaaaaggaggacaggatgctctggtccttttcaagctactcagctatgggatggtattattcactctcttcaggcccaagtggaaataaaaagaaggaggcatcatttacagacatacaaagactgtttcactggttctgatgctgtcgatgtggtcttaagtcatcttatgcaaaacacgtgcctaagtagcaatgacatctcttgtcttaaaggggttcatctttgccaagttctaatgaatcacaaagtatttgaaccagtaggaatgaagaagcttttcaaaaaagaaaaggaattagaatttgaagattccaacattagtctctacaggtttctaggcaataaatcatcttacgattgttgcaaaagacaaaaggatgctgagaatgagttcaatgaaaccttgagaccaggatatgaaatgatttcaaatcctctagcacaggagattggtgaggaaagaattgaggaacttattcatacaataaatgggaatccagctttatgtccaaatatcacagttcagaaaccttttctccggctttcaaaagaagatgtttggaaagaacaaacattattatgtcttcttcaattgattcaccttccattcttggacaatattttggagcctccagttaaaacacaaaatcttcaactaaacaaagaggaagatcttgttatcactaacacttgcctagacagagaacttattccaagcttatgtctacctgaaaaatgagaaaagagcagaagcacttgaagcaacacaactatatctaagattgctgttgctgaacattagagaagaattacgacggctacttacttttatggcaatggcatcagagcccaatgcctacaagttgcaaaaacaggtgaaaaattttgcaataagttttgccattttttttgctatttttttcctctaaaaaccatttatgctaatgttaatctttctgtttacagtatgataataaaacagtggtcctgaaaactcttgccaaatcagttttgcaagccaaatcattattaaaagtgcgggcagaacaactggtctggtttccactggagtaccactctgagctcttcaagacaccagttactttattggatctggttagtaagaaacttaagaagcttctacatggagaagatgcagatgccatatcaggctttacgttttgccaacccttgacatacaaggagtttgaaaagcagaagggaaggacaattcagtatctacaccagttggctcttgagattaatagtaaccccagcatctctct

SEQ ID NO: 256734 - DNA, 242 bp, Homo sapiens
ggccataattgcacctattttattgagtggtgagagtcaaatgaagtatgtggtaatggacttagcacagtgcttggcacgtttaaaccatccttaaatggtggtgcttcatagattaagataaacaacaaatgaggaaaattcagcaaggtcaaatcgacatttccatgctaaatgttaattttactatgcttaaaattaagcttcaacccaaaaaagagtttcacagacatacagatgag

SEQ ID NO: 256735 - DNA, 462 bp, Homo sapiens
  misc_feature (35)..(35): n is a, c, g, or t
ctgtcaccatctgtcatctgtctccaagaccatanttagaggaggggcccaatagcagcactcctcaaatgccagcagcatccctcaaatgccaacagcacccctcaaatgccaacagcacccctcagatgccaacagcacccctcaaatgcgctttcctagatgttacagaggaccatgtgtgaaccttttctggcaggaagctctggtgttcttgtttagtctcgcattgccagagagtaggcagctctgaagggtagatagtttttaaaaaaaaaaaaaaaaggcggcccactacactaaaggataatcatcaaggatagccaagagcacagttcataaatcaaaatcactgccttaaaaatgttgagaatgctttcattaagtgcttaaattggataacagacttgtgcctcaatgctcaatcagaaataataaaattctcttacagtgactatctta

SEQ ID NO: 256736 - DNA, 2250 bp, Homo sapiens
ccctttccccactgtggtgtgataagaggctgccctcacagtcacaatgctcccgggtcacagaggtgctgggccccaggccagcctctgcctgggaagttctctctgggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcaggaacctacctcacctttgaggcatgcaagaatacagtcactgcaactgcgaagagtttgggcaggagacagacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccagaggcgccacagggcagtaatggctgatgggcaccccctggagtctgacacgttcttccgaatgcactggaactgtggcaggatcatcctgcagtcctgcagggggcgcttcctgggcattgcacccaacagcctgctgatggccaatgtcatccttccaggcccaaatgaggaatttgggattttatttgccaatcgctccttccttgtattgcgaggtcgttatggctatgtgggctcctcatcgggccatgacctcatacagtgcaaccaggatcagcccgaccgcattcatctactaccctgccgaccgggtatctaccacttccaggcacaggggggatccttctggtcaataacatcctttggcacctttcgcccttggggcaagtttgccctcaacttctgtatcgagcttcaggggagcaacttactcactgtactggcccccaatggcttctacatgcgagccgaccaaagtggcaccctgttggcagacagtgaagacattaccagagagtgtatctgggaattttaggtcaatgggatgtcacctaccaaaatccaaatcctccaggaaaaactactacactaaatggaccaggaacctcagagtcaagatccaagagaagaacatctgttacaacttttcctacccagtttagcaaaacacctgttttatgcaacaatacatcacaacaggccacccccaagatccttgtgtgcatctgactcaatatagaataggggtctggatgagggttgaaacagacaccccaggctgctctaagttctatacaggagagaccaaatggcaagcagttcttccactgatcttccccgtccccatccagaactgctagactttttccagtgaacccatgagcagccagcattgccctgaagggtttagaatccagttatgactttaaatatctttttggtttagaaaaaaggaaagattgttaatctcgtgagcacaggataatggtaataacaccttatgcctgtataggccactttacctcctcctaccacgatttatttaacttccccacccttactaacatta

SEQ ID NO: 256737 - DNA, 1337 bp, Homo sapiens
ccctttccccactgtggtgtgataagaggctgccctcacagtcacaatgctcccgggtcacagaggtgctgggccccaggccagcctctgcctgggaagttctctctgggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcaggaacctacctcacctttgaggcatgcaagaatacagtcactgcaactgcgaagagtttgggcaggagacagacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccaggtgagaccttggcttcctgagcaagagaaaccttaagctctgagctctccctccctagacttccttctcctttttcaaggcaaatgatgagaggatgatgtgggctgtggaggcacttgttgataaacattcattttcacccaatgggggctccttta

SEQ ID NO: 256738 - DNA, 2005 bp, Homo sapiens
ccctttccccactgtggtgtgataagaggctgccctcacagtcacaatgctcccgggtcacagaggtgctgggccccaggccagcctctgcctgggaagttctctctgggaacatctgacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccagaggcgccacagggcagtaatggctgatgggcaccccctggagtctgacacgttcttccgaatgcactggaactgtggcaggatcatcctgcagtcctgcagggggcgcttcctgggcattgcacccaacagcctgctgatggccaatgtcatccttccaggcccaaatgaggaatttgggattttatttgccaatcgctccttccttgtattgcgaggtcgttatggctatgtgggctcctcatcgggccatgacctcatacagtgcaaccaggatcagcccgaccgcattcatctactaccctgccgaccgggtatctaccacttccaggcacaggggggatccttctggtcaataacatcctttggcacctttcgcccttggggcaagtttgccctcaacttctgtatcgagcttcaggggagcaacttactcactgtactggcccccaatggcttctacatgcgagccgaccaaagtggcaccctgttggcagacagtgaagacattaccagagagtgtatctgggaattttaggtcaatgggatgtcacctaccaaaatccaaatcctccaggaaaaactactacactaaatggaccaggaacctcagagtcaagatccaagagaagaacatctgttacaacttttcctacccagtttagcaaaacacctgttttatgcaacaatacatcacaacaggccacccccaagatccttgtgtgcatctgactcaatatagaataggggtctggatgagggttgaaacagacaccccaggctgctctaagttctatacaggagagaccaaatggcaagcagttcttccactgatcttccccgtccccatccagaactgctagactttttccagtgaacccatgagcagccagcattgccctgaagggtttagaatccagttatgactttaaatatctttttggtttagaaaaaaggaaagattgttaatctcgtgagcacaggataatggtaataacaccttatgcctgtataggccactttacctcctcctaccacgatttatttaacttccccacccttactaacatta

SEQ ID NO: 256739 - DNA, 2510 bp, Homo sapiens
ccctttccccactgtggtgtgataagaggctgccctcacagtcacaatgctcccgggtcacagaggtgctgggccccaggccagcctctgcctgggaagttctctctgggaacatctggtgggtactacaggccctattccaggccctatggcctgtggaacctcaccacgggggggagggctgggccagacggagacatcacctgtggtgtcagccccatggatgagacagagtggatacacagacatcccaaggctgaggacctaagggttgggctcatcagctgggcaggaacctacctcacctttgaggcatgcaagaatacagtcactgcaactgcgaagagtttgggcaggagacagcacagggtggttgtgtcagaaagaagagaagtggagagcacagggtggttgtgtcagaaagaggagaagtggagagcccaggttgatcacagctgaaccaggcagttgcatctgaactgttcatgctcccatcttcatccctggagccaggcctgcctataagagcttttgcttctgtcttgccatgctggaaggcaacctttggggatggaggtattggctaagtgtgctctctgcggacaacagtgaggaagaaaaaaacctgggagatcttggtgagcaatgagcatgagacacaggccgtggtgcgactaaagagcgtgcagggcctctacctgctgtgtgagtgtgatggcaccgtgtgttatggccgcccaaggaccagccaccatgggtgctttctactgcgtttccaccggaacagcaagtggaccctccagtgcctaatctctggtcgttatttggagtccaatggcaaggacgtgttttgcacttcccacgtcctctcagcttaccacatgtggaccccccgaccagccctccatgtccacgtgatcctctacagccccatccaccgctgctatgcccgggctgaccccactatgggccgcatctgggtggacgcagcagttccctgcctggaggagtgtggcttcctgttgcatttccgagatggatgctaccacctggagacctctacacaccacttcttgtcccatgtagaccggctgttctcccaaccctcatcacagacagcttttcacatgcaagtgcggcctggagggcttgtggcactgtgtgatggagaaggaggcatgttatatccacagggcacgcatctgctcttgggcatgggctgcaaccccatgaggggtgaggagtggttcatcctacagcactgcccaacctgggtcagcctcaggtcaaagactgggcggttcatctcagtcatctacgatggtgaggtgcgtgctgcttctgagcgcttaaaccgaatgtccttgttccagtttgaatgtgacagtgagagccccactgtgcagcttcgttcagccaatggctactacctatcccagaggcgccacagggcagtaatggctgatgggcaccccctggagtctgacacgttcttccgaatgcactggaactgtggcaggatcatcctgcagtcctgcagggggcgcttcctgggcattgcacccaacagcctgctgatggccaatgtcatccttccaggcccaaatgaggaatttgggattttatttgccaatcgctccttccttgtattgcgaggtcgttatggctatgtgggctcctcatcgggccatgacctcatacagtgcaaccaggatcagcccgaccgcattcatctactaccctgccgaccgggtatctaccacttccaggcacaggggggatccttctggtcaataacatcctttggcacctttcgcccttggggcaagtttgccctcaacttctgtatcgagcttcaggggagcaacttactcactgtactggcccccaatggcttctacatgcgagccgaccaaagtggcaccctgttggcagacagtgaagacattaccagagagtgtatctgggaattttaggtcaatgggatgtcacctaccaaaatccaaatcctccaggaaaaactactacactaaatggaccaggaacctcagagtcaagatccaagagaagaacatctgttacaacttttcctacccagtttagcaaaacacctgttttatgcaacaatacatcacaacaggccacccccaagatccttgtgtgcatctgactcaatatagaataggggtctggatgagggttgaaacagacaccccaggctgctctaagttctatacaggagagaccaaatggcaagcagttcttccactgatcttccccgtccccatccagaactgctagactttttccagtgaacccatgagcagccagcattgccctgaagggtttagaatccagttatgactttaaatatctttttggtttagaaaaaaggaaagattgttaatctcgtgagcacaggataatggtaataacaccttatgcctgtataggccactttacctcctcctaccacgatttatttaacttccccacccttactaacatta

SEQ ID NO: 256740 - DNA, 628 bp, Homo sapiens
tgtcagaaagaagagaagtggagagcacagggtggttgtgtcagaaagaggagaagtggagagcccaggtgggaaagcagaattgtgggcatccaggggaagttggaccagtggagttattgcaaagcctatgtttctgttctggttgtggtttgagaatggggaactccagaagccctagcagtgtcggtcttcattctagagaggaatgtaggcacctctgggatgggtgccagactgaggcaggggcaaagttcttcctcttataacaaggttgatcacagctgaaccaggcagttgcatctgaactgttcatgctcccatcttcatccctggagccaggcctgcctataagagcttttgcttctgtcttgccatgctggaaggcaacctttggggatggaggtattggctaagtgtgctctctgcggacaacagtgaggaagaaaaaagtaagacttacaccaaagcgtttctttaaaaattaggtattgaagagtgggattaagaaaggagggagggtttaccttctgttagctgaaggaggtagacatctagaacttctctttggatagtgccatctggctgcaggggtggaagggcccagagatctcttgatgaggggata

SEQ ID NO: 256741 - DNA, 418 bp, Homo sapiens
gggcacctgtagccctagctacttaggaggctgaggcaggagaatggcatgaacccaggagacggagcttgcagtgagccgagatcgtgccactgcactccagcctgggcgacagagcgaggagaccccacctcaagaaaaaaacaaaacaaaaaacaacaaaaaaacacatagattccattctgattcagctaggtgttgtatttatgatacaggaaatttgggaaacagtcttaatactgtgggaactcttacaagaatttacctctgaggccttagcctagcagtatatgaaatcccctctattagtttgttctcagttttttaattgttactttgttctcgggcctgttattagttctgctaatctgttaatccctcatccccacccccatcccacaagagtaaaatatctacc

SEQ ID NO: 256742 - DNA, 405 bp, Homo sapiens
caccacacccagccttcttttcttttttgtagagacaaggtcttgctatgttgcccaggctggtctcagacccccaagctcaagtgatcctcttgccacagcctcccaggaatatacttcattcaatagactatacccacaattatatataatgcataatcatatgtgattatattttgcatataatgtaaggagattcatggatcctctgaaattcatctatggatgctctaaaactatgttgctggaacccagattaagaacccttgtctcagcctcccgagtagctgggactacaggcgcacaccactacaccctgctagtttttgtatttttagtagaggtggggtttcaccatgttgtgcaggctggtcttgaactcctgacctcaggtgatccacccac

SEQ ID NO: 256743 - DNA, 286 bp, Homo sapiens
ttctccattcctccttcaagtatctgagcagttcctgtgtgccagctgctggtctacaagatggatcggtccttggagatcacgctgtagcagaggaggcaggctgtagcccacaggccacaaccagccccctgcctgttcacacatataaagttttattggaacacagccacacccatttcagtgcatattgtctgtggctgctttcctgctacaatggagagttgagtagttgggacagagacctatggcctgcaaagctgaactatttaccatctggctctca

SEQ ID NO: 256744 - DNA, 491 bp, Homo sapiens
catctcaaaaaaataaaaataaaagcttttgagttgatctaaaaagctaactggtttattagtcaaccgttgctgtgtaagaaacaatctgagaacctcagtggtataacacaatgaacatttatttctaataagtttctgggttaggtggggcatttctgcttcagtttgcagcagctggggcctctctcattgccactgtggatcagcaggggtggctgtgttcccagggctgcccattctcctcctgggaccaataagctagtcacagcatacttttcacgtggtaggagggaagaaggcaagcccagttccctaaagaggaaagggactctagacagagcagtactattcaaagcatgtctgcagtgagtgagataggtacagaaattaacaacaagcatttagaaactaaacaattgccacaatattcaagcggtgtttttgctgaattttactaaagtattggtccaggacacgttggaaattta

SEQ ID NO: 256745 - DNA, 341 bp, Homo sapiens
gaacctttgaatttgattttccagttgtttgctgtcagtatgtagatatacaattgatttttgtatagtgactttgtagtctaagtctgtttcacttattacttctagtggtttgcttatatagaaaactaagaaatttgcaattatgtttcctgtgactatcgttttacttctttctttctaatccttttgtcttgtctttctttttattggtttattatactgtccaggacttctatagcattgaacagaagtcatgagaatgggcataattgcattgctctcaagcttaggcagaaagctttcagtagtccaccatatggtatgacgtctgtaggatc

SEQ ID NO: 256746 - DNA, 428 bp, Homo sapiens
acttctgaataccattaaccccctctcctggcagctatgacctggttagagtcttattaggttcccaagggtaatgaggttatcaccatttttttgccccttttcttctcccagaatagcgggtcttctaaagatgctgttctcggctgggcgcggtggctcacgcctgtaatcccagcactttgggaggccgagatgggcggatcatgaggttaggagatcgagaccatcctggctaacacagtgaaaccccgtctctactaaaaatacaaaaaattggccgggcgtggtggtgggcgcctgtagtcccagctactcgggaggctgaggcaggagcatggtgtgaacctgggaggcggagcttgcagtgagccgagatcgcaccactgcactccagcctgggacagagcgagactccgtctcagaaa

SEQ ID NO: 256747 - DNA, 757 bp, Homo sapiens
tctcatctgtcagttaaggctttgcctttaaatgctaacatagagctacattttaagagcccataattcaatatggaaacaaactccctggcacactctatttcttgaaagattatcaaagagaatcaacaattggaaggaagtgttgccgagaagctagttgcatcaaatggtttctctacaggaacttttgtagaaattgcacttgcttgtaatgccactggtctaccctgagagactttttaagaaaaaagagatcctaaacctttgaagatattcactccattacacagcatcttctttttgagaacccttaggacacaactttttttctgatactaatattagaaatactgtcactttactgtatttggtgtttgtcttaagggctatgtgaaagacatgatttactagattttcttccctgagttttctgttaaacagcttagaggcaaaattgtggtcagtttatggcaaatgtatagaattgtataatataaaattttgactagcctcatttgtgggtggattttcatgttttatcttgtatttgcttacttttcttaccttactcaatttattctatttaggtgtattgtacatttcttataaagccacctgaatttgcttttggaacaatgtgacttagtatttaataactatgtcacttatagtgaaaattataagcctcttcataattttataaagtaccatggtatgtaactaataaaaaagtaataattaaaatataaaaaat

SEQ ID NO: 256748 - DNA, 223 bp, Homo sapiens
ggcagaggttgcagtgagatgagatcgcatcatggcacttcagcctgggtgacagagactccgtttcaaaaaaaaaaaaaagtttacttaatattttcattttggctgggcgtggtggctcacgcctgtaatcccaacactttgagaggccgagacgggtggatcacctgaggtcaggagtttgagaccagtctggccaacatgtcgaaaccctgtctctact

SEQ ID NO: 256749 - DNA, 605 bp, Homo sapiens
agagttgccctaagggagccagggactatagtcaaaagccttagaagtctacctggtatcctgttatactgacctggtgtcctgttgtactgtggctgagctggcactcaaaccatgagatgcagtccttcccacgttttcctctcctttccacaggcaaaggagcctcacctcatggccaccaccaccacagacccacagggagtactgccatgctactgtccatgttctcctcaggccccaggaacctccagtcagcttgttgctacctcacttgggactctcctttcatagcagtaagcgtccctctgaatgtccaagacccaaggcctggaataaggaactccaagagcccacttggtgctatacctgtggccaagctggtacctaacgtgcaagagtcctcattgcttttccccctgcttttctcaagcagaaggaactcacctcatagccaccacagctgggaatatgctgagtctcacaagaagccagcgagtcttagagtctcacccaaggtccacagtttactacttaggtattgatgctggctattcagggcctaagagctccctagtcagcaggtaatggctcctgtctgaaat

SEQ ID NO: 256750 - DNA, 683 bp, Homo sapiens
gcctaaacttgctagcagcctacaagaatggagaaaagaagcatgtgaataactagaatccagagaattttaaggcctggggcagatgccttctggggtgccatcccagccccccagtcatttccctttctctagaacctgttccacccaccccagggtagggaccagccgcagtagatggcaggcagaaagagattctgctataaaacaccatacacataaaagaaagaacagcaacaaatggacaaagatggagtatggttttgtgcccaaagaatttacaaccccaaaatgagtttcgtgatatgcctgctttgatttctcatttattccaagttatcatttatattgttaatctatacagttttctccccccacgtattagacagcttttaaaaatggttttcaaggctgggtactgtggctcttgcctataatcccagcattttgagaggctgaggcaggtggatcattcgaggttaggagttcgagaccagcctggccaacatggtgaaaccccacctctactaaaaatacaaaaattagccaggcgtgatggcatgtgcctgtaatcccagctactcgggaggctgaagcaggagaatcgcttgaacccaggaggttagagtgagcagagattgcaccactgcactccagcctgggtgacagagagagactgtctc

SEQ ID NO: 256751 - DNA, 703 bp, Homo sapiens
aaataatcaggaaaattacccatgttcaattgcccggttgctccagaacccttggagtgcctaatcacagttaataattaaaacaaagcaagaagattcaaatgttggatttaagtattatcaagagggaaagaaaccatttgagggggaaaatatgaggagtcttttgtggtaggtagattttatggacagaaacatgggctctaaagagagaatgatttttttttttttttttgagacagattctcactctgtcacccagactggagtgcagtggcgcgatctcggctcactgcaacctccgccttccaggttcaagcaattctcctgcctcagcctcccgaataggaaagagtgatcttttaaaatggatgtggattatggtagatggataacttagtatctatgaagctcctatagtgtccccagctccgtgttagaccatatgtctaacctagccaaaattgtgtccacaggatacaactagcaaattatatgtgacagaaacaaaaactggaacctgcagtttaaaatggtatggaatatttgaaataagaacattgacagaaatttaagacgtggtcatagttttaagtaatatgagttaggatgggctgagttatgctgcagtgacaaataacccccaaatcgtagtagtttatacgaacaagtccttttctaggtcttcttgctctgggaccca

SEQ ID NO: 256752 - DNA, 334 bp, Homo sapiens
cagagatggatggctgttttatccctcagtcactgcagcagctgggggctgtccataggtaccagtggttcgccggccgtgggaaacctccaaagtgatatgcactttttgtgttcctctgtgttttttctgggaagccgcaccacactttctacttcttaaaggggactgcggccatcaaccaccttgatgagaacttcctttatacactgaagtgacaggtcctggcctagacgaagactctacacctggcaaagggttggtttcagaagtgctgatcaagctgctgagcctctgtttccttgtctatgaaattacaagaatcttgcctgta

SEQ ID NO: 256753 - DNA, 714 bp, Homo sapiens
gactttggaatgggtccttcactacctggaaagattattttgagaaatgaatgatttatggagtaagaatccacctggtaaaccactaaggaccatgtaaatctaaaatcaattaatctataaactagagaaagaaattaggccaaaacccagcactattctgaccaaagaagtcaagaccaggcagtgagttcctttacttaggagctggggacagaatataaataaatgggcctttgggtttgtgggaaaaggagataataaagataaaggcaacaatgaatggcttggaatggaaaaagaaccatcagaattgatcattacaattaggagctatttctttgggaaaaaataaggaaaacccaagagggaataaggagaatgatataatcaggctggcagccctgtgtcttccactcccccacaagtctggctccagctgctgtcagccacaccacctacatcttctcagcagcgtatcctagatttgcaccctgacagctacccctgaccccctacgcaaaaattatcttttgatcagtgacagtggccatttgtttgatgctgggaggtttccagtgccatgctcatttcggaatggttgaaatggttctcttttcgtgagtaaacagaggaagaagattatgacacaggtggttaactggttcctaatgtacctgtaaaactcctgcatagaaagcccagcagaaggac

SEQ ID NO: 256754 - DNA, 254 bp, Homo sapiens
aaatgaggaagcaatttctgttttatcttggtcactgatttagagcatggactgtgctcatcattcatttctaggaagaaattagagtattcatttcacagagagctacatattgttttcttcaccaccctcttggaggaaaggtagggttgataattacggtttgccctggccacatgctttcactcatgggtaggtgagctaaaacattcatatcaccatgatgcttccttttctttccgtcttaaatagac

SEQ ID NO: 256755 - DNA, 328 bp, Homo sapiens
gggcagcagaggcttcctggggtggcacttctgtgttcaccccatgaaggcactttctctctgaagtttacacacaaggaagacccgtttgaggccatgaaatgtgcactgtgacagtgacgagcctagggtcacacggattcatcgtcccgtggagccacattccagcatcttttgggggaggacacctctgccgggcaatgaggagccagtagcaggtctcccctccctgaagacgggctggacacaaatcacctcattttccactctgtccacacctgaggctgcatctcagctggaaaattacactggaattctaaataataaa

SEQ ID NO: 256756 - DNA, 470 bp, Homo sapiens
gatacagtatacaataggattctggagttaaattgttttttgactcaattcagagacttctgatgggcacccctcatcgccccagtgagttgattctaggagtcagaggagaaacaatgaccatcaggcgaagagtctcacaaagtcaaacgcaggatttccctgatacccatcagggcactttcccataagagacagctgcgctcaggcttactccaggctttactttaaaacctactagaataatagtaggaaaaacaaggaagaatgggtgaaaggaaacagcctatttatttcctcaaatcctttcagcttcgcttcaccttagagaacaatgaggcttattaaatagggccagcagcaatcttgtgtaattgttcagccatcttctctgttgactcctcagcctattctgcgaccctcaagttacccacagcttggctaaaataaaagacttcttcttgcaggtt

SEQ ID NO: 256757 - DNA, 1142 bp, Homo sapiens
ccagaggcccccttccgtcccggggccggggctaggccaaggcgggcaccaggactgcccagcctcccggcccttcgcactggtaaccggttccggggcggatgctttttgcatctgacccggcgcgcccggtgacgccttcgcgtccagacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaatta

SEQ ID NO: 256758 - DNA, 2002 bp, Homo sapiens
ccagaggcccccttccgtcccggggccggggctaggccaaggcgggcaccaggactgcccagcctcccggcccttcgcactggtaaccggttccggggcggatgctttttgcatctgacccggcgcgcccggtgacgccttcgcgtccagacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttccttgtcctctttggaatgtaacaataaaaataatttttgaaacatccatcagtgtatctatctatgtctcctagttttttcctcctccctcttttgctgtataatgagattgaagatataaagacattttgtaccctgtaaaaaaaata

SEQ ID NO: 256759 - DNA, 2108 bp, Homo sapiens
ccagaggcccccttccgtcccggggccggggctaggccaaggcgggcaccaggactgcccagcctcccggcccttcgcactggtaaccggttccggggcggatgctttttgcatctgacccggcgcgcccggtgacgccttcgcgtccagacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttccttgtcctctttggaatgtaacaataaaaataatttttgaaacatcaaaaaaacagaacaaagaaaaaaaacccaaaaacaaaaacaaccaaaacaacaaaaaacaaccggttggcggcgccatcgagcgcccgtgaagaaaggtcttctaaaacccactgcggtggggggcgcgacgcccccaattcgatatcagtaacagttggccccaaccggggtccacaagaagacacccggggggccaaagaaaccgcgggtggactccccccagaaaaagaccgcgggggggaaccacagcgcgctgagacacaacccaaaggggactcggaggcaacacgcggcgcaag

SEQ ID NO: 256760 - DNA, 2168 bp, Homo sapiens
acggaagctcctcccctaccaccggccttgcggaaactgggtctgccaacctgctccttggcccattcctgacagccatacgcctggcctcacagctccggcagacccccgccgccaccagccccgcccctcccgactgcccggcggcactctcgccctcagccccgacagcctggcaggcagcgccccacgatacttagtcacctgttcctccacctcttgaaacttgttttgttggtagttgttctgtctgtcaaccaggaattagaagcaaagtttcctgggaagagtatactaaactgatctcagagtcaggctacttcctgtgtgtacttcctttctagttgtagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttccttgtcctctttggaatgtaacaataaaaataatttttgaaacatcaaaaaaacagaacaaagaaaaaaaacccaaaaacaaaaacaaccaaaacaacaaaaaacaaccggttggcggcgccatcgagcgcccgtgaagaaaggtcttctaaaacccactgcggtggggggcgcgacgcccccaattcgatatcagtaacagttggccccaaccggggtccacaagaagacacccggggggccaaagaaaccgcgggtggactccccccagaaaaagaccgcgggggggaaccacagcgcgctgagacacaacccaaaggggactcggaggcaacacgcggcgcaag

SEQ ID NO: 256761 - DNA, 1850 bp, Homo sapiens
agctgcgaaaggtctgtctttgacggcatgttgtcctcagctaattgggaattgaattcaaggtgactagaaagaaacaggcagacaactggaaagaactgactgggttttgctgggtttcattttaataccttgttgattttcaccaactgttgctggaagggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttccttgtcctctttggaatgtaacaataaaaataatttttgaaacatcaaaaaaacagaacaaagaaaaaaaacccaaaaacaaaaacaaccaaaacaacaaaaaacaaccggttggcggcgccatcgagcgcccgtgaagaaaggtcttctaaaacccactgcggtggggggcgcgacgcccccaattcgatatcagtaacagttggccccaaccggggtccacaagaagacacccggggggccaaagaaaccgcgggtggactccccccagaaaaagaccgcgggggggaaccacagcgcgctgagacacaacccaaaggggactcggaggcaacacgcggcgcaag

SEQ ID NO: 256762 - DNA, 1672 bp, Homo sapiens
atggtctccacctgaaccttcaaccacttcccctcaattcaccaaacactagccatcttgacctcctttcagttatttgtacactccattctcctttctgcatcaacaccctcaaacatgctatttcctctctctaaagcagtctccccatccccactactttttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttccttgtcctctttggaatgtaacaataaaaataatttttgaaacatcaaaaaaacagaacaaagaaaaaaaacccaaaaacaaaaacaaccaaaacaacaaaaaacaaccggttggcggcgccatcgagcgcccgtgaagaaaggtcttctaaaacccactgcggtggggggcgcgacgcccccaattcgatatcagtaacagttggccccaaccggggtccacaagaagacacccggggggccaaagaaaccgcgggtggactccccccagaaaaagaccgcgggggggaaccacagcgcgctgagacacaacccaaaggggactcggaggcaacacgcggcgcaag

SEQ ID NO: 256763 - DNA, 1838 bp, Homo sapiens
ccagaggcccccttccgtcccggggccggggctaggccaaggcgggcaccaggactgcccagcctcccggcccttcgcactggtaaccggttccggggcggatgctttttgcatctgacccggcgcgcccggtgacgccttcgcgtccagacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgccgatgaatagcgaggggatacctctagaggcg

SEQ ID NO: 256764 - DNA, 1721 bp, Homo sapiens
ccagaggcccccttccgtcccggggccggggctaggccaaggcgggcaccaggactgcccagcctcccggcccttcgcactggtaaccggttccggggcggatgctttttgcatctgacccggcgcgcccggtgacgccttcgcgtccagacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacttacatggtctagcatgtcatctaagccaagttatgaaggatctggctcccctgtgtaagta

SEQ ID NO: 256765 - DNA, 1391 bp, Homo sapiens
ccagaggcccccttccgtcccggggccggggctaggccaaggcgggcaccaggactgcccagcctcccggcccttcgcactggtaaccggttccggggcggatgctttttgcatctgacccggcgcgcccggtgacgccttcgcgtccagacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattaaaaaaaaaaaaaaaaaaaaaaaaaaaagaaaaaaataaaatatagaaatgaaaaatgaaaaaaaaaaaaccgggggggataatattagggggggggagaaacaggaggtaaaaaaggagcaggtgtataatagtgtgtacacgaagacgcatttttgtagagagaggggaaaatgcagggggcccacatatgaggggggggataatatattaaaggaggtgtactctttttttttctgtggagagatgt

SEQ ID NO: 256766 - DNA, 1002 bp, Homo sapiens
ccagaggcccccttccgtcccggggccggggctaggccaaggcgggcaccaggactgcccagcctcccggcccttcgcactggtaaccggttccggggcggatgctttttgcatctgacccggcgcgcccggtgacgccttcgcgtccagacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgtgacaaagtgcatggggaccc

SEQ ID NO: 256767 - DNA, 666 bp, Homo sapiens
gcggccgcctactactgctcgaattcaagcttctaacgatgtacggggagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttccttgtcctctttggaatgtaacaataaaaataatttttgaaacatcaaaaaaacagaacaaagaaaaaaaacccaaaaacaaaaacaaccaaaacaacaaaaaacaaccggttggcggcgccatcgagcgcccgtgaagaaaggtcttctaaaacccactgcggtggggggcgcgacgcccccaattcgatatcagtaacagttggccccaaccggggtccacaagaagacacccggggggccaaagaaaccgcgggtggactccccccagaaaaagaccgcgggggggaaccacagcgcgctgagacacaacccaaaggggactcggaggcaacacgcggcgcaag

SEQ ID NO: 256768 - DNA, 2200 bp, Homo sapiens
ccagaggcccccttccgtcccggggccggggctaggccaaggcgggcaccaggactgcccagcctcccggcccttcgcactggtaaccggttccggggcggatgctttttgcatctgacccggcgcgcccggtgacgccttcgcgtccagacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttccttgtcctctttggaatgtaacaataaaaataatttttgaaacatcaaaaaaacagaacaaagaaaaaaaacccaaaaacaaaaacaaccaaaacaacaaaaaacaaccggttggcggcgccatcgagcgcccgtgaagaaaggtcttctaaaacccactgcggtggggggcgcgacgcccccaattcgatatcagtaacagttggccccaaccggggtccacaagaagacacccggggggccaaagaaaccgcgggtggactccccccagaaaaagaccgcgggggggaaccacagcgcgctgagacacaacccaaaggggactcggaggcaacacgcggcgcaag

SEQ ID NO: 256769 - DNA, 1876 bp, Homo sapiens
agctcagagaattagaaagccgacggggtgctgtggtcaggaggcgcgtgggcggcagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttccttgtcctctttggaatgtaacaataaaaataatttttgaaacatcaaaaaaacagaacaaagaaaaaaaacccaaaaacaaaaacaaccaaaacaacaaaaaacaaccggttggcggcgccatcgagcgcccgtgaagaaaggtcttctaaaacccactgcggtggggggcgcgacgcccccaattcgatatcagtaacagttggccccaaccggggtccacaagaagacacccggggggccaaagaaaccgcgggtggactccccccagaaaaagaccgcgggggggaaccacagcgcgctgagacacaacccaaaggggactcggaggcaacacgcggcgcaag

SEQ ID NO: 256770 - DNA, 510 bp, Homo sapiens
ttttcaaataactatacttttagtttcagaaaaaattacaaaaataatagttcaaaattgttacaggttaagagtttatatgtgtatatatttgtgcacacaaattatatatgtatacccatgtacatgctcagttatatatacatatatacataagcaatttaaatatttaattttgtatactattgtatatacatatacacacacatgtaaaaagtataattggataaataggatctttatagatgagtacgaagttttagggtggataaatcaatgtcatgagggaggacgcaaatcacagagtcatgacattgatatgtttggggataggtatattcatctgatgaagatatgaatatctctcagtcaatcgagcaatcccttttccttgtgagagcgttgatcttgatttcttaattcttttttattggggaaaacacagaaagttaacctagaacaagaatcttatttttattttaatttagggttgcttggctatatttcaga

SEQ ID NO: 256771 - DNA, 495 bp, Homo sapiens
cccatggctgcccatgggccgcaggtactccagcctgaggacacgctttgctctcaagacgtttttgagatggcagagttgacattttgcttttatttcatcctcacaagatgtgaaaaattcacaaatgggacttcttgaaagaatcaaaacttgagaagtaactgagaagtagaagcagctcttaacaagcatcaggggctcagaagaggtagctcttcccagggcatccagcgggcgagctgttccatgtgcctctgaacccagcttcccacttagcagcaggtcttgagtgcacctggcatacagtaagtgctcagtaaatgcatatgaattagaattcgtagtgttcacagtcattagagtgtcccttataagaatgaaaaatgcatttattttcccactgagagggaattcttgttacttctggaatgagtgcccagggcgaatggtggtgagtgtgcagccctcactggtgttttgctctgattctgt

SEQ ID NO: 256772 - DNA, 672 bp, Homo sapiens
  misc_feature (20)..(20): n is a, c, g, or t
gctgcccgctactactacgntccttcatacattccatacatacttaaaaccaagcaaagggtggagttccatctttaaaaactaaacggcatttacacttaaaaaatggaatgaggtgggatccctccttctcaaaaatgtttctagagctactaaaaaacttgcatttacaaaatagttgataaaaatattcccggaggccgggcgcagtggctcacgcctgtaatcccaacactttgggaggccaagatgtgaaaaattcacaaatgggacttcttgaaagaatcaaaacttgagaagtaactgagaagtagaagcagctcttaacaagcatcaggggctcagaagaggtagctcttcccagggcatccagcgggcgagctgttccatgtgcctctgaacccagcttcccacttagcagcaggtcttgagtgcacctggcatacacctgtgcaattctcgtcaacacagaacacctgcctgcccacccccggtgctgaagaccgaccagtcaaggagaggatggctgcattttgtgctcagagttggttgaaatggctacgaagtgtggagaataaccactgaatcccaaaaagtcactgcgcttgatctgatccaagtaacagtgactgcagttagggtcgagagcttctccgaagcagcggtcatgca

SEQ ID NO: 256773 - DNA, 527 bp, Homo sapiens
gaacagaatgaaacataagaaaacagaaacaaacaagtagaagctcaaatatccacacaactaaaagtggcgatgataataaaatctggctctggtgacataagcggaagttgttgtgtggaacgtgcaggaggactccttcaaaaggaatatggacagggagtgcacacttttccagccttcttgtctcattccttcttgctgccaggaacaatgacatgagaactggagcgctaacagccattcagatcatgaggcaacattaaggatgaaaaccacacactgaggatgatggagcagaaaaaacggagagaaggagattttctgaccatcccatggtgccagttgacacacctggactgcctacttctgactctcttgtatttgaaataatacattttgttgtgtttaatcactactattttggattttctgttgtatgcagctgaatttagttctaattgatgtagacaagtctgtctgtaactagatgcatgtggaaaataaaacttttatgggaaaaatac

SEQ ID NO: 256774 - DNA, 373 bp, Homo sapiens
catgggatgccctgcagatacctggggatgtgggtgaccaggcactaatgagcaccctgggcctagcaccctgagctggtgccccatgccccaagacaactgtaggtgctaactaggcagcagtgaggcctgggctggagccacccctgcatagcccgacccctgcaattcactgtttgggaaaattaagctactccgtcaaaaggcaaagacgcccagtctggtgagttaaaagccccctacctgaagccatttcagggtcaacctactgtctacctttaggctgtgcagtgctcatttgcactctacttcttctggggggtgggaaatgattctttacccatcctttggttctttttaaaaagcagctctg

SEQ ID NO: 256775 - DNA, 401 bp, Homo sapiens
ggcaccaccgcttacaggctggatgaattaagacaattttcatagattcccagggcctcagtgttcctatttccaaaccaataatagtcatctttttattgcagggctgttgtataaatttacatatgtaaaaatcaggtgtcaaataagagctattgtgatattagctatagcactaggaaaataaacagtatgttacactgatgaaaattctttgctcatcttacacaggggcaagaaataaaaacttctggcaattgttggtgttgccaatggtgcaacataccatgaagattaaggaaacttagcaacagtgaacttggaccttctaatagctgtctaaccccgagctcatcacttgaaaatgaaaatatcaaataaaaaaaggaaagtataattta

SEQ ID NO: 256776 - DNA, 398 bp, Homo sapiens
aggttttcatcaaattttcaaagggatctgaaattaaacaaacagccaaacaactgattcagagcaagcttctgctgttgcagcagctctagctcactgtttagacctcctcagaatagcgacagcatacagggagcctattagttgtgtaccccaatctttggtgagcctggagggaggtaattgagagggaggcaggggccctgaaaatggagtaggtgttgatgagtgcccataactctccaggcccagccagggcaccattaaccatcttctgctttggcaagaatagtccagatccacctggagaggcttttgggctagggaggactttatatgcagcaggactgcattaatgactttcaggcccttttcctttgtaggctccttcctccata

SEQ ID NO: 256777 - DNA, 717 bp, Homo sapiens
  misc_feature (26)..(26): n is a, c, g, or t
  misc_feature (80)..(80): n is a, c, g, or t
ccgggcgctcctagcggtctcccggnccctgccgccctgccactatgtcccgccgctctatgctgcttgcctgggctctncccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacacccccgcctcgtgccagcagcaggcccggaatgtgcagcactaccacatgaagacactgggctggtgcgacgtgggctacaacttcctgattggagaagacgggctcgtatacgagggccgtggctggaacttcacgggtgcccactcaggtcacttatggaaccccatgtccattggcatcagcttcatgggcaactacatggatcgggtgcccacaccccaggccatccgggcagcccagggtctactggcctgcggtgtggctcagggagccctgaggtccaactatgtgctcaaaggacaccgggatgtgcagcgtacactctctccaggcaaccagctctaccacctcatccagaattggccacactaccgctccccctgaggccctgctgatccgcaccccattcctcccctcccatggccaaaaaccccactgtctccttctccaataaagatgtagctca

SEQ ID NO: 256778 - DNA, 506 bp, Homo sapiens
aaaactgtggtggcagcctcactttagagaatgaggtattaaaaacttgaccaaggtagtcatgccagacttttgaatatttttccaaataagatggcttcaaattgaaaaattttatccacttgatatttttcaaaactataaagctgtgttctatttctacctaaaatataaaattgttagtatggtatgatttgtcatttgagatgatcttggctaatacattactgggcataataatggctattacacattgagaggatagaggctgtttccgtgtctcaagcatcattaactgcagataaaaaaaagttaacagttattctaaaaatatttcttataggggagaaaatgtaatcagtatattgtatgttttagtctggtgtggtggtgcaagcttgtaatcccagcctcccaagtagcagtgactgcaggcacgtgctgccacacctggctaacttctttactttatttctgaagagactggctcgccaaatgagactgcc

SEQ ID NO: 256779 - DNA, 427 bp, Homo sapiens
tcatgtgagcaggttttattttaagaaattggctcgtgattatagaggctgacaagttcgaaatctgtaagacagaccagcaggcaagaaacaggtaaaagctcaagttgcagtcttgagtttgaaataagtatagcaggtcagcagtcaagacactcaagcaggatttctgtgttccagttttgaggcagaattccttcttctgggaaactttagttttgttcttaaggccttcaactggctggatgagctccacccacattattgagggtaatctcttttgtaaggtcaactgattataaatgttaatcacatctttacaaaataccctcacagcaacatctaaacagtgtttgaccaaataactgggtactaaggcctagccatattaactgtcacacatatatctttaatgacattcccacat

SEQ ID NO: 256780 - DNA, 135 bp, Homo sapiens
acaaacactgtaattgaacaccagagcataggctgggagaaccttccattagctgtcacactgactgggtgttcaaaactgcacagtaggccgggtgtggtggctcacgcctgtaaacctagcactttgggaggc

SEQ ID NO: 256781 - DNA, 463 bp, Homo sapiens
tcagaacaaggattgaaatactggtctagaaataagaagttgaaagttaagcattggtatttaaaaatcagtctcaatcaagtagtaaatttgaatggcccagagcttaatatgagctgactgtatgctgatactgctcaaaagctaatgcaaatttaggccagatcatggaacacaaagctcccactgtactctgcactgtccactcattatgtatgtacttatttctgtcttgtttttaaaacatctaatgtgaggcttgtatacctttaacatagcaagtaattttaatttaaaaatatgtaggaaaaattaagaaacactaacatggagtaaattgttggggggacaaaatgaatgctgtgaaatgccatacatatgctggaagtggaccacaaattaagctctaaggtttaggaagaaaatgacaatcagtaaccaagacccagggtgtctgtaagta

SEQ ID NO: 256782 - DNA, 436 bp, Homo sapiens
gatatgctgttaagtaaaaaatgcaaatcaatatctatagtgttgtcctttccatgcaagaaagaagaggaaataagcatatatagaagtatctgcttatttgtataaaacctatacacaagtacacatgggaaggataaaccagaaactaatgaatttgattacctatcctgaaagaatgggggaatggaaatggaatagaaagggtaggagaaactggcacttctgtaagtacatcttttggtatagttctaacttcatacttgaaaaataactaactagacaactgggatgtgagatgggcccaaagctgaatagaaactataacaagtgagtcttaactgtattacaaatgaataacaaaaccaatggggagggtagcccacattactttagcaaacagtaattcgactatatcctcttaaagaataaagtc

SEQ ID NO: 256783 - DNA, 652 bp, Homo sapiens
cctatgacataattttctatggttgtatagcattttatgtggttgtactgtagtttaattagttgatctattattggtcatttaggccttttctaattcttgctgttacaaataacaccacggaatacatttttgtgaatatagtattgtccatgattatttccctggtaggttaatttcttttggggctgtgtgtgtgtgtgtgtgcgtgtgtgtattcagatagccttcataaacggttgtaccagtttacactccaactcacagtaaaaagaaccatccaatctcttttccaaaaaatataaaaatatacaaaatgtaagtcttctgtgtttcagtttcctaaaaatcttaacaaatgccacacattcatatggcacccactgaatgcctgccattgtgcctaggagacagaaatgagtgcatagaattgtaacttgtgcagtgtttccacttggagtagtcaatgccaagttgtccaacagtgtatgatgctacccttttctctgtatccttgctaatacttattagtttcagatattttcatttttgttaatcttggccaaagatacatatgacagaagtctttgttttccacgcccttaaggcattgggatagggtatggaaagggaggtaatccagatggacaac

SEQ ID NO: 256784 - DNA, 408 bp, Homo sapiens
tgagaatataaaggtgcagcacaagggatttcttttgtggtgatggaacagcttcgtatgttgattgtggtagaggttacatctatctatacatgggataaaaatgcatagaatggaggcagggcatggtggctcatgcctgtaatcccagcactttgggtggtcagctaaggcaggaggattacttgaggccaggagttcaagaccagcctgggtaacatagtgagacccccatctctattaaaaaaatacaaaaaaaaaaaagccagacatagtacctggctatgtagtcccagctacttggaaggctgaggtggaaggatcatctgaacccaggaggttgtggctgcagtgagctgtgattgcaccacagcactccagtctggatgacagagtgagactatgtct

SEQ ID NO: 256785 - DNA, 460 bp, Homo sapiens
ttctttgtgtgtgtgaaggaaggcaggtttatttgcaagatgggtttgagggaattaaggataaagtctgctgaaagtagcaccagcctctggattaaaagggatgtttggatgaagcttcaatctcaagaagaggcaagagaaaactaaagaaaaagagacaagaaggtagttgacaagctgtgaacctgcattgcattctagtgatgggacacgtggaaggggaagctgaagttgaagggtggatggtagcagccacagggagtgagatgggctcgtttctggagctgttgggagagaaaaagggagtcaaacgggaattcacacagggttgtgcattatatccaagtgtgtattcagatacaagcctttatctcaataccttccttacccccattccgcacatatctcataccaaagtacaaataaaaccattcccaattgttctaataaaaaaaat

SEQ ID NO: 256786 - DNA, 443 bp, Homo sapiens
atttacattatgatgcaatatgaaaataaaataaataccactctaacattttcaggacatatggcaattctccctgtgctgattttttttaaatgtatctctgcagtattaacatcctctaaatcattctctttgttttagagacaagaaggtagttgacaagctgtgaacctgcattgcattctagtgatgggacacgtggaaggggaagctgaagttgaagggtggatggtagcagccacagggagtgagatgggctcgtttctggagctgttgggagagaaaaagggagtcaaacgggaattcacacagggttgtgcattatatccaagtgtgtattcagatacaagcctttatctcaataccttccttacccccattccgcacatatctcataccaaagtacaaataaaaccattcccaattgttctaataaaaaaaat

SEQ ID NO: 256787 - DNA, 594 bp, Homo sapiens
cttagtattttaaaaacagaaaagtaagtaggaaagtattatttgtaaatgtcataaaaccagatggaggcatattctttactgataaagaaacaggactagaacacgcatgtggtatctccttttacttttgaggaaactgtggttaaagaacattctattctatttgatctaagagcaaagcaaatgatggataatcctgaaatggtaaaagtatttttgtcttaaaaattattcatttgggcaaagtcatttacaacaaaataaaaagtcatacagcacacctatggaagaattaaagaatacataaatgtgctggatacatttagcatcctccagtgagttgtatgtaaggagagtaaactaataaaccaaaatacatatcagatcaactagctatcacttttctaaaacttgtagaattctgaaaaatatttaaagatgggagaaacgaaactgtgctaagacaatgagattggcatagcacagtgaagttggcacaaactgtgatcctggcctgggtttacatgaaactctgctgtgtggccttaagaaaattacttagccagcctgtatcctggtttcttcaactgg

SEQ ID NO: 256788 - DNA, 737 bp, Homo sapiens
tttggtcctatgaacaaaagggagggatccaagagagaagtgaggcatctgggagacgctggggaactaaactactaacctgttgctcagccctgggctgggccatttaacaaatctgcaacttccccctgaattagccttctggattcatagaaatgagccctattttatggcttgctaaatgggaatctcttctggaagaattctaagaatcaagtcaatttatgacctaataacctagtttctactcaaagctacagggtaggaaacgtaagtgacctgaggccaagtgaagctgctttttgcccacttctgctaagatgacacaactttgtgaggaagtgctaagctgaaaaggataatctacagaccattggaaacccctaaagtcaggaaaaagaacaaacccaagatcagccttaaatttcaacagggatatgcgtttgctttaaaagcttttcttactcaatccttagactcccttcccctatatactcttcatttgaaagtaaaacacaataagaatatgttctgctggagtccaaacatttttcagcactgataacttattctagctaatttattagactagattcttaaaaatgtacttaaaaatggctcttcaagacaaggggcaagagttgtgatgccttgttctgagtctgtgtaaggtcactaaccaagttcagcatatttgtccgggagcccagtgattttatgcacgacttcctaaaaag

SEQ ID NO: 256789 - DNA, 409 bp, Homo sapiens
tattattattattgtatttgttggtgtttccatgcttgtactttttcatgcttgtcctatacctcacttttccaatcagagtttaggttttatttctgtttatcatccatacagcatagaatgcctacttcagtattttacagtaaaatgggggctcagtaaatacttaaaactgagactggtcctctcagagagtgaggctccaagctgaagtcttccttcatgttgtattctgtctcacttcttgttttatgggccctgcctgggatgcaggtcaggacaatgtaataggcatgccagggtccaggacagaaagaagaaggcagacactgtccttgacaagttcaggtgaggtgggtgcagtgagggcaagggcagacacgagaagatcaagaagcagtttcactgc

SEQ ID NO: 256790 - DNA, 1035 bp, Homo sapiens
cttcgctgactcctacggccagcggccccgccgggcagacggcaacagtcacgaggcgcggggcgggagccgcttcgagcgctcggagtcgcgggcgcacagcggcttctaccaggacgactccttggaggagtactacggtcagcgcagccgcagccgcgagcccctgaccgatgctgaccgcggctgggccttcagccccgcgcgccgcagacccgccgaggacgcgcacctgccgcggctggtgagccgcacgccaggcaccgcacccaaatacgaccactcgtacctgggcagcgcgcgggagcgccaggcgcggcccgagggcgccagccgcggtggcagcctggagacgccatccaagcggagcgcgcagctcggcccgcgcagcgcctcctactacgcttggtcgccgcccggcacctacaaggccggctcgtcgcaggacgaccaggaggacgcgtccgacgacgcgctgccgccctacagcgagctggagctgacccgcggcccgtcctaccgcggccgcgacctgccctaccacagcaactcggagaagaagaggaaaaaggagcccgccaagaaaaccgtgagactgcgtctgcctcccctcctccgaggggactgagcgggagcctccaggcagggcgagcagtgtcgctgtctgggggccggggaggtggcgaggcgggagggtccttgccggagaggccgcaggggcctgcctgggcgagttcgtccgcggatgctaggccgggggctttttcagcctcactctgtccaaggccagatgaaggaaggaagcaagggctgggagagttgaaaaacaggcagaaagttgaaggcgtgtatatggttttacagggagcattaggtatttaaccaactcagaagcctttagcatcagggatctcgggagccatcaccaccaccggcctttagtgggcttctgaggtctgtgtgcagaatcttcgatgcatccttctatgtgcattcctccccagccctgcttggggcgagggtttgtaacttgca

SEQ ID NO: 256791 - DNA, 239 bp, Homo sapiens
ctattttgtagatgaaagactttttctttagccaataagaaaatgtcaatttctttaaaagccccaataaattctttttcatttatattcagagtgcctattcctagaaaaaggaacacagtgagggatgttagccagagcttccaactacgtaggacatttgccacctgaaaccaagtttaatatggaacttccaatttcatgcctagtttgcccagttctccttcctctaatcctga

SEQ ID NO: 256792 - DNA, 635 bp, Homo sapiens
tatgtgatatgtggaaaactcactgcatctcagtgggccttctgggaggggccagagatgtggtattctgagctgtagatcctgactgtgatacggggctctgtagggaaatcctgtcagcctgtgcccgagttcaaagcctgaactccagtggaatggcgcatatttgagatttcagattcctgggaaacacgaacactcggcaaaggagaagttatgacaacctaactaaaaatggttagaattttatgtctttgtaagaaacttgatgtttccaagtgggttggcaatggtagacacaaggaacaaggactacacttttccataggagcttctaaagtgtgtgaactggcagagattaattatcatcaccagagtcacagctaccgtcctgaggctcgagtctacttttggaaatctaaagagaaccttgcataatgatccggtaccttctatttctaagtaagcaaagtacatataaagaagctgtctccatgccctattttaggatttgacaaggccctccatgtgtatgacaaacacatataaaataaaagatccagggctggatgcagggacagaggatgaattaaatgagtgaagtcaccgaagtctgacagtaaaagctctcatcc

SEQ ID NO: 256793 - DNA, 346 bp, Homo sapiens
cctccttcttctaattaaagaatagggacattctctttcctgctattgattggctgtggtacctcaattttggtccacatattaccatatgtctaaacaagtatgttttaatgtttgtttagggaggtttatttctgttactaaaatttattgggctttgtgcgtgggtttatttttactttaaaacatattttaagacaaagttttattttaagagtgtactggatgacagcttggttggtccatgggtcatttctgtccatgccagaagacatttctttctacctagatcactttcataaagaaataactgctatgacactgtaatacatttacgtacagatgc

SEQ ID NO: 256794 - DNA, 153 bp, Homo sapiens
accacactagtaagatggcactactgatagaaaatgataaggtcacaattattgtttaaaaaaaacctcttctggttcaactcaatttaaataacatctgtattcaactctagaaatataagaaggatgaaatcactgaagactgactgaact

SEQ ID NO: 256795 - DNA, 142 bp, Homo sapiens
caccgccacagccgcttttggggcccgcgacagtggggagttccggagggcaccggcgcccccacccctgccacctgctgagcctctggccaaggagaagccaggcacgccacccggcccgccgccccccgacaccaacagc

SEQ ID NO: 256796 - DNA, 483 bp, Homo sapiens
attaaagccaggcccctaccttcaggaacctcccccaaaaaagcagaacttacagctctcaccagagccctaaccctttccaaaggcaaacaagtcaacatttatacaaactccaaagatgcctatcacatccttcattcccacgctgccatctggcaaaagaggattccttactgccaaaggaaccctcatcactaacagctccccttatttaccagctacttcaggctgcacaccttccaaccaaagcaggacatcaaacaggttcaaataaaatctcaaaaagaagcacgaaagctgataaggcagcaaagaagctctccctttcttctccccctggctctctcctcctcattacccctacaatccaaccccagaattccccactaaaaaaagggctcactactacaacaaggaacctccttcgaaagcaactagataatcaaaaactcatcctccaccaaaaacaaaccaagaaaaaaa

SEQ ID NO: 256797 - DNA, 365 bp, Homo sapiens
ccccgcacattggaaggggggacatacacctatttctgctttaccattctgcctgtcagccattctgatcttcatgaagacacttggcctgctcattcctcagtggttatagtaccagctgcatttctggaagctcactgctggctacaaaatgaccttcaacctccaagtgatccaggcttttcctagcagcttccatcaatgtgcaggggttgaggaaatttgtcgaatagcgacattgaggatatgagtcaaagagagggggagatgatagattcatatcttgaagcatgtggaagtaatctggtttttgtttttgcttttttttctgaagcagatccaggtgtctaaatgtaaccattgcc

SEQ ID NO: 256798 - DNA, 467 bp, Homo sapiens
cacatgtgggaagcaggaaccagcaacgcccctgctgtgtagacgggaaacaggggctgcagagttgaggtgaccgggcagatgtcgaggagctgctcagggcagcgcccgcactcgagtctgggcctcctgactccaggagtgtgctccggcaggacagaggcctccgggtggatgcctcggcaggaagaagacacacgccaggcccttccacccgggacttgcacctgaaccccggccaggactctctccacggccaagctccctccggccgtgtgggctccagcaaagctgggcggcttcccgttggcagctcccgcaagaaccgtgaaaggcggttagtcgccggccgccccgcctctggctcgcagagcaaagactgcactggtgttgacacaaacccttgcgctctcaaccgggagtaggataatatttatttattttttgcattaaaaaaatcagcttgg

SEQ ID NO: 256799 - DNA, 624 bp, Homo sapiens
ccccctacgttattctctttggatccatctctccctgcacttcttgtgatgaggggttctaattctatagagggcagagcagaatgggtgacatggggtctctttgattcctgctcttagtattgtctctatgttatgcttgactaaagagaaccaaaatagatctgggttatttgtccagcccaaggctgagtagctgtcaaactacctcaagacaataacccaaaggagcatcaaacctgagctttgtcagcacctgtacctgccaacaaccaagacaaaagacaccatcaatgcatattaacagagggcagggtaaggccatcaaatcactggattccctggggcctatacaaatgtacaatacaaatcagtaacaaaaaacaggctgatgtgagaatgtagtgaacgtggcagaggcatcaccaaggttccctctcagaggacctctttaacatacacaagttttcaaagacattttttaaagttttaagtaccatatttagttagaagatatatctaattttgcttcccagagttttttcccctaagggatcaatacacatgggataagaatctgctatgtactgtggcagaatacaaaacaggaacacaggccaggcg

SEQ ID NO: 256800 - DNA, 123 bp, Homo sapiens
ttgcttcgggtaacaactagagtagtatttagctaatttgacttttcagaagataagtaaaatgaaataatctttaatcagggtaatatggtaagaacctgtctctacaaaaaaaaaaattaa

SEQ ID NO: 256801 - DNA, 457 bp, Homo sapiens
aacccagatctgctcgatgcccatggcaaagagagcccattacagatggtcaaaaacctcccctcaggcacctcagagcctgcagcacccacccgccaactctaagctgctatttggtgctcagagccccagccttgcccacagaagcatcttttaagcagatagaggaggcctgtccttcctccttgccaccacactgcaccactgtgacgatttctgccatgcccccaaggaacagaacgtagtacagcaagcctgggcagagagtcagaaacacatggcttgggatccccgctccatcccagctctgggattacagggccagtggctccatctccttgggtcacagctttctcttctgtaatagttagcagaacaatatggcacccacctcacagagtagctgagactacagaaatgtataatttatacccccatatgaaggcattcttttaaa

SEQ ID NO: 256802 - DNA, 430 bp, Homo sapiens
aacccagatctgctcgatgcccatggcaaagagagcccattacagatggtcaaaaacctcccctcaggcacctcagagcctgcagcacccacccgccaactctaagctgctatttggtgctcagagccccagccttgcccacagaagcatcttttaagcagatagaggaggcctgtccttcctccttgccaccacactgcaccactgtgacgatttctgccatgcccccaaggaacagaacgtagtacagcaagcctgggcagagagtcagaaacacatggcttgggatccccgctccatcccagctctgggattacagggccagtggctccatctccttgggtcacagctttctcttctgtaatagttagcagaacaatatggcacccacctcacagagtagctgaggggattaaatgacactgatgta

SEQ ID NO: 256803 - DNA, 1050 bp, Homo sapiens
ccacagcacttcagtgttttggagctctcagcatctcaaatgtccaatgggatcaattcgaagttttctatttttaaaggaaaaaacaacaacgacgacaagaagaaacaacaaagcttgttatgaacaacaaaatatcacatggatgactttcacagggatcttggattcccagcctcagagtctatcaggaaagcttttgacagggtttcagaatatactgtgcttagtaaaatgaatttaatctatccatccagtaaattacataacctcttttgttccaagtgcagtttacttacagagacttgctacaccctccagtctcctctcactgaatccggtcaaaccctcctctactgtttaaaaggctgctagtccatcaacaaagattattgaacatccaggggcacattctcatgccagcaaagaatgcatcttcagcgttgtgggttgaaattgtggcccctcaaatgatactcctgtgtcttaatcccttgaacctgtgactgtgaccttatttggacaaataagatccaaattgaattaagctaaggagattgaattaagctaaggagctcagaaatcatcctggacttaacgtgggctctaaatccagtggcagatgtccttataagaaaaaggcagagggagagttcagacactgagacacacaggtcagacagccatgtagacatggaggcagagattaggattatgcagccttcagccaaggaatgtctggaattactgggaactgaaagagacaaggaaggattctcccttgaaggacttcagggagaagaatgtggtgcagaaacaccttgaattcacactttggtctccaaaactgtgagaaaagaaatttctgttgtttttaagccacagatttgttacatcagctctagggaaggaaagccatcaggtaccaagttcaacacctcatgcttggagacatgtctgagatttgactctcctgggtttattggaatcttttttgttttgaaaatcaactctccgactccaaccatcatcaccctaccatgccctgcc

SEQ ID NO: 256804 - DNA, 160 bp, Homo sapiens
tttttttctgtctgacatacccaagcctccttttttcctctttcctctataaacacctactcattgttgagatttcagttcaaactatgctcagtaagttttctaagcaactccccaagtttaggtcagggttccttattaaacctttatacagaactac

SEQ ID NO: 256805 - DNA, 435 bp, Homo sapiens
gcttatgccaattatcttgatttggtcattacacgtcatatatgtaacaaaatatactctatctcataaatatgtccaatcatgtcatgtcagttaaaaaatttttaagaagtaatgaagacctgctccctcaacatctatgaaagccattcaaaacatatctttaagataaatatgaccaatagatcttaaaagtgtatacctgatttcagtacctactcattttgagggtaagactaaagaaaagaatcaggatttttattgtttttttttgtttttgtttttgtttttgtttttcttagagatcttcttgactgttacacaaattgctgtacctcttccctaatagccttactaccctagtgtggttatgaataggggagtgcattgtcaaatattgtcacattcttcccttagaataattgatttctattc

SEQ ID NO: 256806 - DNA, 707 bp, Homo sapiens
aacggaaattataaaactttagtgacatttaaaaataccttcatagaccaggcatggtggctcacatctgtaatcccaacactttgggaggccaaggcgggcggatcacttgctcctgggagtttcagaccagcctaggcaacataatgaaacttctcctcttcaaaaaatacaaaaaattagctgggcatggtggagtgcacctgcagtgttagccactttggaggccgaagtgggaggatcgcttaagccccagaggttgaggctgcagtgagctgagatcgtgccactgcactccagcctgggcaacagagtgagaccttgtctcaaaaaaatagcaataataacagagagctatgtcatgttcatgtattttaaacaatataataatatcataaagatataaattccccccaaattgatctataaatttgtttcttttcctatcagaatcacagcagggtttttcatgaaacttaagattctaaaatttatatggagaagtaaaaagccaagaatagccagaaaaaggaagagcagggcagggaactgactctatgccaggatgtattgtaaatctataatagttaagatgatgtggtattgatgtaaggatagaaaaattaactgatgagacaatatatagcctataagtcaggcctttatgcatatgttatgcatataaaaatttggtatatgatggaggt

SEQ ID NO: 256807 - DNA, 481 bp, Homo sapiens
  misc_feature (10)..(10): n is a, c, g, or t
  misc_feature (31)..(31): n is a, c, g, or t
aaaaaagagnaaaagaaaaaaaaaaaagaangagagaaggaagatgacaaaagaaaagagaagagctaggggtttcgctgctgaattctggactaacagtcggtgcctggggagaaccaaaggactgcataccacactcaagggggcaaagaaagattcatctccatgccaggagcttgaccctggagacagaaccaaatccctctctatgggactggaataacacaccatccaaactctgttcccgtggataagtagaaggcaagcatgccctgtctacttcatcaaagccagttctgctgggcagcaggagagagaagtggaagagggggcggagtttactttagtagcctttaaaaattaaagattattagatgtattaaattattcaaaagtattacaaattaaaaataattcagaattaaaaatctgtatttgtaatgagctttaaatattaaaaaccacagacctccaaatgtca

SEQ ID NO: 256808 - DNA, 487 bp, Homo sapiens
  misc_feature (49)..(49): n is a, c, g, or t
aagatggaatatatgaaataaaaaaaattaaagaaaaatgggagtggangagtgggtatctggggtaaagactgagggtttcgctgctgaattctggactaacagtcggtgcctggggagaaccaaaggactgcataccacactcaagggggcaaagaaagattcatctccatgccaggagcttgaccctggagacagaaccaaatccctctctatgggactggaataacacaccatccaaactctgttcccgtggataagtagaaggcaagcatgccctgtctacttcatcaaagccagttctgctgggcagcaggagagagaagtggaagagggggcggagtttactttagtagcctttaaaaattaaagattattagatgtattaaattattcaaaagtattacaaattaaaaataattcagaattaaaaatctgtatttgtaatgagctttaaatattaaaaaccacagacctccaaatgtca

SEQ ID NO: 256809 - DNA, 390 bp, Homo sapiens
ggagggatggggtgggcccctggaaaggtgaaggccccagatcggaggcagaggcttctcagagcgtgactttcagaagtttgctgctgggtgatacctggtcgtcactttgtggctgtagatactgggtcctcaatattcacatgtaagacagacaccacattccttacgtccctcttatcacctagcctagctccaaatacctacacacttgacttctctgaaagaaaaaatgttcaaggaggattctgtaacctgttgtttccctaatattttgcttctgtatggatgttccaacagatttcacccggtggcatttccactcatctgtatgggagagccctctgtatatgcgggactccccttcctcttccttcaattctgtatttt

SEQ ID NO: 256810 - DNA, 462 bp, Homo sapiens
tactttctgagctggagaaggcaggagcctgaggtatagtggctgggaagagggggtggtggctggtcttcctctgctggaagctcaggaatgctgggccaagtttccaggcctgcccgtcttaggggctgggagatatgtgctgtgttgtggacgctggttcaggggatcagtctctctctgccggtaaggagggactcacagcagcagaagcctgttctttccacagcccaagacactatctttcgtatatgttttgtgaagatttttccctgcttctctattttctgatttttaaaagtgaatcttataagcatttttctttatttaaatacatacaaattatacatttaaaatagaacatggcatgatggaaaagtataaagatttgctaatttatgtctatactcttggacttgtatgacatttctaaatctttataaatatatgttgcaatgaaca

SEQ ID NO: 256811 - DNA, 426 bp, Homo sapiens
tcacaaactttttaacttactctcacagggctggaaaaccccagtgaaggcttttaaaactcatcagacatagaaaaaaagaagcagctttaattgtaggatctcactgacacaaacataaggaaattctgagttatagatacctcacattaagctttttccactgacattgtaacttctgtcaacattcaaagaaaattcaaccctggtcaaaggtgacagttgacaatcctggaagctaacatcctctgtttatttgaacaagtttatactctgcacagggaattgaagttcttcttgtctgtgacttgatctcccaaagttaaagcactacgctttagggttgtgaattctgtttccaagacttaacttcacaatccactcccaaggaaaagtgctgagagaaagtaagcatcataaatgaaa

SEQ ID NO: 256812 - DNA, 444 bp, Homo sapiens
  misc_feature (2)..(2): n is a, c, g, or t
gntcacgcccacaggactggaccctcgcgccgcccgcgactgtggcgtcctggagttgatgggagctgcagcaccaagccgggccagcctccctcccagccagtgacaacaccgcagcacctggaccccgcccacccgcttgagtcctctgcctggggccccagggatgcgcctcctcctgaaagtcccctccatcctcccttagaggaacaggctgccgccgcgcccccatcagcctccattgccctgaccttatttccacctgatggtgccagaggctgcttcccagctggtatcctgagatcctcgttcccttggtggcttggttgtttaagcctccattattgattgggggcggtggtctgggtgtgattcctgtgggggaaaccagcccgaggtgccttggctcaggcttgcctgcctgagtccttgtggcgtaccgtc

SEQ ID NO: 256813 - DNA, 301 bp, Homo sapiens
cggcttgtcatgggctgctggctcagctggggctgatggcctttcctcctcagcaccctggttgaacccgcttcctcttctttcccagactgtggcgtcctggagttgatgggagctgcagcaccaagccgggccagcctccctcccagccagtgacaacaccgcagcacctggaccccgcccacccgcttgagtcctctgcctggggccccagggatgcgcctcctcctgaaagtcccctccatcctcccttagaggaacaggctgccgccgcgcccccatcagcctccattgccctgac

SEQ ID NO: 256814 - DNA, 590 bp, Homo sapiens
taaggaagactcgatttgttcaggtagggggtaactatcaagaagaatatataagaaaagtgagccaaaatgtagaaatactgtgagccattatttggtcttttgtccattattctgtctcctctctttctgggattccgatagctagataggtagatatgcttaatgatatcccaaaggttgctgaggttctgttcatttatcttcatttattttgtttctgttctttagaatggataatttcaattgatttatctatatgttttctattctttttttctacctgctcaaaagtgctgtagaaaccttctagagatttttttatttcagtattatacttgtacatttcagctccagaatttgtttcctttatatcatttctgccttctttatttggtgagacattggtttcatatattcctttggttctttgtctatggctttaaacatatttaagacagttgatttaatctctttgtctagtaaatctagtgtctaggattcctcagggacagttcacattcatttctttttttccctgtaaatgggccacactttattattttttttggaagtctaatatctttttg

SEQ ID NO: 256815 - DNA, 434 bp, Homo sapiens
agagatgtgcagcctgttcaggaacgaacaccaggtggaacaaaagcggggcagaacaagagcatgtgcatcctcttaccaccatgacattaaggccatgtctgcacccggaccaagatgggaagggagcacagagctgtgacttcagggaataggaaggatggcaacagacatggggttctctatgactttccattttatcttccattttcacagtaagttttaaaactctacgtctccagattcagcatgagaaggagaagttccttgaatcctctgggcactggggacagccagtccacccaccctgggtaacaaagggatgtggtcagtcctcacgtgaggagggactgagtgtcctccatggacctgcgacgtcccgtctgtgaggccctcgctactttctgcaaatttctacatggatcagagacagg

SEQ ID NO: 256816 - DNA, 388 bp, Homo sapiens
atcatgcttggttttacagttttatccaggcattttttttcccctaaatattaaaactgccttgattagatgggtgagtcttctgcatttgaatatttgtttgagatggaatttagttgcagtttggctgtgagatttggagaattggctgggtgcagtggctcatgcctataatcccagcactttgggaagccaaggtgggtggattgcttgagtccaggggttcaaaaccagcctaaacaacatgacaaaaccctgactgtacaaaaattagctgggcatgggggacatgtagtcttagatgttcaggaggttgaggctgtaagtgagccaggattgtgtcactgcactccatcctgggcaacagagcaagaccctgtctcacaaa

SEQ ID NO: 256817 - DNA, 407 bp, Homo sapiens
tgagcatcagttcagttagaggaaagagctttaagggccccaaggtgaaaagaagcatggtgcattctctttgccagtggttctcaaactgaacattagaatcttctggaggaggctgggcgcggtctctcaagcctgtaatcccagcactttgggaggccgaggtgggtggatcacttgaggtcaggagtttgagaccaggctggccaacatggtaaaccctgtttctactaaaaatacaaaaaaaagttagccaggcatggtggtgcaggcctgtaatcccagctattcaggaggctgaggcacgagaatcacttgaacctgggaggctgaggttgcagtgagccggaatcatgccacttccctccagcctgggcgacagagcaagactctgtctcaatagaaaa

SEQ ID NO: 256818 - DNA, 599 bp, Homo sapiens
gggagttctgacccgctccctttctgacctgggccagttcagccatccttaggcaacttggtggccccccgctcccaggaggacatcatattgatgccaaacttagtgcgggcacccggtcggcatagggaccagctgttctaaaggtctcttccaacctttgcctttttctttgctgcggccaatttgctctgttgagtttcttctgccattgcggggtggggagggaggcggggttggggccacgtgagcaaaatcccagtgagcactgatgaacacctccacttgcctaccaggcagctgtgtgactgagcccgaggaggcacaactagggcccccatagaatgcagaacaggggcgtggccttaatgctccaagcccattggtcaatgacaaagatgaaagggaaagggggtgtggccaggcagcagtatgtccagagggacctgtggctcacaaggaaagctgtccatgcaactgctgtccccgcctactctgaggggaggggccgccccctctgggagaggggaggggccggcttttgctttaaaagctttaaaactttaaaaaatatatgtgtgtatactttaaatatatgt

SEQ ID NO: 256819 - DNA, 745 bp, Homo sapiens
tggattttgggattgtggctgggcatggtagctcacgtctgtaatcccagcactttgggaggccaaggcgggtggatcacctgaggtcaggagtttgagaccagcctggccaacatggcgaaaccccatctctactacaaatacaaaaattagccaggcatggtgcatgcgcctgtaatcccagctacttgggaggctgagacaggagaatcgcttgaacttgggaagcagaggttgcagtgagccaaaattggccattgcactccagcctgggcaacagagcgagactaagtctcaaaaaaaaaaaaaaaaggattttaggattttttgttctgtgaaaaatgatagtattttgatgggaattacactggacttgtagattgcttttggcagtatggtcattttcacaatattgattctacccatccatgagcatgggatgtgtttccatttgtttgtgtcatctatgatttctttcagcagtgttttgtagttttccttgtagcagtctttcacctccttggttaggtatattcctgagtattttattttatttttttgcagctgttgtaaaaggggttgagttcttgatttgaatctcagcttggtcattgttggtgtatagcagtgctactgtttgtgtacattgattttgtatcctgaaactctactgaattcattcatcagacctaggagctttttggatgagtctttagggttttctaggtgtacaatcatatcatca

SEQ ID NO: 256820 - DNA, 605 bp, Homo sapiens
cctctcctttcattctctctccaactcagtgaggctttccccacaaactccaccaaattgtttctgataagggtcaccaaagactttcattttgctaaactgatgggtaggtcttggttctctcctcacttgctatattagtagcatgttacacaaaaggtcactccttcctttgacacctcacatccaaacagctagagaatccttttgactgtaccttaacaatatcctaaaaatttctcaaggcctccactgctacctccccttcatctctgccaccctcacctctcaccaggatcattgcattatcctcccagctggcttcctgtttctgacctagccactccaacccagtttcctctcatcacagcagtcagaatgatcctctttaaacctaagttagatcactcctttgctcaaagctttccaagagctcctcaattcactcaagcaaaagccaaagtgcttatgtcgtgtaagactctctaggaggtggctctccatgacctttctgacttcagggccaattctttgccttcctcctcctactacagacaaacttgcctccctgcagatcctcaaacagacctgggtgccactgcacc

SEQ ID NO: 256821 - DNA, 654 bp, Homo sapiens
ttggcaaaatgtgtcctgcatttcccacactttctgagctggagcacaggttctggagttagaccacttggctcaaaccttggcctcgttcatggctagttgcctgtccctggacaagttaattccctggtctcatttttcctatctgtaaaatggagtatgcaataatagtactcttaacctcataggttgtggaagaattcacagacacaatggaaataaaaggcctggctcattgcctggcatgtagtaaggacctgataaatgtcagccatcatattattactacatggtattactgcctccccttagatgggagccaagtcttgctcaccagctcattgtctgatgttagtaggcattcaataaaagtatcatgaatgaataagaacatttgagaaagacagcattccagcctttccaggcaatactcgtgtgtgtgtgtgtgtgtgtgtgtgagagagagagagagagagagagagagaaagagaaagaaagaaaagaaagaaagaaagaaagaaaacaaagaaaggaaagaaagaaaaaaaaagaaagaaagaaggaaagaaagaaagagggagggagggagagagggagagagggaaggaaggaaggagagagagagagagacagaaagaaagaaagaaagaaaga

SEQ ID NO: 256822 - DNA, 428 bp, Homo sapiens
agagggggtgtgacccggcctgctgtctgtcatgcactcagcccatgcctctgcatgcatcctctcatgtaatattaggagtgtgggggagtctggagggaggaaagctttcctatgaggatagtggaaggaaaatagtacaaagtggctgggcttggtggctcacgcctgtaatcccagcactttgggaggccgaggcggccagatcacctgaggtcaggagtttgagaccagcctggccaacatggcgaaaccccatctttactaaaaatacaaaaattagccaggtgtggtggcacaagcctgcagtcctagctactcgggaggctgaggcaagagaatcacttgaacccaggatggggaagttgcagtaagccaagattgtgccactgtactccagcctgggtgacagagcgagactccatctc

SEQ ID NO: 256823 - DNA, 362 bp, Homo sapiens
caacaagagaaccccagaacatcctgtgccctacgggacaatcccagagcctcctctcccagcagaaccatccaacaagagaaccccagaacatcctgtgcccaacgggacgatcccagagcctcctctcctaacagaaccacccaacaagagaaccccagaacatcctgtgcccgacgggacaatcccagagcctcctctcgcaacagaaccatccagcgagacaaccccagaacatcctgtgcccagcgggacaatcccagagcctcctctcctaacagaaccatccaacaagagaacctcagaacatcctgtacccgacaggacaatcccaggacctcctctcccaatagagccacacg

SEQ ID NO: 256824 - DNA, 407 bp, Homo sapiens
gctgggtctaatgcagtcatctgagccctttataagggaggactgaacccccctgtgattacgctcccctgtgggagattccccagcactggctgtgcacacccagggagcctcacggcccagacctgggcagcacgggtaggagctgagagcatcctcacggcagcaggcagaacaaacaagtgggcctggggctcacaaccctgaggcattgttgaattctgccaccaactcgaatcggatcgaagccagacccttctcaggtggaggcaacgaccgcacagccagacccatcctggaggtccctcgtgggactctgagcaggaggcagtcacttggcctagcagaacttctgacctgtgagctggtgtttgttttaaataccccaaattggtgagaattcgttc

SEQ ID NO: 256825 - DNA, 425 bp, Homo sapiens
gtttaatgaatgtagggccatcaaaatcctgatgagctatatagaatattttgaatgacccagggtgatatacctgactgagttggaagatttagtcttaattaagaattagtttcaatttagtcagatttttatctgatacgatgccctcataggggagtttgttttttagacatcatttgcaagaaaattgggtgcaagatctcacccacagattttcctatgataggccccacaatgcagaagcaacttgtataagagggtctgttctctctgtgtgcgtccacacaattggattgaattgttaagatgaaatgggattcggccgggcgcagtggctcacgcctgtaatcccaggtaatcccagcactttgggaggcggaggcaggtggatcacgaggtcaggagatcgagaccatcctggc

SEQ ID NO: 256826 - DNA, 523 bp, Homo sapiens
cactaaggtctcaggtttatatgggcacataattgggggcatggcatgccagatgggtcttggaaaatgcaacatttgggtacaaaaacaggagggcctgttctcacttagatctgcgagcacaggcctgaagatgaagccctaacaagggaccctattattctctaccaagcacttccttgtcccctcccgtatcattttcccctctgaagaggcacatctaatcgccgttagaatatacatgaccactggtattagctacttcctgccaatagggggcattgttttgagaaaaacagcagtcagattcgtcccagatgtctacctaagggttcctggcaaaggggagtcattgtccgagacctcagttgcttgcctttttggaatttgatggcctctaggtgtgagaaagaaaaaaaacttccataaggttagatacgcaggggtaaaacatgtattatactagtaaagaatttagtgccaaagatttcagaaataaaaagtgaaatatactaattattct

SEQ ID NO: 256827 - DNA, 402 bp, Homo sapiens
ttgtataatcacttaacagcaatataactaatagaggaaacatcaaaattattttcatcttgtgggtgaaaagcctcttgctgtggttctagaccttcagaaggatgcttgttaaaggagaatgaacttggaaggtggcttacttttttcaagtgggaaggttgaaactaaagaaggttgcaagtgtctgccagcgcatggagccccgggaagtgctttggagtgcccttgcagaggatgaaggtggtccgatgaaggaatcctgcctgagagtccttaccccatcagggtggcatctggttcacgtgggatgctggacctgacttcctgtgccatcacaaccagatgctcctttttccttgaggacctggccacccagaggattccctggtggttctcaca

SEQ ID NO: 256828 - DNA, 444 bp, Homo sapiens
atttatagctgaagggtttttttttttccttcttattgattgttcttgctttttcacacggctccttaaggtggtgaatttgtaaccgaaaggcccaggtgagatgtgcaaatatcactggattggaggagctcacttggaaagccagtattcctcctgagctaatgaaaagaaaggctgtcgtcttatgccaaaagcaataccaaccttgttcacgggctggtaagtttcaaatccaaggaccacggatttcaactccaccctcattgcgtccctcagatctgatatttgccacttgatttctgcttttcaaacgccttttctgcctgtgttacctaaattacacagtaaaggatattggcaagtgtttagccaaatgccccaccctgaggaaataatttttctgcccatatctcccaataaagatgtctatgcctttatagc

SEQ ID NO: 256829 - DNA, 335 bp, Homo sapiens
ctgatttggaatttgaaattatagtgttacatgtatacctatcaaattaaaattaaggaaatacaatagcaatatatagaatgaatgtagtaacagaaattaactctttactgcatcattgaacttattgttagttacaggtttaaaagaagttcatttaacatccagtgtgtctaattcttctggaagtggtgtagtaccattgttcttctggcatttttaaatattaaacctttttggatagatggaagccttatacaaaatctactttattttagcaaggattctctgtccttttgtatagttgtaccttactgttaactatacatgatcaa

SEQ ID NO: 256830 - DNA, 550 bp, Homo sapiens
gctactcccagctgtttttaggtggtggggaaatgggtgatttttatgttattttctcctctatacttatctataatttcaaattttctctttacatattacaagtgtagtttcaacaaggaaaaaaaagtatcatgattgggccgtttagtaaagatcacggagatgctggaggcaggtgagagaccatggctgagggggtccagcaaagaccagaacaggcaaagtgctgcccttttctaatcaaggtaataaatcaagatgcaaaagcctaggggaggtctggtcatgagacgctcagctgagagccgagtttgggaaggcaagggcttcagaagcctcaccttggtggtggcacacctgtcttcctggctccttcctctgccaaactcaccagccctgttgccaggaggaaccttggctccacatgtcctatttcccagcccagctcttccctgtcatccagcagagggcttgtttctgatcttgacatttgcagcaaaaggagaaatgttttcattcctaattgagctgtttacccagagagcct

SEQ ID NO: 256831 - DNA, 275 bp, Homo sapiens
ggtctcagacacttcagtgatgaaggcttgggtcatattactagtagaagcagcagctgggggtgaggggaatttagaaagtatagtagaggagacaatggacaccagctgcagtcctgcgagctgtcgtagtgatgcagttgtagttcattccacaaacctgtcattccaccggatccctggaggagctgctcctggaacatacatggaggatccatgcctggcaaggagtggactgtggcagacaccaagatgtgctactttacccaccttca

SEQ ID NO: 256832 - DNA, 193 bp, Homo sapiens
ccggccgtagcgcgctcctgcctggccagccgcctactccgcccgccccgctccactcggcccagctggcgcgaaggaaactttcctgcagccgcccggcgacaccgcgactccgccgcttcgcaaccctggccctgggccgctcaggctccggagcctttgggatggcagcgcccagcggcccggcccgcgc

SEQ ID NO: 256833 - DNA, 478 bp, Homo sapiens
aacagaggcgccaaatcctccagggtgcttctctgaccccatccacaccctcctccactgcaagtgaggggtaagagcctttcctccgtgtttgatgagcatcttgcatgcatttttatcacacccctaccacactgtatggataatttctgtttatgcatgtctttcctactggactgaacttgaatccaaaaactgcatcttagtccagaatcatattttcgagacaacatttagtagagtgctgcatatttagtaggtactcaaagtttactgaactgtattatccactaataagtataatatgaaaaacatctgatttcacagctgtctgtgaagtggggatgagtaaaacatgggatttgggctgatcctagcgcaagtctcaacagaagtgcaaagcatagactgtgcataaagtgttatgtccaattttgaagtcaggttttaaatgacctgtaactctgcaaaagagggt

SEQ ID NO: 256834 - DNA, 506 bp, Homo sapiens
atacatacttagtggtaactatggttgcagagaaagagaaaacttaaaacaatatgaacatatgtggtcatatagactgaaaacccaccgtgtcataaaaccccaggacacagaacgcatcagcgtagacagcagctgtacagacaatgctggggcggttgtggagtgggattagaagacaggaggcgccatcgagtcagctccaaggccattagccttgtgacgccagcaaaatgtgtgagtggggagcctctacgttctctcctgtgaaatggggatgacagtacttccttgtagggttgtggtaacgaagttattcagcacagagcttggcatgtggtcataacaaggagtggcggataatgataatatggtaacagtaggcatcattgtgagacgggacagagactcaatgtgaaaagtatagaaagggctcttacaaatctccaagcacataaaagtccctaaaagacaaatggcgaagggttcacagttcacagaaacgg

SEQ ID NO: 256835 - DNA, 2536 bp, Homo sapiens
  misc_feature (154)..(154): n is a, c, g, or t
  misc_feature (298)..(298): n is a, c, g, or t
  misc_feature (852)..(852): n is a, c, g, or t
  misc_feature (1067)..(1067): n is a, c, g, or t
  misc_feature (1076)..(1076): n is a, c, g, or t
  misc_feature (1093)..(1093): n is a, c, g, or t
  misc_feature (1099)..(1099): n is a, c, g, or t
  misc_feature (1132)..(1132): n is a, c, g, or t
  misc_feature (1149)..(1149): n is a, c, g, or t
  misc_feature (1152)..(1152): n is a, c, g, or t
  misc_feature (1157)..(1157): n is a, c, g, or t
  misc_feature (1160)..(1160): n is a, c, g, or t
  misc_feature (1168)..(1168): n is a, c, g, or t
  misc_feature (1192)..(1192): n is a, c, g, or t
  misc_feature (1293)..(1293): n is a, c, g, or t
  misc_feature (1364)..(1364): n is a, c, g, or t
  misc_feature (1816)..(1816): n is a, c, g, or t
  misc_feature (1834)..(1834): n is a, c, g, or t
  misc_feature (1836)..(1837): n is a, c, g, or t
  misc_feature (1923)..(1923): n is a, c, g, or t
  misc_feature (1938)..(1938): n is a, c, g, or t
  misc_feature (1955)..(1956): n is a, c, g, or t
  misc_feature (1984)..(1984): n is a, c, g, or t
  misc_feature (1986)..(1986): n is a, c, g, or t
tactcactataaggctcgagcggccgcccgggcaggtgtttccttaaagtgtgtatcaggatctcttttcataaaaatagtattagtcactaacatgttttgagtgcctgtgtgcgccaagcacagtgctaagccctcttttaaatgcataatntcatttaattcccacaactcctagtagggatactgtgataatcgccattctacagatgaggaatttgagggtctgaaagcttcagtaacgtgtccaaagttacacagtggggtaattggtggagacgggaaatgggccgggtgntctggccccacagtctgtgctcttaaccctggtcctttacgtgcatgcagaagtcttgacacactcctgtcttctttcatggacatatgtgaattcttcattaaaccacatatgtgtgaaggagaatgtggggaaggctggtttgtgctaagaactcttctaagtgctggaatgaagtgcacagaagagacccgttccttccattagggagcttaaattctaataaggggattaagaaaataaatacatttttggattcatgatgatgaatccaaaaataaaagagaaagagccaaacatggtggctcacgcctataatcccagcactttgggtggccaaggcagatggatcacttgaggtcagaagttcgagaccagcctggccaagatggtgaaaccccatctctactaaacatacaaaaattagctgggtttggtggccggtgcctgtggtctcagctacttgggaggctgaggcaggagaatctcttgaacctgggaggtggaggttgcagctagctgaggtcgcaccactgcactccagcctgggtganagagcaagaccccatctcaaaaaaaacaagcaaaaaaaaataaaataaaaataaagcagtgaaggagattagatttttaaacggttggtcaagaaaggcctcactgagagggcgacatttgggcaaacacctgaaaggaagggaggagggaggcatttgggtgtcaggcgggaggactttccaggcacagggaccagccgtgcagagaccccgangtgaggcanggtgtagggtgcgtgangaacantgaaccacctactgtgtgtggtgggggctggangacatggatgggcggangangtcangancaaccaancagggccatgcaggtgcctgcgangcacatgtcctcttttcatcctcacggacatcatcacttgtaaatgcttgatcttttccaggcgtttcacacaattcttacttggcagtattatggagaanattgctttgtggaatgactcatgagtaggcttaatatgtcacagtgcaggcttgcccattcattcaagaantgcttagagtcgctgctctgtgttgggcagtgtactagattctgagactacaaacaggattaagcaaatatgccctcttaaggagcttactggttggagggtgaggggataagggggtgtctaagcaaatcgttccaatgaaaactcttggctcttcagattccacctcagctgtcctggcctctctgctgctttgcatttatagtgctgtatgctcattatttccttacatgtctgtctccttctagacggtgaaatccataaggatagagttcagctcttagttattttcatattttccagtgcccagcacagtgtactggttgcacaacaggtgtttaaaaacattccttggcttgatttgaatggagacctgtgcgaagcactgtgtatccacagtaaaggagcaacactaacttgttgtgagggagaactggaggagaggcggtganatttgaactgtttggaangnncctgcaggagttgccagcagaggaggctgctggggttgctgagggtgcagatgtggccttgtcaaaggataccatgtgcttggggnacgtcaaggccagantcagcatgcctggagcnnacgtgtcccggggtcaatgacagatgancntctgcctcgagggaggtagaggctgattagttctaataatgtagacacaaacttgcacgagtgctacatattttttgggaacggatagtagaatgcatgtttaaaataattaggagacagagtgtctggccacttctgttggtgtgaacagtcctaagtgtctccccaaccgccgccttcagaggctggataggtggtgggccatgaagtgaaatgtggaatagagtagcaagaagttttccggaggagaatagtgagtttaattcggggcatgtgaaattggaggaggctacagactgggaagcacctcagaggggtatgtgcatgcctgaggtttaagagtaaaaatatgtagagactaaggaaaccatcagaaaagagctgacataaagatataagagacaggcccagtggctcccgcctgtggtctcagctactagctactcgggagcctgagacaggaggatctcttgagcccaaatttgagtctacagtgagctatgattgcaccactgtgctcctgccagggtgacagagcgagaccctctga

SEQ ID NO: 256836 - DNA, 910 bp, Homo sapiens
aattcaaggtacagataaagaaggtggagcaaaaggagaacaacaacccattagttccccttgggatgtagtttttggaacacaggttcagaggtccaaagaggtgacattttatggatagccatggcagggactcatcagatatgggcactcctgctggactctggcaaactgccaaagaaaaatgagttaacaaaaggaacctgccttaggtttgctggaagtggaaatgaagagaatcgaaacaatgcctatcctcacaaggcaggttttgcccaaccttcaggcctttccttggcctctgaagatccctggagctgcttgtttgtagcagatagtgagagcagtacagtgagaaccgtttcactgaaagatggagcagtgaagcacctcgtaggaggagaaagagaccccatgaatttatttgcttttggtgatgttgatggagtaggaatcaatgcaaagcttcaacacccccttggagtaacatgggacaaaaaaaggaatttactttatgttgcagactcctacaatcacaagattaaagttgtggatccaaaaacaaaaaactgtacaacattagcaggaactggagacacaaataatgttaccagttccagttttacagagtcaacttttaatgaaccaggaggcttgtgtattggagagaatggagaattattatatgtagcagacaccaataatcatcaaattaaagtgatggatttagaaactaaaatggtatctgtgctccccatcttcagatctgaaaatgctgtggtagatggcccgttcctagtagaaaaacagaagacattacccaaactacctaaatctgctccaagcattaggctttcccccgtgactgcgtgtgctggccagactcttcagttcaaactcagattagacc

SEQ ID NO: 256837 - DNA, 622 bp, Homo sapiens
gtggatttaaaatctcgtctgtcccatttgacaggaagcttcttggtgatgtgaaccatgtttacaaggacagggccctacatgtaacagacactccataagtgcttctagaatttaactagaattgaagagttgaaacttgtaccaccagtagtaagttaaagagtggggatgtgtaataatacaaacatgaataacacagagtatgaacattctaaaaattccccttttccctttccacgaaggctcagagacagacaagcagcacgtggaggagataaaattagagagagttacaaagcatgagtgcacaggtgcttgtttgtattatttcaatttgcacatgccatctttgtgtttgtcaactcctgtgagatttaaccaggcatgatgctgaaaacaatggctgatggtgaaaccactcatttccatggagcttccattgaaagaagcctctgtttttttctttcaaagtagtcacattagggagacagtgcatattttaaggatgcagagattatttcacacatatttgagactataaaaaataccagtttatagactacacaaataccattccttgccctgtagttccctcttgctgctgatttaaagttttttt

SEQ ID NO: 256838 - DNA, 1242 bp, Homo sapiens
  misc_feature (822)..(822): n is a, c, g, or t
ggataaggagtggatgcctgtcacaaagctgggccgctttgtcaaggacatgaagatcaagtccctggaggagatctatgtcttctccctgcccattaaggaatcagagatcattgattctttcctgggggcctctctcaaggatgaggttttgaagattatgccagtgcagaagcagacccgtgtcggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgttaaaaacacaaaaaaaaaacggccgaattcgggctcactggccaattggctatatggagccgataccantaatggccgcgttaacaacgcggatgggaaaacctggtgtaccaactaatcgcttggagaaatccccttgcccagttgcgaataacaaaggccccgaccgatggccttccaacagtggccaccctaaggccaagggaattgaggcgaaatattttaaaatcggtaaatttgttaacccgtatattaaccaaggcgaaaggaaaacccttaatcaaggatccccgtatagttcgggtttcaatggcaagggccttttaaacggcttcagccacggggaaacccttttagcgaggccatctgaccaccctctcaagttttggcagggccaagattaggggcctagggcccctttaaattccgctaacccgcaccctaagcggcgggggcctctcctcctcgggagcctcgtcacccccgccc

SEQ ID NO: 256839 - DNA, 710 bp, Homo sapiens
tatccatgtgaggtgttccagactgcagaccggctgggaaatgctaatggatgctctcaggacgattttgcccaggctaggaagttgttctattgttctgtgaactgccatggctaagtcaagctgagctggttctagttccagaaaaactcagggtcctcggcaatggactcacagcctgtaaccctggactccttcctcagcaactggaacctgtcttggtggaagctcagggccaggagggacatggcagcgaagaggtcctgtttgggcagagattggcaggtccccaccctggcaccacagagtgtctggagctgtggtctgcccaagccctcagcctgagctgtgcagatggggagaagccggagctcatcttctctccttgcctcagactcaccctcatgcccagaaccagcagagaggaaataagatcatttcaatctacacaaagaagagcgttcagacacagcagatatcattctgatctatacacttcatgcagtttaacctcctagctttaagttaaaaaaaaatctgaacaggcagctttcccagaaatggtctgcatttcaggggaagaggcaggttaagtgtaatggacgggcaccatttagtgttctcctctttttctgtggttttggatgagtgacatttttggagagagatgagaaatggccatgcttccttattagtgcacttcacgtgaa

SEQ ID NO: 256840 - DNA, 255 bp, Homo sapiens
ccctgcttgtggagggaggcgtagcactgcctatgtgtatatacagccatgcctccagtatggcagccaccaggcacacgtggctactgagcacttgaaatgtggctggtccaaactgaaatgtgctgttaaatacacatgagatatcaaagaccagatatcaaagaatcagtacaagagattaaaacagctcatgaatacattttgtactgattacatgtttaaacaataatatcttatacagtcatgcaccaa

SEQ ID NO: 256841 - DNA, 420 bp, Homo sapiens
cagggaaccataaagatgatagagtttaatgaataacagaagcatcaatcatttttgtaattcatactgtgataaacctttgatattgtaattggaggatttaagtcattagtataactagattttgaaaggtgtcctctaggctgggtgcggtggctcacgcctgtaatcccagcactttgggaggccaaggcaggtggatcatgaggtcacgagttcaagaccagcctggccaagattgtgaaacgctgtctctactaaaaatacaaaaattagccgggcgcagtggcaggcgcctgtaatcccagctactcgggaggctgaggcaagagaatcacttaaactcggagggcagaggttgcagtgagccgagatcgggccactgcactccagcctaggcaacagagtgagacctcaaaa

SEQ ID NO: 256842 - DNA, 485 bp, Homo sapiens
aaatgaacatgtgtcaaagtttaattcagcagttaataaaggaaatagtaaaatgttacaactggttcccataacctgagtctaatcatgagaaaacattagacaaatgcatatggagagaccacgtatgaaattactggcatatgattttttaaatgtccaaattatgaaatgcaaggtaatactgaagaacagcttcagtctaaaagagactaaagagataggtcaactaagtgcaatatgctgtcctgaattaaaaacattcttaggtgaatgctgaactcggagtggtgctgaggagtgaatgttgataatctggtttggatggttgtgtggcagttgtgtgggagactgtccttgtggaaaacacacattgaagcattcggggcagtggggtgttgagtcggtcacttaccctcagtgcttcaggaaagaagttatatactctccatcctctgtaagtttatgattgcttaaaaaaaaaa

SEQ ID NO: 256843 - DNA, 361 bp, Homo sapiens
tgagacagagtctcgctctgtcgccaggctggagtgcagtggctggatctcagctcactgcaagctctgccttctgggttcaagcgattcttctgcctcagcctcccaggtagctgggactacaggtgcgtgccacaacaccgggctaatttttgtatttttagtagagatgtggtttcaccatgttggccaggatggtctccatctcctgacctcgagatccacccaccttggcctcccaaagttgctgggattacaggcatgagccactgcgcctggactagtttttcaaagaattttggactttgttgatcctctctatgtttgtttgtttttattaatttctgttcttattgtttcc

SEQ ID NO: 256844 - DNA, 243 bp, Homo sapiens
tggtttccaatgacaataagtagatttttctgtatccttagattgaccaatccagagcatttggtatagttaaccacttcttgagggggctgctacagttgacctcctttgaaatgcttctgggaactctttgattcttcttttctctcagcttttcctaggtttgtttaggtgattatgatgggatgttggtgttgcttcttggcctgcttcctactctgtatgctgtatttggattcatat

SEQ ID NO: 256845 - DNA, 410 bp, Homo sapiens
aaagttttaaaatttctgccttatacttgaagtgtttagttgatttatatctgatgtagttattgatatgattgtttcagatatgatattttgttattgtattatatttatcagttttctctgcagcttctttcctgtcttctctgtgttaatcaactttttaaaaaatccatcatttcagttcctttattggctttctagctacatctctgttgagggaattacaatatgtatctgctgtggtctaaatgtttgtgtcccctcaaaattcacatgatgaaattctaacccccaaagagatggtattaagtggtggggcaactggaaaattattcgatcatgagagcagagtcctgataaatggtaatagcacccatgcaaaagaggcatgaggcagcttgtttgctccc

SEQ ID NO: 256846 - DNA, 624 bp, Homo sapiens
aggagattaattttggcaactgtattttccccagaatattgcattaaattatcttctacagatatagttgtgggtgtttatgatgacaatgtctattttttaacactgttctgccaatacgacaaaaaacttactttgaaaaatcttatttaggtactaaccagttccaattaactccttcctatatattccatttattctgacaataaaagtgtgtagctcgagcttgttatcataggcaagtccaggatttagtagtatcattcctgtcttagaattgaccttcatgtcattttaatttttaaactattgggtgttctcaaaagcaaataaaggaccaatgtaatatttaaaacacttgacaaatgtaacaaacaagtgacaaattcaaaacagaaaaatctatgtttcattagggtaaaagaagagagcaacatataattagtctgcttaggaaaacacatccacagaatatatgctgcaggagaaatgtaacaggagactcactcatctactgcaaggctttgaaaaatgttggtatctgtaaacaataaagaaagaaaagatattcttctctaattattaaagagatgttcaaccatctgcaaactatttttttaagtt

SEQ ID NO: 256847 - DNA, 420 bp, Homo sapiens
gagtgggcaggagtctggcctggggagggcttaggcctgtgaggattcttcccgaaggcgcccttggaaacagactaattctcagggaaatcagattgcggtaaaatgggatggaaacagacaacattcagatctgcgatttcctgtccttgaaggcccctttcagattacaagttggcaccctctgcccatctaggtgccacagcttcccccaaggacaatagatggtagggccagagaagagaagagaaactgggggagggaggcccagtggagggccatggcacatgacctggttctgccctgccagtgggctcagcccctctccatcctcagccaagcgcctctgagggcacttgtttccccttctcacccatgtttttttgggcgacagagccagactccatctcaaaaaaaaaa

SEQ ID NO: 256848 - DNA, 396 bp, Homo sapiens
caggcaagccgtgggcgtgggctgtggccctgcactttgatggctggctgggtctgggtggcctgcactcattcgcctcctgtctcaccccaccaccacccaagatgaagccatcttttctggctcctccttctttttggtagaaatggtaccagcttgtgtggtctggagggaaaggacttaagggtatgaacctctcagcagccatgatccttataggacttagtgagctatttagaggtatctgagggaatcagagccttgagagcccagtagagacatcactgttgactattcaaaaaggcattatttagagcagggttcacaagctatggcctgtgggccaaatctagctggccaactgtttctgtaaataaagttttattggaacacagt

SEQ ID NO: 256849 - DNA, 412 bp, Homo sapiens
tgcatttctttgaaatgtttgttattttccagcagatgtctgaggctctgttgttatgattagtttttctctgtgttatttgaaatgaaatgattaaactcttttgaagtttattgatttttttttttgtgtccgccctttcaaatctactactgaaccattttggtaagcttttaatttatgcaaaattactttttagatacaaaattgccatttattttttatagtttgcatcttttttgtattgattttttctttttctttagtcactattaatccgttttcctttaacatatttacagtagttgctctgtagtctttatctgtgaaaaccaaatatctagacctgcttgaagtcagcttactttacagtcttttcatctctaagcataaataaaactttgggtttttt

SEQ ID NO: 256850 - DNA, 413 bp, Homo sapiens
tgcgacggagtctcgttctgttgcccaggctagagtgcagtggcgtgatctcagctcactgcaagcttcgccttctgggttcaggagccattctcctgcctcagcctcctgagtagctgggactacaggcgtccaccaccacgtccagctaattttttgtatttttagtagagacggggtttcaccgtgttagccaggatggtctcgatctcctggccttgtgatccacccacctcagcctcccaaagtgctgggattacaggcatgaaccaccaaaagctttcaatttttcacgattaagcatgatattagctatgggcttgccatacatagtctttactgtgttgagatgcattccttcaatgcctaatttgttaacggtttttatcttgaaaagatgttaaacattgttg

SEQ ID NO: 256851 - DNA, 460 bp, Homo sapiens
ggtgaaacatataaacccccaaatgtataatgaaacaaaaaagagggcaatttcttgcttgtataaggtctaaaatgggtttttctcattgacggctggctctcttttcagcaggaattcagatccttttcatctgtgactctgtcattttcaacatgtggcttcaaaagtctgcttcaagccagtgaaaagaaaacaaatatgaagaatagacttttccaggcctggaagtggcacttatgactttcactcacatcccaacagccagaactcagttatatgggaaatgtaatctaactatgtgtccatgaagaacaggacatccgggaagcaattagcagttttttctacaatggtatagcaactggatcagtgtggagaatttacagggcatcaaagaagaaccactcttctttacccaacatggtggtgtaggtacactagaaactcttggtggagg

SEQ ID NO: 256852 - DNA, 472 bp, Homo sapiens
actaattaggtttgaacttgccagagagaaagtggacattggcagcctattgtataagagtgaaacaaagtttgaactagagtgaacttaatttcctttgcactgaaaggaaagaaagattaatgaaatatccccaaatccatcctgttagtttttattaaatcagcaaatgaaatttaacctccaattctgctataacgtcctttcctgcagattgggtttcagcaagcctaagtgaaatagacacactccctctagaacaacatttcgatatgaaaattgcattattgccgtcaacatcaggttacctgaggaacaagccacttggaaaacaattaattccacaaagagcagaatgacacatacattgcctcaaatttacaagaagcacaatgttctgattacagcatttgtgtaagttcatttcttacctctttgctaatgctaataaaaaaccagttgaaatttatgt

SEQ ID NO: 256853 - DNA, 340 bp, Homo sapiens
catgaggagggtgctctcctgggatgacagcgtcaggaatggacctgaggggcctcttgagctgggcacaatccacagtgctgctatcccacttcacagccctgtgacaattcacaagtcagttagttattcctaaactgttactttttgaattaaaatacacacataaaagagtgataaaaacatttttcagaaaaatggcatttttccaagtggcttacctaaaaatgcccttagcctgaattgcatatactgtgttataactcagaattttctcattttgacatggtcccttcttattttataaagataataaaagtgatcattttatatcatcaaa

SEQ ID NO: 256854 - DNA, 288 bp, Homo sapiens
ccatttcccaatcacaggccctaatcaccctatggcccggtaccagataattcaggacatttccattccccatgaggattaaaagcctgctgaaaccattcaagctagccactcgtaagcctgcttcccctcctttgtccttttcttcccatagaaactgtaataaaaaggctcttacccacatttcctcctcactccctctgcccctgacccaccgtgccatgcctggcatgtggtacctccagtttctatctagctatgagtaaaacaaacttctttcttcatgac

SEQ ID NO: 256855 - DNA, 404 bp, Homo sapiens
tgcggatgaaatggatgatttaatgggtcatctctcctgtagttaatttctctagatctcttgtgctatattgattttgtaaatagctattgtcacatctgccccttctgcctgtgggaactagtgggtcttaaaaaattgaattgggtgagagtgtagattaatcaataccaagatttattgactcgggacatttatattaactgttgtgaagtcaagaataatttgaaccttttcaatacttcattaagtggcatagtgtattatctatggtgtattttgaaagtatccttcctggatttggtacagctctcacctcgacttcctaaaacggctccctttatttgtcaagctattaggatttatattataataggaatcacatcaaggtacttttcaaaggc

SEQ ID NO: 256856 - DNA, 242 bp, Homo sapiens
ttccgttcaaggatcttttcacggtctttgtccagttttagcctagtgataaccaccttgctggggtgaatgcctacgtggacagttgtgccattagccttttcccgctgcacccgttcaatgtagataacatatttcttcctgtaaacctggactactttgccaatttgctgacctttatagtgtccacgtacaacctgaacttcatcatcctttcggatgggcatggatcacacgttgta

SEQ ID NO: 256857 - DNA, 347 bp, Homo sapiens
tttttatttaaaattttaaaataattaagatgggggggaggatttcaggtgaagaccggaaatcccatacagtgctgaaaaggtggaaatcaccaagaaaacaggccacatgtaatgccaccacccattgctatgtcgataaacatgcttccaaggaagttcatctcagtattatttgtaattagcaacaacaacaaaagaaaagaagctaaatattgacattgcagggttggctattaataagatgagacatggatgctgttgtgtaactgggctttccataatgggtttccattgtgattggatattcccctttaagaccaaatctgaattgttctgttctgctc

SEQ ID NO: 256858 - DNA, 497 bp, Homo sapiens
ttaaataaagatgcatggctaagcaaatagaagacctaagtgtcagaacattgcaataattttcacatatgcacacatactcccagaaaccaaggcggctctttaatgggaagcattctttatgcaaatgaagaaactaaaaataaaatggaaagttgccaaacttttaccacaaacttcacaccacgtttcagagactgagaagcaggcaattttccttgctgtttttccctccctcttttggctctttttttaaaacataaactgcatctttttgcagtgaatttgaaaagtataatgagcaggctcattttttccctctgttcatggaatctggtggaaatatactaaataaggcatgaaattaaatgaagtattggtgagtttctttatatgttgtaaattatctgggagaattaagtttcaatctctaatgtttaaaagccatgaaatagaaagtgttgtgtatgggagaagcccaagaacctttctctatt

SEQ ID NO: 256859 - DNA, 673 bp, Homo sapiens
tcccccgggctgcaggattcggcacgagaaaattcttaaatattatactggaaaatatttcccagcgtctctcaactaattcattacaatcattaggaagtaaaattgcaatagcaactagtttattttgactgaatcagttggtgaattcagtcatgcaatccataatcatggttaattaaattttaaaatattcaaattgggtttatatgctcctgtggccaatgcttactttaagtctccctttgttcagttccaacttccgctctgggaagtttctagtaataggcacagagctgtaacagagcatgctgcagacatctcattaggtcttagacggacctgctgagccaaataggaacccaggttattacacttcttttaagaactggggccaggtgtggtggctcacgcttgtaatcccaacactttgggaggctgaagcaggtggatcacttgagtttaggagttggagaccagcctgaccaatatggtgaaaccctttctctactaaaaatacacaaattaactgggcatggtgttgggtgcctgtagtcccagctactcgggaggctgaggcaggagaatggcgtgaaccccggaggcggagcttgcaatgagccgagatcgagcactccagcctgggcgaaagaacgagactccgtctcaaaaa

SEQ ID NO: 256860 - DNA, 506 bp, Homo sapiens
agcccccgccccagctgcgcgggcccccgcctggcccatggactgcacagccgagcgggcgccttgagcgcggtgcgggtcctcggagcacccccgaggtgagcgcaagcaaggtccggcatcatgtgctaggttattcccagtgcgaggccacacttgggccgtcggagcagcccctcctcacttcaggggtcaccctccccaagacccattgccccatcatggccggggaccggctccccaggaaggtgatggacgccaagaagctggccagcctgctgcggggcgggcctgggggggcctggtcatcgacagtcactccttcctggagtacaacagctggcatgtgctcagctccgtcaacatctgctgctccaagctggtgaagtggcggttgcagaagggcaaggtgaccattgtggagttcatccagccggccgcacgcagccaggtggaggccactgagccacaggacgtggtggtctatgaccagagcacgcggccgc

SEQ ID NO: 256861 - DNA, 391 bp, Homo sapiens
gtaccttgatcttggacttcctagcctccaaaactgtgagaaaaaaatgtctgttgctgcaagccacccacctcacagtattttgttatagcagcttgaacgatgatcattgacttaaatattttagaacacaagccttcatgagcggggaacagaaaaaagaatcgcatgctccactcctaatgctccctctcagaatgattctgtaaacaaatctgactcgactttcttaagtcacattgaagttttcaaataatattggattttaaaggccaagagtccacatcactttgaaggacttatttaatagctattagtattactatttcacttaaaatgtaacctttcacatgcaattatgacttatttcctaaaattgagcatttgtatt

SEQ ID NO: 256862 - DNA, 300 bp, Homo sapiens
ccataaccccatggccaggcctcctcctccctcaggcatttggtttattcagagcatcccaggcctgagactgcctgcccccagcacccccctctccctgcagcatggccctctctctctcatctcactgctgtttctacccggcctgttcctggcctccagactgaacatcccactgtcccctcagtgcccacagaccctccctatcctaaacctgctcagttgcagctctcactcctgctctttgacctcattctcatctcagaaaatggcatcgtcccctcagcacgtgcgcgtgta

SEQ ID NO: 256863 - DNA, 363 bp, Homo sapiens
gcacagtgtacctccaccttcctccttctgcttctgtttttgggagttcagtcaaagctgacatgttgcccaagactagaggggagagtttggaggccggagaggatggccaggtcctgggtgtggaggttgcttcctgcccctcctcctcccccaccacaggggcctggagaagactgacagcagcaatcacagtcacattccacagcctctccagcacccagccagctctccgcgggggcagcagggactggtccacccaacaacagcagccatgtcctcacctcttgctacagcagcaactttatttgatttgatgtatatgaagaaataaaactcagaagtcaattgacttaaacatgg

SEQ ID NO: 256864 - DNA, 2500 bp, Homo sapiens
cccagacacctgctcactcaccaccagctgggctccgctgggcctgcccggcacccaccccggccaccaagggcagcagcttttccagaatttggctggcaggcctagtcaccccacctcgccacctcaccactgcacctcggaggccagccctgtccactccactctgtgcctggcttctcttgcctgccttgggccttcgtgtggccctccacggtgtctgggactgagtgcccctcttgcctcctgaagagcagccatggccacctacaaagtcagggtggccacaggcaccgacctcttgtcgggaacacgggactccatctcactgaccattgtggggacacaaggagagagccataagcagctgctgaaccactttgggagagactttgcaactggggcggtgggccagtacaccgtgcagtgccctcaggacctgggtgagctcatcatcatccgcctgcacaaagagcggtacgccttcttccccaaggacccttggtactgcaactatgtgcagatctgtgcccccaacggccgtatctaccacttccccgcctaccagtggatggatggctacgagaccctggcactccgggaggccacaggaaagacaacagcagatgactcgctccccgtcctcctggagcacagaaaagaggagatcagagccaagcaggacttctaccactggcgagtctttcttcctggcctgcccagctatgtgcacattcccagttaccgccctccggtgcggaggcatcgcaaccccaaccggcctgagtggaatggctatattccgggattcccaattctcatcaactttaaggccaccaagttcctgaacttaaatctccgctactccttcctcaagacggcctccttcttcgtccgcctggggcccatggcactggctttcaaagtccgcggcctgttggactgcaaacattcgtggaagaggctgaaggacattaggaaaattttccctggcaagaaatctgtcgtctccgagtacgtggccgagcactgggcagaggacaccttctttgggtaccagtacctcaacggcgtcaaccccggcctgatccgccgctgcacgcggatcccagacaagttccccgtcacagacgacatggtggctccgttcctgggcgagggaacgtgcttgcaagcggagctggagaaggggaacatttacctggccgactaccgcatcatggagggcatccccaccgtggagctcagcggccggaagcagcaccactgcgcccccctctgcctgctgcactttggacccgagggcaagatgatgcccatcgccatccagctcagccagacccctgggccagattgccccatcttcctgcccagtgattctgagtgggactggctgctagccaagacgtgggtacgctatgcggagttctacagccacgaggccatcgcccacctgctggagacacacctcattgctgaggccttctgcctggccttgctgaggaacctgcccatgtgccaccccctctacaagctcctcatcccccatacccgatacaccgtccagatcaacagcattggccgggccgttctcctcaatgagggggggctctctgccaagggcatgtccctgggcgtggaaggctttgctggggtgatggtacgggctctgtcggagctcacctatgacagcctctacctccccaatgactttgtggagcgtggggtccaggacctgcctggatattactaccgcgatgacagcttggcggtgtggaatgcactggagaagtatgtgacggagatcatcacctattattacccgagtgacgcagccgtggagggtgatccggaattgcagtcttgggtgcaggaaatatttaaagagtgcctcctggggcgggagagctcaggcttccctaggtgcttgcgaaccgtgcctgagctgatccgatatgtcactatagtcatctacacctgctctgccaagcacgctgctgtcaacacaggccagatggagttcaccgcctggatgcccaacttcccagcgtccatgcggaatccaccgattcagactaaggggctgaccactctggagaccttcatggacacgttgccggatgtgaagaccacgtgcatcacgctgctggtgctctggaccctcagccgagagcctgacgacaggcggcccctgggacacttcccggacattcacttcgtggaggaggccccgcggaggagcatagaggcgttccgccagcgcctgaaccagatctcacacgacatccgccagcgcaacaagtgccttcccatcccctactactacctggacccggtgctgattgagaacagcatttctatttaggagcgcgcttcccgtctctcctctccccattctgtgccctactattttcaacaaaacaaaacaaacaagcaaaaaacacaaaaacctcagagaccaaaacaccaaacaaacaaaaaaacaaaaaaccttcctttc

SEQ ID NO: 256865 - DNA, 428 bp, Homo sapiens
tgctgctgcggtgattctagaggatcccggcacatctggcccagagcaggattgttcctggaggtggggtgggctgggtcaggggttacaggggcacttactgggatcctagaggacctgaaggggttccagggatgcctgtccggctccaggatctgcctccttcctcacagggcatgtccctgggcgtggaaggctttgctggggtgatggtacgggctctgtcggagctcacctatgacagcctctacctccccaatgactttgtggagcgtggggtccaggacctgcctggatattactaccgcgatgacagcttggcggtgtggaatgcactggagaagtgagctcaggacagcagtgggtggctcttagggtggacaacctgggatgttggagagggtgtggggagcttctagagaactgag

SEQ ID NO: 256866 - DNA, 2356 bp, Homo sapiens
cccagacacctgctcactcaccaccagctgggctccgctgggcctgcccggcacccaccccggccaccaagggcagcagcttttccagaatttggctggcaggcctagtcaccccacctcgccacctcaccactgcacctcggaggccagccctgtccactccactctgtgcctggcttctcttgcctgccttgggccttcgtgtggccctccacggtgtctgggactgagtgcccctcttgcctcctgaagagcagccatggccacctacaaagtcagggtggccacaggcaccgacctcttgtcgggaacacgggactccatctcactgaccattgtggggacacaaggagagagccataagcagctgctgaaccactttgggagagactttgcaactggggcggtgggccagtacaccgtgcagtgccctcaggacctgggtgagctcatcatcatccgcctgcacaaagagcggtacgccttcttccccaaggacccttggtactgcaactatgtgcagatctgtgcccccaacggccgtatctaccacttccccgcctaccagtggatggatggctacgagaccctggcactccgggaggccacaggaaagacaacagcagatgactcgctccccgtcctcctggagcacagaaaagaggagatcagagccaagcaggacttctaccactggcgagtctttcttcctggcctgcccagctatgtgcacattcccagttaccgccctccggtgcggaggcatcgcaaccccaaccggcctgagtggaatggctatattccgggattcccaattctcatcaactttaaggccaccaagttcctgaacttaaatctccgctactccttcctcaagacggcctccttcttcgtccgcctggggcccatggcactggctttcaaagtccgcggcctgttggactgcaaacattcgtggaagaggctgaaggacattaggaaaattttccctggcaagaaatctgtcgtctccgagtacgtggccgagcactgggcagaggacaccttctttgggtaccagtacctcaacggcgtcaaccccggcctgatccgccgctgcacgcggatcccagacaagttccccgtcacagacgacatggtggctccgttcctgggcgagggaacgtgcttgcaagcggagctggagctcagccagacccctgggccagattgccccatcttcctgcccagtgattctgagtgggactggctgctagccaagacgtgggtacgctatgcggagttctacagccacgaggccatcgcccacctgctggagacacacctcattgctgaggccttctgcctggccttgctgaggaacctgcccatgtgccaccccctctacaagctcctcatcccccatacccgatacaccgtccagatcaacagcattggccgggccgttctcctcaatgagggggggctctctgccaagggcatgtccctgggcgtggaaggctttgctggggtgatggtacgggctctgtcggagctcacctatgacagcctctacctccccaatgactttgtggagcgtggggtccaggacctgcctggatattactaccgcgatgacagcttggcggtgtggaatgcactggagaagtatgtgacggagatcatcacctattattacccgagtgacgcagccgtggagggtgatccggaattgcagtcttgggtgcaggaaatatttaaagagtgcctcctggggcgggagagctcaggcttccctaggtgcttgcgaaccgtgcctgagctgatccgatatgtcactatagtcatctacacctgctctgccaagcacgctgctgtcaacacaggccagatggagttcaccgcctggatgcccaacttcccagcgtccatgcggaatccaccgattcagactaaggggctgaccactctggagaccttcatggacacgttgccggatgtgaagaccacgtgcatcacgctgctggtgctctggaccctcagccgagagcctgacgacaggcggcccctgggacacttcccggacattcacttcgtggaggaggccccgcggaggagcatagaggcgttccgccagcgcctgaaccagatctcacacgacatccgccagcgcaacaagtgccttcccatcccctactactacctggacccggtgctgattgagaacagcatttctatttaggagcgcgcttcccgtctctcctctccccattctgtgccctactattttcaacaaaacaaaacaaacaagcaaaaaacacaaaaacctcagagaccaaaacaccaaacaaacaaaaaaacaaaaaaccttcctttc

SEQ ID NO: 256867 - DNA, 419 bp, Homo sapiens
cacacagaagtctcagagtcttattcaagatccactttagaacagctttaaatttcctgcattccaagtctgagatatccaatgaggtccagaatctaagaccactgtgcccagccgtggcttcattttctatagaatgagagcagttgctaagtttttaatacattttcattaaaactacattttttcaacttatgaatagtggttatggagaaagatagaatcaacttctgttaatttttatgcaaaaatctgccattgaattgtccataatatgtttctcaaaatatcatttataatttattatgtgatttagacccaagctaaatataaattaacttcattaactatgtacattatcatgacactgttgaattactttcacagactgacaaagcaaaattaaaaataaactctgt

SEQ ID NO: 256868 - DNA, 335 bp, Homo sapiens
gcagaaaatgttaaattaaacaacaaccaaagtgtctgcaaagctcagcaagagatcaagtggagaagacgatgggtcgctttcacttttgcatgtgatgaaattctcatctcagccctcagccctgaggccctctcatcgctgctatgtctgggctgcacgcttccccaagccccaagtcaagctgcctgcctgcccaggcttctttgaattccatcagaattcagaaacacctcgctaaatcaggaacagtcaggggcacagagacaccacgccaaaaggcaggcagatagcaagtcccggaatcggggcaaggataacttcagagtctcatc

SEQ ID NO: 256869 - DNA, 673 bp, Homo sapiens
caggtctcctagccccttgctctaattggcctcctcaccattcccctctctacacacagctcattttcctgcctgcttcaaatgccattacatagccctctgtacacgtggaacaatttttgtcttccatctacatattatatatccttcaaggcccatctcctctgcagaccttctctgactgctcctacatacatgggttcctctgttttctttgatttttgttgaattgcgggtagcatcttaccaatcctgtcttaattatgtttgtgtttgtttcatgattgtgcatcttgtctcctctagctgaagggtgaggattctaaatcagtggtatggtccatggttcattggtgtgactcattttttaagctgtaacaaacagtttgaaggggcatagttcatgtgtctcagcaaagagtgatctatgctctaagcttcttactataaaaccaggggaatcccagcctcaggtacctctctctcgtcgcagggtcccaggtgttcccctttgctgctagaagcatgtcagatcagtgccccaagatcatctctgcagtgcttggtctttgctgctgtaggttgtaggccttactgcaataggtctttgacgttgatcagtgctcagtaaacacctttcaactttctttctgggaattgttcatttccatgg

SEQ ID NO: 256870 - DNA, 559 bp, Homo sapiens
ttcagtttaccacacaagctgttgttccttgattaactgttatgaaaatgatagctatgttctatgactttaattttactaaaattctgagatgcaaaataatattcagtctatattatttgcaggagaatgattagctctgcagagtagtaggaagtaacaaaagaaatagagggcattggaactgtcttatatagcaaggcacatgtatggattggggcaggtttgtcctgtgccagctttttgtactacttaatcaagtggcctgaaatcaactgtgtatgcctgtacaagttatgacttctgacacatggaggtcacttgaaatcaaatagaggtacaatcaagttctggttttaccttgtactagtgctgtgatatatgcttagttgctttactttcctgagttttaatttcttcatctgtaaaatggtggtaataacagtcaatgtgaatgtaaacgagaacatatatgtaaaggggcctctcagtttatacaacaaagtcattgtttagtaaatgtgaatacttgccccaccaataaatatctgttacatgg

SEQ ID NO: 256871 - DNA, 479 bp, Homo sapiens
ctttggcaactgcaccccctcttccttctccttttttttcaatctaatatgtgggacataccaagtgatgagatcctttctggcatcctaagaaaatgccaactatagaacaacagatgtagtctccttattaagtctgaagaccaaacttcttagtgcaaagcagtcaagtcttttctcaacatgaccccaatcaagcttttgaacttaacatcaaaatataacttcagaagaacgtttggaatagagctcagttcaaactcttcctattgcaaacgaggaaatggctacagaagcagagtgcccaaagaatgcgaatgcaactggcttcatcttgaaagcgacactctgaagaaattacccataatttctccctcttggacatgcagaattatcctgttcttgtatttttctggccagcttctccaactttccctttcttgtttgcaactaattaaactttatggataagaaaaaaa

SEQ ID NO: 256872 - DNA, 183 bp, Homo sapiens
ctaaagacacactttaagctaaagagagtgcagtggtctggttaagaagtaacaaaggtataaaccagtgatgccagtggaaatgaaatgaagtaaatttaagtaaatgtaagaaggcagactgttaaaaactgattattaattagaataaaaaaatttatttcccaagaagcctcttgcttc

SEQ ID NO: 256873 - DNA, 440 bp, Homo sapiens
attcttctctttcctctggactcacagctggaccacataaccttcccagctttccttcccaccttttccaaacgtgattgggttttggccaatggaatgagggtggaagagagggtcccactatcaggtctagcccataaaaatctcacagaaaattctcctccatactctttttccttccacgaactgaatggaaacgacttcggcgaacttggaagtaatgtattgaaaatcggaaactctctatcagcctgaatcttttatccctcttcaccatcctatctacccagaaacccttgcaaatgttaggtaaccacaaaataaatgtgtatgtgtttaagcaaaaacaaaacaaaacaaaaagcacagccaatgttgttaatagaaaaataatttaaaaataaataaaaaatgtccacttaaggacagacttgatgaaa

SEQ ID NO: 256874 - DNA, 340 bp, Homo sapiens
cttgatttttttaggaggcatttgtaaagtgcagctaagtagattatttccagcttgctgctgctgctcattttcttgaggttttttttcatccatgcattcatgaaaattttcagagtagttgaattcaattgactcctgctgacagcaaggggacaaactactaacaattttatacttcataaaattgaaaactactcctctgagtactctagaagggctgtatactagagaaattggaagtgacttggccaaatctcccagtaattgtgacttaaattcaggtttgccagattctaccattgtgctttcctgtaataatacattgagtcagaatgat

SEQ ID NO: 256875 - DNA, 317 bp, Homo sapiens
actacagaaatgactatgagccttttcacattatttatcctgcagtttcattctgtcccaggtatatgacgtctatatattttaactttacttgagatgttattatatatattttgtgtctttctatgtatatattttgagacagagtctcactctgtcccaggctggagtgcagtggcatgatcttggctcactgcaacctccgcctcccaggttcaagcaattctcctgcctcagcactttgggaggccgaggcaggacaactgaacccaggtaattgagaccagtctgggcaatgtagcaaaccccaactctag

SEQ ID NO: 256876 - DNA, 1811 bp, Homo sapiens
gtccccggggaggccggggcgcggcgtgcacgctcctccgcgcagctggcgagccgcaccgcccccgcggcacctccatgcgcccctggcctgctcgctagtcgctgtcctccagaggattcagcaggaccgttcctcttcctcagccgcgagcacgtgcgcgggggtgcgcgcggaggtcacggtcactgcggggctcagggaaggaggcgccgtgcctgcaggacttcccttcgcttgggcgcaagccggcgattagcctggtcccctaggacatctccagggctccggggaacctctcctgcgcaggcttggccctgcctcctccaagcgtccgagtctttttcggcttttcgtgagcctcagagagggacgtttcctgccaacgctgctgcgaaggaaagtttgggcggcgttatcctgactgccttcctcgccagcgccggcgagcagcttggggacacagccgacgcccgggcatcctccccgacgaccccccggagcgctcccagttcagactcctttccgagaagcgcgcagaagtgacagccccggagcttcgttccggtgtaggtgtggggatgcgccgcaaggcaggaggggaaggcgctccagttgaagggggcaccccggggcccgcgccgactcctcccggcgcagccttggctcgccggagtcgcgggtcggaggctggcgccgctgcccgccgaccagcaccctggcgccaggcgcccggctccacgccgcacccttggcgacgctgtgcgaggggctctagcgcccgccgcggcgcagtctcgtgaacccccgctccaattttttcctacggaggcgcagaggagggtgaattcgcgctctccttcccgacgccccggcttctgggagcgtcagagcaacggaagtacgtacaggaggaccgagagcagcagggaagtttggcggtgggctgggtcggcggcgaagattccctgccgtgcgctgccccctcgtggccgctttgcgttcccgtcgggaagggctgggttccagtccagggcccagcacaaaccaggattggttggacgctgcacagcgagttcagtcagggctaacatcagaagagtcgtggggggcctgcctatcggccagcctgtccttgtggtttgtgaagttgtatgatctttctgttattattaaggaaaaaagtagtatttgttgaggctaaaaggccaagagcgtgctatatattatttaatcctctaaacagctctgccagataattattttatttatttatatttacttccatagctttagacaggatctcgttctgtccggcaggctagagcgcggggtgctatcacggctcactgcagcctcaaactcttgggctcaagccatcctttcacctcagcctcctgaatagttgaaactacaggtgcgccaccacgcctggctaaatttttaatttaaattttttgtagcgacagggtctccttatgttgcccaggctagtctcaaactcctgggctcaagagatcctccaacctcatcttcacaaagtgctgggagtacaggcgccagccacggtgcccaacctgtgataattattttaaactcattttacaaatgaggaaagtgatattcatacttgtaaagccattggggctgaattttcatttttgtatccacagaactaacacataaagtttacatgccattagaatgtaagctctctgtaagctacagatcttttctactgtaatatccttagtgcctagggcagtgactagcatatagtaggtgttcaataaatatttgtagaattaatg

SEQ ID NO: 256877 - DNA, 304 bp, Homo sapiens
gaaataatcccgtccatagtgttcattactccttgccacacacttgacttttcaatcccgttaccctagttgtttctaggacatggcagttcctcccctcctttctgctgcctttaccacctccgcagcttaaacaatgactgaacattcccttgtctccagtggcagttatagatactacgctgtgctgtagtgatcgatgcagatgtcttctttcccttactgaactaagctcattgaaacatccaccctagctggtctttgccatttatagagtaggcacatggtaaatatctgttgagta

SEQ ID NO: 256878 - DNA, 333 bp, Homo sapiens
tgtaaatatgtggtggacccatatgataaaccccaagaaggcaactgatactatggcttacactatacccatatacccaaatggttcctttttccagagtaatatgttatgatatgggaaattatcccgaagcccggtaggatgagctcacacacaaatatgtcacttaggcaaatactacctgaaaaatgtttgaaagctatgacccaaagtgttctttactcagaccagctgccagtgaaatcatggttataccctccaattaatcaaatgacaattctatgtttttttaactgggtaagatgtgtcaatggtaaaaactccagacagaac

SEQ ID NO: 256879 - DNA, 972 bp, Homo sapiens
gctaatttaggagtacttgtaaagcatccaggtaaggaggatcctagtccaagctcaatttatctagtgagcctatctagtcagcctatcctacactaaggttatgggggtaggggagaggcactttttatcaaatgtaccttgacttcttcaacagaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaattactggatgagtcttccgttttattacaaaaatgaagatcagtttgatcaaaatgaaagcttgttcacaagttttacatgaatattctaaatacaaagtctcctgaaacaacatacttttgatatgattttcatttttaaagggatgcaaacattccattttc

SEQ ID NO: 256880 - DNA, 408 bp, Homo sapiens
  misc_feature (30)..(30): n is a, c, g, or t
  misc_feature (35)..(35): n is a, c, g, or t
atctagaggatccggtcgacggttgacagnaagtnttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccac

SEQ ID NO: 256881 - DNA, 1826 bp, Homo sapiens
gtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaattactggatgagtcttccgttttattacaaaaatgaagatcagtttgatcaaaatgaaagcttgttcacaagttttacatgaatattctaaatacaaagtctcctgaaacaacatacttttgatatgattttcatttttaaagggatgcaaacattccattttc

SEQ ID NO: 256882 - DNA, 2196 bp, Homo sapiens
gtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagaaaagacggggtgtggcgggggtaggtgggcgaggaacctgggatgcaaaccagtgtttggggccaggagtggctgtatggtttcagaggcgcccaccactctgggtttgagggacacagcaccctcgtctcggcgctttggattgtcacgcaccagaccacggggcggaggaatggagtggcatccctggggggagttaagacacacgaggtttgcagtttcattttgtttcagaatcagtttggccataaaaatggactgggttggggacaggcggagcgattgaaccaccggagatgaggaggaggtggcaggcgcctctcctggggtggggactgagggctgtggagacagtaccatggtgaaggaccccatggcaatgggagtattgcactgagccaggtttcgggggaacggggacgtgtcgggatggcgtagggggacagagcctggcaggagacacatggaagtttccgccttgtcagtctcagagcaaacgccttttagtctttacagtacaggaatttggacactgcccacgttctcagtggacagcagccatcagaggtgacccaggagggaagtgggcattggtcaccaaggtatttacagacttctatcatgggggacagcggggtgggtccagcagcctccctcgcgggggatctgagggagaccgagttcgctaaatattataaataggtcttgccgtcctcctgcccccgcccctcggcacagtcagtggagcacgtcagcctcggtttacagttctctgaaaaggaaccaaaaaacacaaccaacaccaagtatatctccaaaggggccttggagacaacacaagaatggaaatgaaatgctcgtgcc

SEQ ID NO: 256883 - DNA, 1354 bp, Homo sapiens
gtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccac

SEQ ID NO: 256884 - DNA, 1510 bp, Homo sapiens
gtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccaccgtgacggcaggatggcggggaatataagcgcaaggaaggacaggccctcaacagggatccccaattgggatggctttggaggagctggggggcatccccaatgggaacacttaggtccccacagaagtttgccccaaaaacgcccgggtggcgag

SEQ ID NO: 256885 - DNA, 1484 bp, Homo sapiens
gtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccacaaaaaaaaaaaaagaaaaaccccggggctttttgcgggggggggaaaaggggtttcagggcctggcatcggttcccggcccattctggcaggggatcgcggtccaaagggggaaataaacgcgaaaaagc

SEQ ID NO: 256886 - DNA, 1716 bp, Homo sapiens
tgtgtttgcagctgcattgtgtgtttgcagctgcattgtgtgtttgcagctgcattgtgtgtttgcagctgactcaagtcaccacagtgtgcttgctgtataaatgttattttttgtgagtgttgacaggaaaaagtttaggatgaaacactgtgttcagtacataacactacagttgcagtcttgtcactaattcttgtaaataccgaatttttaaaaaatctcttactttttttgtaacaaagagtataaactataggctttatttcttcttcagtactagtactactgaaaacacaactgctaacataaaaggatcgttttctaattttagacacttcttactcgggagaagttatcttgattacccagcttttttccttatagtttttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaattactggatgagtcttccgttttattacaaaaatgaagatcagtttgatcaaaatgaaagcttgttcacaagttttacatgaatattctaaatacaaagtctcctgaaacaacatacttttgatatgattttcatttttaaagggatgcaaacattccattttc

SEQ ID NO: 256887 - DNA, 1787 bp, Homo sapiens
gtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaagtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaattactggatgagtcttccgttttattacaaaaatgaagatcagtttgatcaaaatgaaagcttgttcacaagttttacatgaatattctaaatacaaagtctcctgaaacaacatacttttgatatgattttcatttttaaagggatgcaaacattccattttc

SEQ ID NO: 256888 - DNA, 1773 bp, Homo sapiens
gtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaattactggatgagtcttccgttttattacaaaaatgaagatcagtttgatcaaaatgaaagcttgttcacaagttttacatgaatattctaaatacaaagtctcctgaaacaacatacttttgatatgattttcatttttaaagggatgcaaacattccattttc

SEQ ID NO: 256889 - DNA, 1914 bp, Homo sapiens
gtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaagtatccttttttccccttcataattaaagttgaaaaaaaaaaacaaaaaaaacaaccacaacacaaaaccaaaaaaaaacacacaaccacaaaacaaaacaacaacaacagcgccacacccaccaccaacacgaccgagcggcccccaaagcagagagcaaacacagagagaagagcgaaacggagggagacacaaagaagagaagaccaacttgtatagacgaaggaggcggacgaaagcaaaacagcgggcagaaagaggagaaagcacgaggaaaaaggggacaaaaatacaggaaaagagagcgcctgaaagaagacgaagcacaaacataatgaggagcgaccaaccaacgctgcaaaacaatacagacgcgagccaaaagaaaaaatatagaaacacaggtcaacgagtgtaacttaaggagaaaccaaaagagaggaagagatagcaacgcagcaagaacagaacatgaggaacagaagagagagacgaaaacagacacgatataaaagccaggggacacagaagaagaaaaaaagacgagaaaccaaaacgacgaagagcagaaaaacagagaaaacaacgagaaagtagagacaccacacaagagacaagccagccaaaagaaccagccgagaagaaagaagagggtaagacaataaaccacgaggcaagcgacgaaagaaagacgaggggtaaagacgcagacaaagcagaaggagaagagaggaaccgcgaaacgagaggagagaggaggaagaggcgagaagcagaaacgaggagaaaagagaagaaagaccaacgcaagagaacgggaacagagaagacgcagaaacgaagcgacaaaaccaagaagcgaaacagacgagaagaagaataaagcgacggcaaaagcagca

SEQ ID NO: 256890 - DNA, 1114 bp, Homo sapiens
gtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaagtctaaaatactttcctacagctgtgtaaaatactggtcaaggagaactttttccttttacctcatgttgtaaacttaagtggctcaataaaaattgatccac

SEQ ID NO: 256891 - DNA, 1301 bp, Homo sapiens
gtaaggagtcctgatgttcaactattaaatctttattataggttatagactggactttaaaggcatagctgccttaaatgtgggtaatggttgataaatgtcgctaccatcagaggtcgcttcacaaggtgtctaattcagaatcgaagatctctagcggtcttctactcagtcgactgcagagacgaccgcggtaggtttttcaacccggactcaacaaagaagccctcatagcacagccttgacgtcactcaaagacaggccccaatcccgactgctagagcagaggcccgcccctcgacctccgtgagtggccccgccccgccctagggggcggggcgatgccgaactgcggcgggctggctcagtaaagcggaggcagcgggggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccac

SEQ ID NO: 256892 - DNA, 880 bp, Homo sapiens
  misc_feature (30)..(30): n is a, c, g, or t
  misc_feature (35)..(35): n is a, c, g, or t
atctagaggatccggtcgacggttgacagnaagtnttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccactgtcttgatctgactgtgatttgtttggtgttaatatattattgttctgattagggaattggaactaaggacctcatcaaaccagggagtaactcccagtaaaattatctggacagattgcctgtataatgagaaggcaaaagcataaggcttgaggggaaacaaaatgctaaaagcagaaaaatcttggcaggaagatcaagacctgaatttagaaaaggtgtacttcaaaaccaatgagccactaataaaggtgaacataaggttaatattactaattgatccccccaaaataaattcataaacaattactggatgagtcttccgttttattacaaaaatgaagatcagtttgatcaaaatgaaagcttgttcacaagttttacatgaatattctaaatacaaagtctcctgaaacaacatacttttgatatgattttcatttttaaagggatgcaaacattccattttc

SEQ ID NO: 256893 - DNA, 829 bp, Homo sapiens
ggctcagtaaagcggaggcagcgggggaagatggcggcggccgttccacagcgggcgtggaccgtggagcagctgcgcagtgagcagctgcccaagaaggacattatcaagtttctgcaggaacacggttcagattcggtaccagaggcgtaggggcggccgggctggtgcggctgagggacgcctcacccccctggagatgcccatacattccgtattcctctgtgcccccgccctcgtcttcccgcggccggtggcctggaaggccggagaggcccagcttgtgctttggtgcctcgctcccgcctctcgggcgttctctactggggcaggggagcagctttatttcttggggcacacaggctgcaattgtagagttagaacctcattgggatccttgagtgggggtggaggccagaaaaataggaacccgaggatattgggggctagggcggagaggccgaggaatagtggtgtggatgagactcctgggagcggggcgccggctactagggaaatgggaagggatgtgaagatttctgtgggaacggtgtatccaacttgcttttctcaacagtttactaaatactgaacattaatgcgtgtgatttttaaaaaatccgtaggttgtggtttaagttttgatttaacatatcgaccctttaaatgaccttttcacctttatactttaagggagctacatgcacatttctcttgtgcagtggtctgtcattgttataaacagactaagaaatttatttgaaatgctttatactgtaggctctccatttgtcagcatagtctccatcttaaccatccgtctatagtc

SEQ ID NO: 256894 - DNA, 1650 bp, Homo sapiens
agtgtgttatcattgggcagaactggatcctgaaaaattcaagatgctaagcacctacactactttaagaatttggaactgaaacatgaagaggaagacagaaataagaatttgggaacctgaatagctctgcaaaaaacaccaaaggaccgttttatcgttttctgttgttgctgtggtggagtgatgcagtgggcactgccggtgggccagggggcgggtgcgcatgtggtagaaggtgtgcgctcgtgcctcccccacagaaaggctttgttggtttctaccacatcttggcttgcttttggaacaggctggcccagcatcatttgtcatcaagtccactgtggtgtattctgcgtgtccatggcgggggttctccaatacactcacactgtccatgttctttttattgccagggcccgagttgaagtgtcaagagagcaatcatcaatgataatgtattgtgtgagacctttgcatcttgtaaattttctcttttttctaaaaataaataataataaaatccggaagatggcggcggccgttccacagcgggcgtggaccgtggagcagctgcgcagtgagcagctgcccaagaaggacattatcaagtttctgcaggaacacggttcagattcgtttcttgcagaacataaattattaggaaacattaaaaatgtggccaagacagctaacaaggaccacttggttacagcctataaccatctttttgaaactaagcgttttaagggtactgaaagtataagtaaagtgtctgagcaagtaaaaaatgtgaagcttaatgaagataaacccaaagaaaccaagtctgaagagaccctggatgagggtccaccaaaatatactaaatctgttctgaaaaagggagataaaaccaactttcccaaaaagggagatgttgttcactgctggtatacaggaacactacaagatgggactgtttttgatactaatattcaaacaagtgcaaagaagaagaaaaatgccaagcctttaagttttaaggtcggagtaggcaaagttatcagaggatgggatgaagctctcttgactatgagtaaaggagaaaaggctcgactggagattgaaccagaatgggcttacggaaagaaaggacagcctgatgccaaaattccaccaaatgcaaaactcacttttgaagtggaattagtggatattgattgaaatagcagtgcttcagctctaaggatattagcaacaatgataaaacttggccttgaagaaatttacacaactagttagaacttgttactattgtaaaggaagagtcaactggaaaattcaaggagttaataaaatttgtttacttggtcccagcttttgagagataaatcccttatgaatccctggtctaaaatactttcctacagctgtgtaaaatactggtcaaggagaactttttccttttacctcatgttgtaaacttaagtggctcaataaaaattgatccaccgtgacggcaggatggcggggaatataagcgcaaggaaggacaggccctcaacagggatccccaattgggatggctttggaggagctggggggcatccccaatgggaacacttaggtccccacagaagtttgccccaaaaacgcccgggtggcgag

SEQ ID NO: 256895 - DNA, 457 bp, Homo sapiens
atcctcctatatggatgaatttcttgtgacaggcagatcagatctaaacagaaatccggcaaggtattttatttttaccattgtggcattgagatttatttcaaaaataagtgagatcaactatgcctatatttttaaagtttactttcataattaatccttttttgaacacttagaaacactcttctggctcttgtagcaaagtgtttccctgacgactgctgccaaagcagacggaagcagagactatcaggtatatcttaaaccttcaaaaatccagctgcactgtctcaaagaatcctcactgccaaaccatacttagttaaaagtaccaataatctgaagttagagcaatatattttgacaaacaatttatctagacagctaatgttaaaggttaagtatgtttgaggtcgacgcggccgcgaatttagtagtagtagtagtaggcggccgc

SEQ ID NO: 256896 - DNA, 693 bp, Homo sapiens
aaactttagatagagcatctacaaagtcttcctctggtttttatttaagccttcctttattatgtttacttcattgggttataattatctgttcctttattcatctcccgaactctcccaactgaagtgtgacatttcttagtttcaaggataaaatacagtgtctggtgcaaattaggccatcaataatttttccctggattacattttttagggacacacatggaaaaaaacttttttttttccctgggaaagaaatggggttgaaaccaggaaaagcttcagaaagtgggtaaggaaatgcatagaagcagaaaattacatgccacatttgggggtagcatgacaggaagtaaccagaaagttaaagtaaaggctggttgtggccaggtaatgaaaaaccaccaatgtcctgccaagaagcttggactttctcccttatgcaatgtgggagccatcagagattttacaacaaaggaggcaaaaacaaggtctggaaggcagaaaaatcactctagtagctggtaaagaaatggaagaaagaggaaaggcatcaggaaggggtatcaagtcaaaagcagctacaatggtatgattgagaaaagaggaaagaggctgagctggttatgacagcatagacagagagacacaatgtggattcaagagacattaatgagaaaaagtcagtaggac

SEQ ID NO: 256897 - DNA, 678 bp, Homo sapiens
agtgatgcatgtggggtttggtgctgggtggaggggaagatgcagtaggccaagaaaagcctctaccttccaatcttttccttttgggctgacaggtacgtttcaagggaaattgaatctgcacatttcagcttcatttgcacttaacacatctggctggcagtgggcaggaggcttttgatgtctgcgtttcggtgcccaagcctttttaagcctcttttctttgaagccagggagacttgtgtttctgccaaggagtaaacagacttgtacaccctccagcaatttagtctttggagacctggctcccaaaggccctgggggctggaggccccacttcttcatttgttcagcctacaaacacttattcaagacttactgtgcaaaagcttccccaaaactgcctttcataggaagggtatagagagaaactctggcagatttcacaatcaaactcaccaagctcatttgtctaagaagcaagggaagggagtctatgtcccaccaatattttctagagtgactttagctccccgataatttcatcagcctctctaccttcccacccacctctaaagtcatcccttgctgttcttatttgtaatgtgggcaaattgatgatttctcaatgtcatatgaagtgtgaataaagcacttgagaaagtgtggctgttttta

SEQ ID NO: 256898 - DNA, 444 bp, Homo sapiens
ttttagaaagctcgaatggccatattaatatacaataaaatagacttcaggatgatattaccagaggtaaaagggacaattgtccaggaacatataaggcataaaactgtgtatgtccagtaatagagcttaaaatacgtgaagaaatattgacaggccaggcaccatggttcgcatctataatccctgcactttgagaagtcaaggcgggaggatcgcttaagcctaggagtttaagatcagcctgggcaacatagtgagaccctgttgctacaaaaaactaaaaactagctgggcgtggcaacacgctccggtagtcccagctgttcagaaggctggggcaggaggatctcttgagcccaggaggttgaggctgtagtgatctatgactgtgccactgcactccagcctgggcaacagagtgagagcctgtcttaaaaaaaa

SEQ ID NO: 256899 - DNA, 994 bp, Homo sapiens
gcccgtgaggaccgcagaagtgatgtgatgtgacttcagagactaggtcatcacaggcgatacagcttccacctggttttctggagatgctcttgcttggatgtcagctgccatgctgtgaggaagcccaagccgcccagggagaggttctcgtggagaaaaacaagagcccagaaccaacttggcagccacgtggactgccatgatggtgtgtgacttccacggtgaggtcataaaagacattgcaacttcctccttgctctctcttggaacacttgctcttggggaagccagccaccatgttacgaggatgctcaagcagcctgtggagcagctcacgtgggtgaggaatcaaggcctctagccaacagccacaagggagcctcctcagcagtggagcctccagccccagtccagccatcagatgagactgcagccccggctgacatcttggatgtaacatcatgatcgaccctgagccagaaccacccagataagccactcctcaattcctgacccacagaaactctgagataataaaggtttgatgtttaagccacaaagttttggcatagtttgttatgcagtgatagattactgacagtcagcaaatctttccctgacccagtaggaagggatggcaggtgcacagtggggatctcatacccggctgtggggaaatcacaggaggcttctcagggtaacctttgttcacccaaggggtgttcctctgagaggcaggttacacctgggctgtcagggatgatctgtttgaatccacaaaagcatgtacacctagaggacctggagccatgccattcaggccaaattcttggttcacctgcagcttgaccaaggctgcaggctcagaaaaactgaaagcagtaggcacactggctttggaatcaggccaccagctgtgtgaccctgcgtgcactgcacctcctctctgggccctttgtgcagtaaataatttaatcttgcctaaaaagag

SEQ ID NO: 256900 - DNA, 433 bp, Homo sapiens
aggggttgggggaatatttttcctactgttctcaggcctcccttgaccaccattaggacaatgttcctaagtgaccattgtagggtcagtgtgggggttctgaaatatggctctgagaggcagagtctaagcccttgagtgtggatggacttagtgacttgcttccaacaaataggactgccatgatggtgtgtgacttccacggtgaggtcataaaagacattgcaacttcctccttgctctctcttggaacacttgctcttggggaagccagccaccatgttacgaggatgctcaagcagcctgtggagcagctcacgtgggtgaggaatcaaggcctctagccaacagccacaagggagcctcctcagcagtggagcctccagccccagtccagccatcagatgagactgcagccccggctgacatcttg

SEQ ID NO: 256901 - DNA, 423 bp, Homo sapiens
agctgaatgtgcactgggaccgcctgttctctgtcttttctttctctcttgagttctgagccccagagagcaggctccctttcccgcgcgccctggcgcctactggagcacccgggcccagcgtgtcctcgccccttgtctccggcagggggcagtctttcaaaagcattgattcagatgctgggggagtgagggtagacaggcccgagaaagagaaggggtggggaaggggcgaggagccgaagtaggccgaggcttgagggcagggccagggcgggggacaggctggaaggggcctgtgagaaggagaccctgagctgagaaagctcagccgggtaagctgagacgggcaggtggcagtaccccagcccccgccacctcctgctcttaccttcattggacagggatcagatacctggccct

SEQ ID NO: 256902 - DNA, 505 bp, Homo sapiens
cctgcaggaaggaagtcttcagttaactaaagaagagttaatgtcctagaagagtattctaggcagagattacagcaaatgcaaaagctctcaagtgggagagtacttggggtgtttgaggactatcaaggattgaagaggctgttgtggctggagggaccagggcagagtgaggattctgagaggtgaggtcagagtgcaaagggccttagggctgggcgaaggttgtcacgcctgtaatcccagcactttgggaggcagaggcgggtggatcatctgaggtcagaagtttgagaccaccctggccaacatggtgaaaccccgtctctattaaaaatacaaaaaattagccaggcatggtggtgcacacctgtagtcccagctactcaggaggctgaggcaagagaattgcttgaaccagggaggcagagttgcagtgagccgagatccgagatcatgccactacaccccagcttgggcgacagagcaagactctgtctccaaa

SEQ ID NO: 256903 - DNA, 350 bp, Homo sapiens
ctctgagacagagtcttgctctgtcgctcaggctggagtgcagtggcatgatctcagttcaccgcagcctccatctcccaggttcaagcgactttcctgcctcagccttccgagtagctgggattacaggtacccaccatgacgtccggctaatttttgaatttttgttggtagagatggggttacactgtgttggccaggctgatcttaaactcctgacctcaaatgatccgcctgccttggcctcccaaagtgctgggattacaggtatgagccaccatgcccagcccatagatattctttatcaagttgaggaatttcctctcctactttatcaagagggttttctt

SEQ ID NO: 256904 - DNA, 190 bp, Homo sapiens
tgttcataactgtgtgctcacatgcatagtctgttcacgaatagagggaacactgttaggacctggctcttcagccttggttctcaaacctcagcgtgcctgagaaccacctgaggagcctgtagaaacattaccggggcccagccccagagtttctaattcagaaggtctgggggaggagggaagaatt

SEQ ID NO: 256905 - DNA, 440 bp, Homo sapiens
agaccatctttaaaaagaaaaaataatcaggatatatcaatcctctcaaagacagtgcagaattgttagaagacaaagtgatgtttttaaaaatttgagagacaatatttccaaccagctgaatcataaacatatagtaaacatgaaagaataacttcaggtaagtaaaggcttgtaagtactacttcccatatatttgcttagtaagctattaggagatacactcctataaggttgaaggactaaatatgaaagtgggagtaataagatccgtgaaacacatcttccattttagaaaaatctcataacgaagttttacagttataatggaaggaagttctagatggatcattttatataaggctcagggaacaaacttccaaatggagcaaaagaacaaggtaagaggtctggcacgtggagttaaaaaaataacaaca

SEQ ID NO: 256906 - DNA, 440 bp, Homo sapiens
aaaacttacatgtaaccatgctcactatttttaaattttttcaaattttcaaactatatgtgggtaacctcatgctattaccataaaagtatctgctgaccttacttcttcttatttcctgaggatattcatatattaccttaaaaattgaatggtaagccaggcgtggtggctcatgcctgtagtcccagcactttgggaggccaaggcgggcagatcatgaggtcaagagattgagaccatgctggccaacatggtgaaaccccgtctctactaaaaatagaaaaatcagctgggcatggtggtatgtgcctgtaatcccagctactcaggaggctgaggcaggagaatggcttgaacccaggaggcggagattgcagtgagccaggattgcaccactgcactccagcctggcaacagtaagaatccgtctcaaaaga

SEQ ID NO: 256907 - DNA, 480 bp, Homo sapiens
ttttgtttttgccctccctcttttgcaattctaattgaacgtagacctttttactccctttcatgtcttttaacctcttttttctgttttccttttctttgcctctctgtgctgccttcagattatttcattagaactatctgtcagtttcctaattctctttttggctttgtctcatctgtcattagaaatatctactaggggccaggtgcggtggctcaagcctgtaatcccagcactttgggaggccaagaggggggatcacaaagtcaggagatcgagaccatggccaatatgatgaaaccccgtctctactaaaaatacaaaaagtagctgggtgtggtggtgcgtgcctgtaatcctagctactcgggaagctaaggcagagagaattgcttgaaccagggagttggagcttgcagtgagctgagattgcgccactgcactccagcctggagacagagcgagactccctctcaa

SEQ ID NO: 256908 - DNA, 444 bp, Homo sapiens
cctgtgtggctggcccaactgcttaggagcccgtctacctgcccgtaaactggagtaaagccagctccttgttctggatccagaatcccccaagacgtggccatttgtctcaatgtcaccaagcttcatcttccaacttattcacgggccggctccaacaggtcccaacaatctagacacaggctggtaagccattcccggctgctagaggcgccagggctgggagttggaaaaatgggtcacaggggcagccttcattccgctaagtggggccggcccttggtggaataatattaaacagatgcaattcagacctaagttgtgaagcccacagattgctaggctaacttgaaacaagatggtttttgaggataagtgttatggaaaagccagtttgtttttcaaacttgatgctaaaataaacgtgaaggccttcacatgaac

SEQ ID NO: 256909 - DNA, 454 bp, Homo sapiens
aaatcaaataaatgtaaagatccaacttcgtttatctctttcctctctttgaccatagtccctcgagaccgtagtctgctgcctagtccttctccttcaggaatccagtcaggtatttgtcaacctataccttctgaaaaataaaagcacctttagaaggcttagaggcacagaccttcaaatattgtctctgtagcaaagtctccaaacttttaaagtccgaaaataccaccctttgaatttctatcacttctttagtttcattcaatcagttgcagaaatatttcctttttttattttttttgaagacagagttctactctgtctcccagaatgtcatggcaggatcatacctcactgtaaccttgcatgcacgggctcgagcaatcctgcctatgagtcccagttgagtcccaagtagttgggactacaggcatgccaccatgactggcta

SEQ ID NO: 256910 - DNA, 428 bp, Homo sapiens
atgttgccttctcattttataaatgtttggatgaccccatctacattgatgatttaagtatcatctattagcccacgactcccagatatatatctctaactcacactctccatatggccaactgcccttgaataatgtccacttccgactcactgttacacagttccctgtgttgggagatggcactttcatctatccactcacccaaacgcctgggaatctacctagattatccattctccttcaagtctccttcaacccctggaagtaagtgataatattaattttgcaccccagatatctctcatacctgcctctttctttctatgcttgctatcactgctagcatgatttattcctgagcatctcttatgtcttagatagttttaccttttatggaagtggctctcaattatcactgtaaagca

SEQ ID NO: 256911 - DNA, 543 bp, Homo sapiens
tgtcttcactggctttcttccctgtgcatctgcatctctgcatctctgtatctctacgtggacttctcataaggacagcagtcattggatttttgctgattgtaatccagcatgacttcctcttaatttgattacatctgcaaagactatttgcaaatgaaggcacattcactggattcactggtgctgggggttaggacttaataatagctcttggagggacacaattcaacccatgatgggtctaaacaatgttttataattgatataaaagctaaaccatgttttcttaaaacaactagaaacttctaacccagtggcaactttgggtgtgcaagagagctcaaagcaaactctcagtttcctggcaagagaggaggcctccactctgtcaccccatggagactcctccttgatactgacattattgcaatacatgcaaaacacacaaaaaaatcaccttagagtttgggaaggatgaggatatttaatggcagcaatataagtaattttttttgcctctgcatatactcttttttaatt

SEQ ID NO: 256912 - DNA, 546 bp, Homo sapiens
gttctgggaagaccattgagttctgcctccccaccggctctgccccatcaaagaaggaagggctggcagtgtccaagggcagggaatgtctgctaggttgacggctccagctggtgctgccagcccaaagctcgctgggccacgcaagccgagagagtgagctctagggtagcagtctgcagactttttctgtaaagggccagattgtaaatacttcaggttttgcaaaccttgtggtctctgttgtaactactcaactctgctgttgtagcatggaaggagcaatagacaatgtgcaaatgagtatgtctgtgctccagtaaaactgtatttacataaagaggtgacacgtcagatttgacccacatgccatagtgtgcagactcctgccccagaaactgaatcaaagggcccctgggatcctacctgggctctaccacttaccttctggagttgtaggtgggtagtttcagcttcttcctctgttaaatgcgtttcttaagagcacatacctgctggttctcatgagtcttagtgagataatat

SEQ ID NO: 256913 - DNA, 133 bp, Homo sapiens
gtgataggaataattgagtgttgaaagcagagtcttgacatgatctgatttctaaattcaaaaggatttctctatgttcttcaaagtttatgaaaataattcatattgtatccttaatataaacatatgacag

SEQ ID NO: 256914 - DNA, 677 bp, Homo sapiens
gcgaccaagagctagggacccaggagagagaaaaatgcacacccaagagatggcaaaggggccccttctgatgacgagctaggggctctactatcctactggggtctggcccaccctcgttactatgggtttctggttgcaggagaccttagaggggctgatcctgcccccatcttccccacccacacaccaaggaaggctggttgtggataactgaaatcccagagtctgcttctgccatgctcttgaggctgaggaatgggctcagacaggtgggatccctgttactacatcagcactaagacaaagggacaagctctggaccaagaattaggaggctggctcagggctagttatttttctgggtcttggattccccatctgggaaacatggaaccaacagtatctatctgcttggactaccatgcaagtctgcacatgatctaactccaaaggagttggtcacccagatgttccttttggggctcctgggggcttccggtgcgctcttgcactcgcgcgctctctctctctgtctctctccctgaggtgaagacataagaggcagcagatggccaggacctttgctgtggtcccaggagccctcactgggtaaataacactgactcccagtaagcctggaaatttccattctttagggagaacattagtgagca

SEQ ID NO: 256915 - DNA, 638 bp, Homo sapiens
ggcctttcaaaagacatagaatatccaaaacaaccttgtcaatacaatatttcattaaatatttcaattaaatagtaattgaattaaataaataattatttaattaattatttcattagagagtgcataatcttgattatcgcagcttatcataagccttaaaatcaggtaatgtagtaatatcttgattatggtaacattataagccttaaaaccaggtaaaatcgactcgcgtcacttttaaggacgcatacactgaaaatgatggaataaaaaaagagatttcaaataaattgaaaccaaaagagaggaaagctggctacatttatgtcagacaaaatatcctttaagtcaaaaactgtaaaaagagacaattagggcattttataatgataaaggggtcaatttattaagaggctttaacaattataaatatacatatacccaataatagagattctaaatatatttttaaaatttaaggactctgaagggcgagaaagattgcaacacaataatagtggggaatttaataccccattttcaacaatgaacatatcattcaaacagaaaattaagaaaactgtggacttgaactacactttaaatggaactaacagacatatgaagaactttcc

SEQ ID NO: 256916 - DNA, 286 bp, Homo sapiens
cagcagaggggaggggaagctagttggtagagtggatagatagtacactagatccaagtctgtatcttgaatctctctcataacaccagcgtgtggctgtaaacccaggcctccggtttcctctgtaaaataaaggagatgcactaagatgctttctatgcctttcagtactatccttcagtttgctctgatcaagaattgaagagatccccatattcccgtggtttaattttccctgaagaccttggactgaccactttcgtaagtaatcaggtagacttctaat

SEQ ID NO: 256917 - DNA, 334 bp, Homo sapiens
gccaagtgccctgttctccaggcacaggggatgacttggggctccctgcttcttgcagctgttctgcacacctgggaagagtggcttccccttcgatccagatcaaaccctgcatatcaaattggtatgagagggtgggctttagtgatgtcaggaaaaatttaaaatgcacataccctctaagccagaatggcttctacacatcaagcctgtagctctacctgccaaaatgtgtatccatcgagatgttccagactacagtctgggggagaaaaatctggaaacctcttaactgttcaagtagagcaagggtgaaataaattatgaaacagcc

SEQ ID NO: 256918 - DNA, 685 bp, Homo sapiens
ccgctccccaagcactctgaatgacagttacaagattttgtagcaatgaggaaaacaggcatgatataataagttcaaaatacgttctggcacctgaatgaagaccgagagctgttgggttagtgtgggaggaatgtggggagcagttcttttttccctttttcaaattttatataatgcggttgctgtattatttttatgatttaaaaaaattaagggagaaaatgtgttcaaaccaaaccaatggctgagtgaggggaggcaacgaaaaagatcagtttcccttcctcatgatacaactcccaccagggtttcgggttttctcaccactgtttgctggaacccagccagcccacggagtgctacgcccgggcgaggagggtcccgcttctcctatccagccccagaggggccacatggcttctcgggaacaggagactgtgttccctaaacagccttctcgcccaaagcctagctggacatctagagtaggcagtggaggtggggatggcggctgttacttttcttgtttttatccttatatctgcttcacctcctatgcttccctccctctcttctctcttctttctttcgtattccctttcgcgctcttctctgtttttttcctcttctctctctctccctttcctttctcctcgcttgtctccccttgctctttttttct

SEQ ID NO: 256919 - DNA, 307 bp, Homo sapiens
  misc_feature (278)..(278): n is a, c, g, or t
cgcctgtagtctcagctactcaggaggctgaggcaggagaatcacttgaacccaggaggcagaggttgcagtgagctgagattatgccattgcactccagcctgggtgacagagtgaaactccgcctcaaaaaaaaaaaacaattatgataactatgcactcagcatttgggcagggacagggcagggacagggcaggggagggcatgctcggaggccagctcccccaacccccaacacttttggggatcctaaacacttcctgggcctcagtaatgntccccaaagcctcaggctttcttcccgca

SEQ ID NO: 256920 - DNA, 715 bp, Homo sapiens
ccagagagagaaggctttttgagattccagcgttcactgtaacatttcttgtatcaagaatgtagaatcgattgttcacatttattttcagaaaaggagatagagttgtaatgtacttacaagtttctaaccagtttttaaaagaccaaacaatactgaaaggtaaattaattgcaagcataggaggcaaaacattagttagaaaaattagtcaaaacaccctctcatttcaattcccaatgtgcaagagaaagaagcaaatcaaaatacccacatctcacatttaggttacagaaactattgcctaattattcaaataaacacctaacatttctttattctttgatgtggatattggtttctgtcctcaggtttgtttcctcacaattgattgctgcttttctaagaatctcattctcacaaaacatgcaaacacagaaataatggagactgttttcttttagacaccctttttaagatgaaagaaaacggttcccatgtacttccaaaacacttgctctcacgtgttttttttttttttttttttgccataattgtttcacatgcctgttcctaaaccagtcaaaaatgaaggtaaaggaactaccatgactgacttaagttaatcaagtttcacctcttggagtctggagggactttgcattccctaaagcacttgaccacttttacaccactagggttctgctagcaaaaa

SEQ ID NO: 256921 - DNA, 472 bp, Homo sapiens
gggacttaccaggtggactttattgaaagaattatgttttcgccattgagaaactccatgcaggactgaaaatctagttcctagaattccaagggttttaaaaaatcgatttcttgagaatgattaagaatgtcagtgaattggacacattttaattttctaatgtttaatttttttttcaagctactacagcttaggttcccaggtacagtaaactagaaggaataaaaatgtctaacatagtatttcatacaggagaagagcaaggacacaccttctaccccaccctgtcgccatcttcctttctcggaagcaaagttgtataatctgaaaaacctgacattccatattgagggtttattgtaaggtagtaaaaccagattttatatctcatttattcctacaacttctgatgtgcttccaaaaatggtattaaggcagcagctgaggaaattttatgagataatgaagc

SEQ ID NO: 256922 - DNA, 472 bp, Homo sapiens
tatttcccatcagccttagattaagacagaaagaaaatggggccctggcgtcaggaaagaaggtggctttgtccagggagggacagctgctgtggcagtttctgaagaaagtggaaaggcatgaatgggccctgccatgtgttgggtggccacaggcatgagctctcctggtctcggctttccaaggcccgggccacggtggcccacgaggacacccctgcacccccacatggcctcacccaccaattgccaatgtcctcaccttgaacccactcatcacaggctgatccagaaacttgctgagttttgttttgttgcaaacactgatttgctttgttgttttttttacttcactgggatgtaggatgccaggttaagatggactggtttctcctgccagaagcagctttgaatttaggatgcccagagggtgctgtctttttcttttgacagagtcgtggtctgttgccca

SEQ ID NO: 256923 - DNA, 786 bp, Homo sapiens
cgcccaacggggaagagcgaagatgcagggacacgcgcgaggagccgccgcagccgccgccgccgcgctgtggagcccgagtgagcgcggcgccagcccgtccggccgctggacaacatggaggctgcactgcccgggccgccgtggccgctgctgctggcgctgtgcggctgcccggcccccgccgcaggtacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgtacatgtactgggcagattggggtgagacgcctggatcgagcaggtggggatggacgacaaggacacagaagatccattgtggcacttggacctccaatggcacaatagacttgaccatgcactgggggcgaagaagtgtaatgggctgaccataaaataagctcgtccacgtccaactggaggtcatgccggaaaggtga

SEQ ID NO: 256924 - DNA, 795 bp, Homo sapiens
cgcccaacggggaagagcgaagatgcagggacacgcgcgaggagccgccgcagccgccgccgccgcgctgtggagcccgagtgagcgcggcgccagcccgtccggccgctggacaacatggaggctgcactgcccgggccgccgtggccgctgctgctggcgctgtgcggctgcccggcccccgccgcaggtacatgtactgggcagattggggtgagacgccctggatcgagcaggtggggatggacgacagcacccagaagatcattgtggacttggacatttactggcccaatagactgaccatcgacctgggggagaagaagctctactgggctgacactaagctcggcttcatccaccgtgccaacctggacggctcgttccggcagaaggtggtgaagggcagcctgacgcaccccttcaccctgacactctccggggacactctgcactggatggactggctgacgtgctccatccatgcctgcaacaggaacactgcggggaagaggaacgagatcttgagcgccctctactcagcatggatatccaggtgctgagccaggagcagcagcctttctgagccaaggaggtcctgcttgctggcccggtagacggaccaatggagggtctcgctggaccacaccggacttcacggaaatcgttgctgcagttggaagaatccacattgcatacgcataatataaccatggggcacgtctctgactgtacagtgtggcacgagggaacggatggtggccaacgaacaccaaatagcgaaaacgcagggcc

SEQ ID NO: 256925 - DNA, 412 bp, Homo sapiens
ctgatctataaacaaggttcaatatagaatgatataactgctgcgaccggcgctgccacaactacctgtgcgcattgtccaggggcctgaggattgatagcccccacccctgtgccactgcatctagcgcccatgtgcaccattggggggcctgagaataggcccactctgcctgcactggcacatgtgcacatcatctgagggtctggagatcaatatatgccactcactggcatctgcaggcaccgtctgcagaccagaggtcaggccagccccacctgccacaagtgcactggcacctctgcacatcatatgggggcctagggaatgacccaccctgctccctgccactggcgcctgtgcacaccattgggaggcctcaagagaagcccaccctgcctgttgcctccac

SEQ ID NO: 256926 - DNA, 534 bp, Homo sapiens
taaagggccacttatgccagaatttcccattgatatgttttgttgtgtgtgtgtgtgcacacatatatatatatattcacatatataatacgcatataaaagtcatgttatatacttaccactaagaaaaatgacaaaatgttggacaataaaaagaacataaaaacatttttcctatagataaaaattttaaatcagtctacttttgtatgtatttgagatgtatatatatgtacatgatactgttaattaattaatttttttttttttttggcagagccggggtctcactgtgttgcccaggctggtctgaaactccttggcttaagtgatcttccttcctcagcctccccaaagtgttgggattataggcttgttaatttttttagctaccattaaaatttgttttctgaattgactaaaaaatctctgtagtgtgatttttaatgactgtgtacagtattcctccttgtggatattacagcattttcataaaaagataaataaaattgaacttttacttatattacacat

SEQ ID NO: 256927 - DNA, 318 bp, Homo sapiens
attttgaaatacaagctaatctgagggggcttggtgggaagatttttttttcagccctaaggtttaagacaggacctttcttgtggtgtcctggagtatggagggtttattttttggttaacctttactgagagtacaaccctttggggttctacccttgtggggtggagtgtgtgtctcttatgtcacttctatcttaggctttgcccttgaagaccaagctcaagttcatctggtttggcagctttggggctttcctgctgattcagagtctggatttatttattgtcaaacatattaaaatgtagatgaggcaaa

SEQ ID NO: 256928 - DNA, 407 bp, Homo sapiens
gttaataacaaacttaagttaataacaatgtattgatattgattcattaatgttaacaaatgtactatagtagttgtggtggtcaattttgtgtcaacctgactgagacactgggtgtcagttatttggtcaaacattgttccgggtgtatctctgaaggtgctctagatgagaacatatgtgttgatagactgaataaagcacattgccctcccctctgtgggtgaccctcatccaatcaattgaagatctgaatagaacaaaaagactgagcaagaggagattcctcctgcctggctgcctcagccaggacattggtctcttcctgacttaaactgaaacatgggttccttttaggtttgaggcataggcttttggactacaacttataccctcacctcctctgg

SEQ ID NO: 256929 - DNA, 352 bp, Homo sapiens
atcctcccacctcagtcctccaagcagctgggactacaggcacgcgccaccatgcttggctaatttttgtatgttttatagagacagggttttgccatgttctccaggctggtctcgaactcctaggctcaagtgatttacccacctcagactcccagatttctgggattatagatgtgagccacagtgcccagctgacattgacatcttaaagattcacttttaggccttaacgcgtgcctctgtgattattattggtggtgatattggccttatttctaaaaaaaagttattggaaattaaaattattttgtggaaataattattttgtggaaagctaaacaggtcttcc

SEQ ID NO: 256930 - DNA, 321 bp, Homo sapiens
ataactctttgctgaagaataccaaaatcatctcatttttaaatgtgcatacattttgacccaatagttttattagaaaacaattctagggaaatattacatgtgtataaaactatgtataaggtttcgctgcagtgaaactgtttgtaactgtgaaaatttggcagtatcctaaatatccatcagtagggaatgatttaaataatggtaagttatactgtggaataccattgagttattaaataaaaaaagaagaaaagcctcttggttagacatatatatacactgacataggagttccaaagtatgctgttaagcagg

SEQ ID NO: 256931 - DNA, 344 bp, Homo sapiens
aaccaaaggcttgaatggtttaaaaggtactgcaaggatttttggtctttgtcttcctcaactgccagatgtcacacaaacctgacttctcctttaaaaaaataccatcatggagagaaacaaaggactgaatttaagaaacagtgctttgacataaaagagaggaatccatgaaaaagtaaccattgagactgggaggcactaaaatcttatatatttcaaaatttgactgattgtatttgtttctctgataaatagccaagtgctggcctatgagtaatcaacatagctatgagaatttttaaaaaagtggtatttattttatatacctcagtatagcgtga

SEQ ID NO: 256932 - DNA, 405 bp, Homo sapiens
aatgtgggaaagggaaaaatccagaactggcttactcctaagaaatgtggacccagttaggacacagcagttgacttttctaagcagccaggagtatccaagaaccaatttcacctcttagccaattgtgcctcacaattaattatttctgaatctttaattgctttgaaatggcaatgccactgatacactagactttctagtttgaggaattgtttttatgttgtaattcactgacttcgcttgcttgtttgctgttaaatccacatgtgacatacttaaaatagaagtgtatcataatcatatgaaaatgctcaacttggcattttatgagtatgtgtcactaaagactgagtaattgcagccttcaggcaatttaggctgaataactttgtttctgttcaa

SEQ ID NO: 256933 - DNA, 497 bp, Homo sapiens
ctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatata

SEQ ID NO: 256934 - DNA, 479 bp, Homo sapiens
ggaatttgagaccaacctgggcattatagtgagtcctcatctctaccaaaaaagaaaaaaatgccaggcatggtggtgcatgcctgtagtcctaactactcaggaggctgaggtgggaagatcgcttgagcccaagagtttgaaagtgcagtaagctgtgatcatgccactccactacagcctgggtgacagagcaagaccctgtctctacaaaaaatgtttacaaagtttacaaagaaaaatacaaagttactgacatgggaatgtaacttatactatatgctataaaattaactgagatgattccaaattttatgttgatataacattaactatgtaaaatacgttaaaaataaatatattagcattaattatgggtaggagaattatggatgattgttttctatgctttgtatttttaaggttttcaacatgtatttttaacagcaatgtaaataaacattatttaatatatgtaa

SEQ ID NO: 256935 - DNA, 231 bp, Homo sapiens
tgtagagattatgtaatttccttcttgaaagatgttagatgacattaacatgaattgctttgagcttgtcataaatcctagctatcaagcctttaagtcaaagaaatacacattccctgtcattacttgggccaagttgctccttttaaaaagtacatctccagataaatcttgctagtgtcaagttttgtcttgattatcaagtaagccaagtcacaatgtgtcctctat

SEQ ID NO: 256936 - DNA, 318 bp, Homo sapiens
cctttcctccttcacctggtcaagttcacattcttcagtcccccgttttcttaaaactcaaatgagacccgattagacaataacaggaatggaaaagcctctcgtgaagatactctcatgaactgctctcaatttccccccttctgaggaatcttcaagccggctagccacatgtcagggcactgtgacacatcatttgagaatctctaatggagcaacgtccaggggaacatgggccaagcaatgactgcctggcaagtccttctcacgtggcagactagcgatcaataaatatctgttgatttggaaatatcagaa

SEQ ID NO: 256937 - DNA, 416 bp, Homo sapiens
ggataggacagaaggcctttcttctttctccagggagaagagatacacttaaaccagggtcccacaggctcaatgggtctccttccaaaatcagcttccagtgagccctcagattctccaaatactgggcagctggatttcccagacaccttctgcaatctgctgacatctaatatacctgtagactgttctcctgctgacaaggttgttcttgctcttatcctataaagaagagaggtggcagagagttggaggggagggcctccttccctggcatgtccatccgagggtctccaagaacatcctggctgtggcccacacctttctgtgtggttaggaggagtatcggatgccttctctttccaaccttggcttgtaagtttcccccaataaagtctgttccttcacccatacca

SEQ ID NO: 256938 - DNA, 697 bp, Homo sapiens
gtccacgtattctatactcaggcacttaaagtaaattatctcattcaattcttaaaacaaccctatgcataaggcattattgtactgttttacaaatgagtaaacaatttcagagaaggggcaaagacttatctgacagctaaatttggaaacaattaaatgggtgtattagtccattttcacattgctatatagaactgcctgagactgggtaattgataaaggaaataagtttaattgactcagttcagcacggttgggaaggcctccggaaacttacaaacatggtggaaggtgaaggggaagcaaggtaccttctttacaaggcggcaggaatgagtagtgccgaataaagcgggaagaaccccttataaaaccatcagatctagtgagaagtcactcactctcacaagaacagcatgggggaaactgcccccatgattcaattacctctacctcttctctcccttgacacatggggattacggggcttagggagattgcaattcaaaatgagatttgagtggggacccaaagcctaatcatatcaaagggcatgctctgtctagcttcaagtcacatatttttggaatctgggatgctttgagttctgtaaatcattattactttagcctccactgtactgttattgccactctagcacaacctccaaataattttctaattgtatgcacta

SEQ ID NO: 256939 - DNA, 396 bp, Homo sapiens
ttagcttcattcatttatgttatttaactgaccccataagcatttgtgttttgtgaccaccatcttaggttctaaacattacctctaccaaactgtaaaaagtaggaattctacacctgtttcccacacccaagatccatctcccctcctgtgataattgcctttcactcatgggcagtgtatattgggtaaaccagccaccttggccaagaatgatttgacacaagccaagcagggtcattcacgtgctttctcttaggaactttaaacttggacttagaagagctatgtaatctctgcatgcagctacaaccctgtcaatttggaaagtgtagggtagccatattcagccattttgactgcacaagcagagagatcttatttggagaaaaagaa

SEQ ID NO: 256940 - DNA, 611 bp, Homo sapiens
taaggcattctccgtcacccaggctggagtgcagtggcacaaccttggcttactgcaacctctgcctccttggttcaagtgattcttgtgcctcagctcccaagtagctggaattaacaggcgcttgccatcatgaccagctaattcagctaatttttgtatttttagtagaggcaggtttcgccatgttggccaggctggtcttgaactccggaccttaagtgatccatctgcttctgctgtccaaagtgcttgaattacaggtgtgagccgccgtgcctggccttgctcttagctttttgaagggactgcctcatctcataaagatttgtttactgtgacccttgcctttaaaaatttccccaattttgaactgttgagtcagaagccttgaaacctaggtaatttttgctctcaggttcaaagctacatttatctttaggttttttttttttttgtttgtttgagaccgagtgtcactctatcaccaggctggagtgcagtggtgcgatctcagctcactgcaacctccgcctccgggcctgcgatgtcctgccttacctcccgcgtcgccgcaccacacaccgccgcctacctcagccctttcttcg

SEQ ID NO: 256941 - DNA, 611 bp, Homo sapiens
taaggcattctccgtcacccaggctggagtgcagtggcacaaccttggcttactgcaacctctgcctccttggttcaagtgattcttgtgcctcagctcccaagtagctggaattaacaggcgcttgccatcatgaccagctaattcagctaatttttgtatttttagtagaggcaggtttcgccatgttggccaggctggtcttgaactccggaccttaagtgatccatctgcttctgctgtccaaagtgcttgaattacaggtgtgagccgccgtgcctggccttgctcttagctttttgaagggactgcctcatctcataaagatttgtttactgtgacccttgcctttaaaaatttccccaattttgaactgttgagtcagaagccttgaaacctaggtaatttttgctctcaggttcaaagctacatttatctttaggttttttttttttttgtttgtttgagaccgagtgtcactctatcaccaggctggagtgcagtggtgcgatctcagctcactgcaacctccgcctcctgggttcaagtgattctcctgcctcagcctcccgagtagctgggactacagatgcgcatcaccacacccagct

SEQ ID NO: 256942 - DNA, 653 bp, Homo sapiens
gcatcaaggggaaggtttgcaggtagatgaataactaagattttatgagttttgcagggttgtctgtatctaagatggaatacatcagggttttcctagttcattctctctattcctgttctacttttaaggatgggaactggaaaaaatgaagtatttaccatgggcatgcccccacccacatgcacacacctgtcatcaaaattagagccaaattagaaacagctggacagaaactgctacttaggttagtcatttggtgggcattttgttcaagtgattcagcaaaattctgcttacaaggaaaggctcagcaagtgtttgaaaggaggtgatgggaagagtgaagtagatggagggggattttcacaataggcacactggagcagacatgcatgccatcatttaaataaacatgaaggtgacctttctttagcccaggatttcataggctctaatttgtgttttggaaaactggggtaagtgagcagctattcagcacactggaacttgaatctttgtgtcaactagtctcaatcaaaacaggatgccttggtgttatttgatgtctaggtgaagtgagtgataagccttgtctttgtcttctattgtcaggtaaaccctcagaaatgtccagcatggccaggagcacc

SEQ ID NO: 256943 - DNA, 671 bp, Homo sapiens
gatgaaggaagattcagtctcaggattggggctcctccatgctgggtcggatcaaagaccaaatgtccatgaggtccctccagtcactggttcccctgggcaccctggagagacctgggatggggaatggggactgtgaagtggtcctttctggggtgaagggggcgggccttgtctgtcctggaactcttggcttagggcgccctcttcctggtgcaggacacaaattctagacccctcacctccagagcattgcggcagaaccaggtcaccaggcctgcctcactacctgctcccagcacacgaaaatctcgctccctctctccatttccctccagaaccagcaacagctttcctcgcaagctcaggtgtgaccaacgtgtagttctcctgttctgtgggagtaaaactggctgggcacacggccacaaagcctgagacccggagacctcgctcccccttcccttgcttctgctggaatgtgaatggaagtgtccacacctgcttcacgggcttctccctctccccctttctgagagctggaatgtgggtctggttttaacactgcttcaaccacgccatgaggaccatatccaggcgggatggacgactcgcatggccggcctggcctccacatcattgttctgccactccttctcggctccccctgc

SEQ ID NO: 256944 - DNA, 802 bp, Homo sapiens
tcttagtggaaggctcatctctgacaagagaaggggcccttgagaatggagctttctgtgtggcaatgaacatggacttgaaacctgctagactaggtcaggggcatatgaaggcatctgggctggccagactccagtggatggacagcggtctcctctcttaaattttaagaacttaaatgccagggcttccttaaacattgagcaatgcttacatgctctgagtcagcttggatcgtgatggctagaaggagtcatagaggctgactccctccatgttcagtccaggagagggaaggtgacttccctgagccgacgtggctggtcagtgtcaaggctgggcactgagtccagtgcagccctctccctatgggttcctccctccaacctgctcctgcccagagctgctccttccgctctttctccccttcctctgtctctggggatctggctgatgatgctctttgtgttgtcaggaaatgtgcccagcagccaagcataccctgtcattaaaccgaatctggtggtaaggatgtctttatgaagacacctcatcctgtcatctgcctgtgaccatcaacttggtctcggcccttttttttttttaaatctatgatattgggaaggtcaaattagctgatcgctaaggtgcattcccatactaaaaaaaatgttcagccaggcgtggttgctcacgcctgtaatcccagcactttgggaggctgagacgggcgtatcaccaggtcaggagatcaagaccattctggctaacatggtaaaaccccgtctctactaaaaatgc

SEQ ID NO: 256945 - DNA, 266 bp, Homo sapiens
  misc_feature (4)..(4): n is a, c, g, or t
aggnaggagtccacctcgcctcgtcgggcccggcctggccgtcgccccatcttctcgtccacgaacttgttctcgtcatattcatggaaggtcaaattagctgatcgctaaggtgcattcccatactaaaaaaaatgttcagccaggcgtggttgctcacgcctgtaatcccagcactttgggaggctgagacgggcgtatcaccaggtcaggagatcaagaccattctggctaacatggtaaaaccccgtctctactaaaaatgc

SEQ ID NO: 256946 - DNA, 2490 bp, Homo sapiens
  misc_feature (493)..(493): n is a, c, g, or t
  misc_feature (2114)..(2114): n is a, c, g, or t
  misc_feature (2146)..(2146): n is a, c, g, or t
taaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaagggcaaaaactagaaactgtaactgcccctgattgggcaggcatgatggggttgacttcatgtgggtctgagtgttgcttttggaaaagatacagataagccttttgatatttattttgnaccttacggagaataattctcccaatgattaagacaggagctagcagcccacccctccagcctttccccccatgcagggctgaaaggcaagcttcacattggaactctgattttgcctttttgtttactgaggtcctggaacatcaggtttcctgggataggtgagaccacttgatgccatgtctgtattctagcaggtcaagcttgaaaccgttcttgactcctccatggaacatttcctgaacatttacgggctatgcattgggaactgcaggggcacagtgatgggcaaagattagctgcttccagaaggctgatttcgtgggctccacaatggtaaaacgctgctgtgagtggcagagaggttccccaggtgatggccagttcccaaatcatttggtactaaggctttgacattctggcacatcacatcaaatagaacacagcctccctggaaggacttaagtgagaaagaacaagagaagctgcaactcctggacccttttgtcctcagtgtgtggttcctgcgtccttccccagggcaggagagaggagatgagagctctggtcaaaacctgccagctagtggaacagccttctatagagccttctgcaagaaacgagtgggtttgaagaaccaaaacatttgtggtgttttcgccatcagggtgtattggaggctgacacttaatgggtgtgtgttagcgcccagaactgctcggtgtcggggttctaaaagaatgcgctggtgttcttggcttcaagtttctgctttggagaagcagattcaggaagaatgcagctatatgtaaaccaaaggaagattttgacttcatcttattcagagctttataaggaattgttcgtcatttcagaagagcacatcctccacaggaggccactcctggtatttgagtcgtgaatcacacccgtgtcagtctgcatttctactggtcatttccatgaagattatatagacacacgtatgtaagactgtacttactgtctgagtccattcatgctgctataacaaaataccatatgctgatttagcttataaacaacagaaatttacttctcactgcccaggaggctggcaagtccaagatcaaggtgccggcagatttggtgtctggtgaggcctgtttcctggttcacagatggtgacttctacatggtagataggttgagggagctctctgaggcctctattataagggcactaatccctttcaggatgcccctcccccttaatcacctcccaaaggcttacaggctcacttaccaccctcctagtgttatcaccttgggggtaaagatttcaacacaggaattttgggggtcacaaacattcagaccatagcacttaacctttattttaaaatgtcagccaggtgcagtggctcatgcttgtaatcctagcacttagggaggccaaggtgggaggattgcttgagctcaggaatttgagaccagcctgggtaacatagtgaaaccccatctctacaaaaaataaaccacattagttgggtttggtgatgggtgcctatagcagcacctacttgggaggctgaggctggaggatcacttgagcccagaaggttgaggcttcagtgagccntgattgagctactgcaatccagtctgggtganagagtgagaccctgtctcaaaaaaaaaaaaagtcaattatttaaaaactcattagtcaaatattttctaagatccaaatttgttttaagcaattataattgtcttcattgtgtcttctattggaattgtagctgagattttaccaagtatgtattttattgtaagttactttgtctttctgttatagaacattatatatacatttctaattcttcactcatttattttttaatgacaggtttacatgtatagctttaaaaggcaaatctaagcatacttccttaaagatgcattataaactgttttctttcagtgaatggaagtgtagaatattacactgatta

SEQ ID NO: 256947 - DNA, 1366 bp, Homo sapiens
  misc_feature (493)..(493): n is a, c, g, or t
taaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaagggcaaaaactagaaactgtaactgcccctgattgggcaggcatgatggggttgacttcatgtgggtctgagtgttgcttttggaaaagatacagataagccttttgatatttattttgnaccttacggagaataattctcccaatgattaagacaggagctagcagcccacccctccagcctttccccccatgcagggctgaaaggcaagcttcacattggaactctgattttgcctttttgtttactgaggtcctggaacatcaggtttcctgggataggtgagaccacttgatgccatgtctgtattctagcaggtcaagcttgaaaccgttcttgactcctccatggaacatttcctgaacatttacgggctatgcattgggaactgcaggggcacagtgatgggcaaagattagctgcttccagaaggctgatttcgtgggctccacaatggtaaaacgctgctgtgagtggcagagaggttccccaggtgatggccagttcccaaatcatttggtactaaggctttgacattctggcacatcacatcaaatagaacacagcctccctggaaggacttaagtgagaaagaacaagagaagctgcaactcctggacccttttgtcctcagtgtgtggttcctgcgtccttccccagggcaggagagaggagatgagagctctggtcaaaacctgccagctagtggaacagccttctatagagccttctgcaagaaacgagtgggtttgaagaaccaaaacatttgtggtaggtctcccaggagcttgttaaacctggaaacaccacctgagttggtttcatctgctcattggaagaaagaaaatgaaccaggaaaaagcatctttgtcatgaaatgctatgccatgccacccacccagttgaattggaatcctgttaaaacatgagatttaccagaaacagtcctttgtctagatggaaacaaacaagatcctggcttctctctaatga

SEQ ID NO: 256948 - DNA, 425 bp, Homo sapiens
taaaccatgacctggctgcagaccttgactggcttattggaacagatgcaggttcacagagatgctgagtcacagctggttttgcaggagtggaaaaaggaaaggaaggagatgcgagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaaggccccccaccttcggaacccctctcctgcaggaggcccaggccaagtagccaaccgtggactagtattccattccagcgtactactagccaagccgtggactagt

SEQ ID NO: 256949 - DNA, 295 bp, Homo sapiens
ttaaaaaaagaagtgattttgatttcagtagtttaaaaacaaggatttttgaatcattctctgttgctttgcttttttattgcctcttcagagaaatgaccaagagtttcttcaatgcccagtttggaagcctgttccgcacagaccagaacccaacctacttcctaaggcgcctgtcgcgcttcgctgacatctacatggcgtctctgagctgcctcctgaactatgacgtcagccacactttctacccccggaggactccactgcagcacgaactgcccgcctggtcagaaag

SEQ ID NO: 256950 - DNA, 463 bp, Homo sapiens
ataaatgtatgtaaccatctattgatgaaatccaagtctggcattccatgggctccttgccagatggcagaaacttaatgagttatatagcatcctttgtaatgctgcttgttatagttggaatgtacttgtgatatttggctgtatttaactataatggtgaaggtgaccctttagatccaataaggcttctccccatcttctacattttgttatgaacacagtaaggcacagtagtatgttctttttttggaacagggtaggcattttgtttattgtttgcttgcttctaggtgttttcgccatcagggtgtattggaggctgacacttaatgggtgtgtgttagcgcccagaactgctcggtgtcggggttctaaaagaatgcgctggtgttcttggcttcaagtttctgctttggagaagcagattcaggaagtaggtgttgcttaaaaataattcttg

SEQ ID NO: 256951 - DNA, 563 bp, Homo sapiens
gacaagtgtatttccccatctgtagagaaaggatactcatttatatctcacagcattgtcgtaagcatcaaacccaatattgtatacacaatgctcattagagtattcaataattggtagctattctctctcattgtttagcacatcaccttatacctgcgtagcactttgcagagcacttaggaaacaggcagcacttaggaaactataactatggagcaacatactatattgctacagtgggcaactataactgggcaacatagcaagaccctgtctctacaaaaaattaaaaaaaaaaaaaaaaaaaaaaaaaaaaccaagctaggagtagtggtgcatacctttagtcccaactactcaggaggctgtggcaggaggatcccttgagtccaggcattcaaggctgcagtgagctatgattgcaccactgcactgcagcttgggcaacagaaagagactctgtctctaataaataaatagaaacatgtaatgtgaaattaaacctaccactgaggtagggaagttggctttatgaaatgtcattactttacatacaacac

SEQ ID NO: 256952 - DNA, 95 bp, Homo sapiens
aatacttaacgaggctatcagcaaacaaagagaagaggcccaggtgggctcaatagccaggtcacaaatggttgcccaaagaaaaaaacggtgca

SEQ ID NO: 256953 - DNA, 363 bp, Homo sapiens
gattagagagagtccacagaggagtagtataaacttttcaacgtaaaggttacttatgagctgacaaaaaccaatgctagctgtgccaagatctaacacaaacagaaattcctacaatcagaggaaagggtagaggctgtgtttgtttaaaaagctgattatacacacatgtaattggtgtgtactttaaagtaatgagttacatattgactgtcaacttatccaaatatggagagattctccaatcttaatctatcttgacatttaggcttagtttggaactgctaggaaattgcaaaactgataattttttattgttgcctgaaagcatatctgatgtgctacagaaattggcaccacctg

SEQ ID NO: 256954 - DNA, 325 bp, Homo sapiens
agagaggtgatctatcacagcatcgaacttcagcacatgatgcatctgagagccgagaacttagtgtttcccatctctccacctgggctttgagaagccatcctgaaagagaggacatttggctttctcagagcctcagctctggaactagaccagaggttggcaaactctatctgtaattgtccagatagtaaatattttaggttttgtgggccatagggtctctattccaactactcaactctgctgatgcagcatgaaagtagccatagatgttaagtcaacaaatggtcatggcagtgtttcaataaacttcatttacaaa

SEQ ID NO: 256955 - DNA, 372 bp, Homo sapiens
aaccaatcccagtgacttcctttaactatgggaaataatctcctaaaaacagagagatcagattccccacattctagctagccaaatgaccgttacggcaagcccacaatatttttgctggtcagacagctgcagtgtctgttagcacctgatgcaacccaatgggctgtctaatgagctctggtgtgtatctttctgtggaaaataatgtgtatgcatggtcacccaagttcaacacggccaggggtggggccgggggtcagcacgggtgtgtcttgtaaggcagtctgtgttgcctgttaggatataaaacaattggtatcagcaatgaaacatgcccagtgtgacctgctatttaaagaggaaaaaggc

SEQ ID NO: 256956 - DNA, 471 bp, Homo sapiens
agagagggctcttaagagtactgcattcatattcatagggttttatggagactacataagatcgtgcacgttaatgtactcagcacagtgcctggtatgtagacaaaactcaagacatattcgttattagattttaatgccaaggcagaatcaaagcctgggctgggttgagggtggggtccgctgaagcctctggagaaggtccagcctgtgccccaacacagcaggaagccactggtctctggtcgagtctaagcttgctggcctagccacagactgttccgggaagctgcgagcaggcacttgtctggggtggggcctcatgctccttggctcctcaggcccagaaagagacctgcatctgagtgaatgtgcacatttacaagagggcacacatgcatactcagtagtcaattttttgaataattgtgtgggtacattagttctgtgtctacctggccatgaatggac

SEQ ID NO: 256957 - DNA, 1055 bp, Homo sapiens
ctgggatgtccagaggcggccccactacatccattctgccctctgtgggcacaccttgctctcccgcagagactagaaagccaaacacgtttcccaaactcctttcagcagagtgtctggaagtggcttcggtgctgtcgagcgatgctaggtttatggtttggaaggagggcgctcctgtctctgtcggcgtgcgacacatccccaacttacagctgaaaacagccatcttattttggtcatattttagggtgaggaattcggggaggggtctttggggcaattctttcctgagtctgtcatatgagtgtgttcagaagtcactgggctgtgagtccaagatgggacacccatgaggctggagctctggcggggctgttgcctggacgccacacatggtgtctgcagagtggcgctcacagggtgctgggcttttccgcatggggttggtctcctctcgtggagcctccgaagatgtcaggtgggagttgcagggcgtttcttacgtggccgcaggagccctgtgcctccactcccttctcagacctcacctctccgtgggacagccccacagaacttgcagagctgttaaaggctgttgcagagggaggtggcaccctgggggccgcagcagcccggggagtgtggctcccccgcaggcgtggagactgggctctaggtgtttttggggcaactcaagcggagattctggagacgctcacatctgctggaatgcaggcttttcgttcgtagaaacagcaagcggccatgagtgtgattaattgggaattggaggtgagtaaagggtttcccggtctcctaaaccaacctgaggaaacaggtggtcattgttggcatttaactgtgagtatttccaaagcccgccgtagattgaaactccctgccgtagctgtgcagggtgtggacaggatggggatgggggttggtctcagtagggaggcagggtccccgtttttactaacatcagatttacaggatcagctcgacaaacagactgcttttttctggctggctgaaaataaatgggagagaga

SEQ ID NO: 256958 - DNA, 556 bp, Homo sapiens
gcttctggctaaaaatgggatcctgttgtcactgaccttactccccgtcttttctttaagaaactcttgagtatttgtaagaaaatcaaatctatcttcaaataaccaagttttcttatctttgagaatcttgagtgcaatgtgtcatgggctctgaaggtcttacgttgaggaatggcaatattatcagaattacgtgtccagcttcccaagcttactactttgaaggaacacatatttacacaattctgatgtgtttattaaacaaacagctttaccacttcgcagtcacgcttctctaagtctgcagtctcgtctggcctgactttctccttgtgccaagaattccttcaccttttctctttagcctttggccccaggaaaatgggaaagtaagatattttactcctggccaatgcctgatttttagaagccttcctcactccctggcaaggcacattttcctgttacctcagagtaaagagactcggttctggggttctgcatagtgatgctacatgcctgacccttgctagggtttgagggtccttgggaa

SEQ ID NO: 256959 - DNA, 619 bp, Homo sapiens
ctgtaatcctagaactttgggaggccaagatgggcagatcgcttgagtccaggagtttgagaccagcctggacagcatggcaaaactccatctctactaaatatacaaaaattagccatggtggcacacgcctgtaatcccagctactcggcaggatgagggcgcgagaaccacctgaacccaggaggtggcggctgcagtaagtggagatcatgccactgcactccagcctgggctacagtgcaagactctgtctttttttaaaaaaaataaaaaataaaaagaatgcattagatactcgccttttcaaacctcaaaggctgcaacatccccatcatctgtgacgggaaagcagcacccaaaccttcaacctatctgggtggtctataagcctgtgtggttgtatctgactcaactcagggttactgattttcaaaacaacagcaaaaagaaaagatccccccaatcttctcctgacctacaaaatcagaatctctagacggtaaggcccaggaatctgggtgtggtttttttgttgttgttgttgtttttggaaacagattctcactctgtcgccagtatggagtgcagtggtgggatctcactcaccgcaacctcc

SEQ ID NO: 256960 - DNA, 285 bp, Homo sapiens
acatactcttaaataaccaatggatcaaaggagaaacatcaagggaaattagaaaatactttgagatgaatgaaaatgaaaacacaaaagcaaaactgtgcttaaaatacatagttgtaaaagcctacaataaaaataaagatcttcaattgagaacatgtattttttttttacattaaggaagtagaacaaaaaagcacaaactaaacccaaagccatcagaaggaaggaaataataaagatcacagttaagatacacaaaatagaaaaacaatagagaaaaat

SEQ ID NO: 256961 - DNA, 639 bp, Homo sapiens
ggagaaataggaacacttttacactgttggtgggactgtaaactagttcaacccttgtggaagtcagtgtggcgattcctcagggatctagaactagaaataccatttgacccagccatcccattactgggtatatacccaaaggactataaatcatgctgctataaagtcacatgcaatttcttaacaaaagtcaccaggcttccaagctccaatatttatatcccctccacctctactgagtcaatgccacattttagatttttttattttttgcgttccacttctatcaaattttggtagttaatacaaataataaacaaagatcaatgccaattttgttagttttcaaagaaattttttaaataatgaaacaataatgaaaataaaataataaaacaggtaaaaattcaatgataaataacaataaatgtgaagtaaaatggtactcatacatgaatattggcaaaactatattttcacttgattgagcaacatagatcaagattaataatgtattttgatttgcagtaacattgatacaaaccttttaaagaaataataaactttatataaaaacaatgtgtatgatttgcttcctgtcatcaataaaaataggaagctatttgccttagtctg

SEQ ID NO: 256962 - DNA, 537 bp, Homo sapiens
caaatcctgtataccaagaatacgatacccagcaaaactgttcttcagaaatggagaggtaaagattgtcctagataaatgaaaactgagggaataccttattatcagaactgctttataaaaattctaaaggtaattattcaacttgaaataaaaggatgctgaagtgcaacacagaagcatataaaagtgtaaaattcacttgtagagttaagtatataaacaaacagaataatactgtaatgatggtgtgtaaattgattttaattttagtacacaagttaaaagtcaaaaaatattaagaataactttacaaaaattcgttaatgaagttacagtataaacagatacaaattttgacatcaataatataaattgtgtagcggggagtaaaagtatagagatatttgcatgcaattaaagcatacttaatacttctaagttgttatcagcttaaaatggatggttttagtaataaaatattttacatatgccttatggtaaccacacacaaaaatacatacagaagatacaaaa

SEQ ID NO: 256963 - DNA, 205 bp, Homo sapiens
caggtttaatcctgtcactgtgtgactttggaaaaatgattcccactttgcacctcaattttctcatctgtaaaatggggatatttatatacatatcccttcttgtttgtgaggatgaaataaactaatacatgcgatctttttttttttttttttttgagagtctcgctctgttgcccaggctggagtgcagtagtgcgatctc

SEQ ID NO: 256964 - DNA, 1014 bp, Homo sapiens
atgagagctgtcttcatccaaggtgctgaagagcaccctgcggcattctgctaccaggtgaatgggtcttgccccaggacagtacatactctgggcatccagttggtcatctacctgacctgtgcagcaggcatgctgattatcgtgctagggaatgtatttgtggcatttgctgtgtcctacttcaaagcgcttcacacgcccaccaacttcctgctgctctccctggccctggctgacatgtttctgggtctgctggtgctgcccctcagcaccattcgctcagtggagagctgctggttcttcggggacttcctctgccgcctgcacacctacctggacaccctcttctgcctcacctccatcttccatctctgtttcatttccattgaccgccactgtgccatctgtgaccccctgctctatccctccaagttcacagtgagggtggctctcaggtacatcctggcaggatggggggtgcccgcagcatacacttcgttattcctctacacagatgtggtagagacaaggctcagccagtggctggaagagatgccttgtgtgggcagttgccagctgctgctcaataaattttggggctggttaaacttccctttgttctttgtcccctgcctcattatgatcagcttgtatgtgaagatctttgtggttgctaccagacaggctcagcagattaccacattgagcaaaagcctggctggggctgccaagcatgagagaaaagctgccaagaccctgggcattgttgtgggcatatacctcttgtgctggctgcccttcaccatagacacgatggtcgacagcctccttcactttatcacacccccactggtctttgacatctttatctggtttgcttacttcaactcagcctgcaaccccatcatctatgtcttttcctaccagtggtttcggaaggcactgaaactcacactgagccagaaggtcttctcaccgcagacacgcactgttgatttgtaccaagaatga

SEQ ID NO: 256965 - DNA, 157 bp, Homo sapiens
tatcatattattttgtaatataaactacacagactaaaggtctataaaatcacctggccttgagcataaattaggagaggaaaagagagagaaggaaaagtcatttataaatgaattattaacattccaatttagtcaacaaagagaaaactcaaaa

SEQ ID NO: 256966 - DNA, 1535 bp, Homo sapiens
ccgctttttattttatttttattttgagacagtgtctcactttgtcacccaggctctggagtgcaatggcgggaggcactgcagcctcaacttcctgggcctcaagctgtgctcccatctcagcctctcaagtagctgagactacagaaaagcaccaccacgcccagctgatttttatattttttgtagagatggggttttgccatgttgctcaggctggtcttgaactcctgagctcaagcagtccatctgcctcggcctcccaaagtgctaggattataggcatgagccactgtgcctgccctcactgtagttttgatttgcatttccgtaacgatagtgatggtgagcatcttttcaggtgcttgctggccacatgtacaccttctttagggaaacatctcaaggcctttgccactctcattttttagagatggggttttgctgtgtcgcccaggctagtcccaaactcctgggctcaagcgatcctcctgcctcagcctcccacattgctggaactacaggtgcacatcaccattcctagctaaaagttttaaagtttgatgaagtttactttatctatgttttctcttgttgcctgtgcttttgtccaagaaattattgccaaatccaatgtcatgaagcttgctatgtcttttcctgagagttgaagttttagctcttatgattaggtctttgatccattttgagttgatttttatatatggtgtaatataagcaaaaaacttctttttttttttattttagacagagtttcgctcttggtgcctgggctggagtgcagtggcgcgatcttggcttactgcaacctccgcctcctgggttcaagcgattctcctgcttcagcctctcaagtagctgtgattacaggcatgcgccactatgcccagctagttttgtatttttagtagcgacggggtttctccacataggtcaggctggtcttgaactcccgacctcaggtgatccacccactttggcctcctgaagtgctgggattacaggcgtgagccaccgcacctggccaaactttgttcttttgtttgtgattatccagatgtcccagcgttatttgttgaaaaaactgtcatttccccatctaatggtcttagcatccttgttgaaatcagttgactatacatgtgagggtttatttctgggatctctattctattccttggactgtaggtctgtctttatgcgagtcttaaactgatttattattgtagctttgtagtaagttttgaaatcagaaagtgtaagccctccaactttgttctttttaagattgttttgactgtttctgtcccttgagattccatatggatttttctatttctgtggaaaacatcattgggattttgatagggatggccttgaatctgtatatcactttgggtagtattgacatcttaacaatagtgagtcttctaatcagtgaacagaggatgtctttccatttatttgtgtctgtaatttccttcatcaacattttatagtttttagtgtctttc

SEQ ID NO: 256967 - DNA, 752 bp, Homo sapiens
cccgggctgcatgtgattcgtcacgagatatttatataatgtcttcaaaaaataaatgaaccttaactttgtctttctctctcaaattgggttggctattactatccatattgccataatcatttataaacagtaatcacaatctctactgagcccatgtctctaatcatacaagtctctgtatctttatgattaacatagcaaaaatgttctgaaattataactttaatgagacataaaagtaaaatcttgttttaatttgtagaaaaattcagttcttttaatgccacactcagaaaccaatgacatttcagtgaccatgagaagaaaaggaagggtgactatggtggatgtaagcactgctgcggttctttacatacctaccctgctctcagcatccacactaatttccatacttctcatcacactgatattggttttggccatgcgacttgctttagctaatttaatgtaggtgaaattgacagtatgcctgttctagtccatattcttgagaggtattacatgtttctcttgtcttcttgttattgaccatgagacgactatgccctaggaagatgctgccctttagcctgagcctcagaaggacttggcctgtacttgaatccaatctacagcatgaatccaagccttgcttaggtcaagctccagacaactcaccaaccttattagcaacaacaaatgtctcaaggcagtgagttttagtttaacttgttatacagcagtatggt

SEQ ID NO: 256968 - DNA, 423 bp, Homo sapiens
cctgtgattcccaggtcctgctcagctgggattgaccatgtgactcaggcctgatcagtggggtgtgagatcagtgggtgaaattcttcttaggaaagctttgctcttgtgaaagagcactagattcatgaggcccttttctccttgaatatgggagtgatagctggagctgcagcagccaccctgaggtcacacatcagcagggatgaaaataaagccaatatcatagggatggtgggacaaaaagtgagaaagaccctggtgtcttcgtgaaagtggtgggtattattgcagcgagaaatacacccttagctgtttgtgtctgttttttatgtgtgattctgtggtaaaaaagcatccatgaccaattaagtaaatatttaacaccaatcaattaataaaattaacaataggcaaagattc

SEQ ID NO: 256969 - DNA, 356 bp, Homo sapiens
tgagacagagtcttgctctgtcacccaagctggagtgcagtggtgcgatctccactcactgcaacctcctcctcctgagttcaagcgattctcatgcctcagcctcccaagtagctgggattacggcacatgtcaccatgcctggctaatttttatatttttagtagagacggggtttcaccatgttggccaggctggtctcaaactcttgttctcaagtgatccacccgcctcagcctcccaaagtgctgggattacaagcatgagccactacgcgcagcccaatctaccaatctaccgtctttaactggaagcctaccattgttattcaaacttgagaattcagactcccaaga

SEQ ID NO: 256970 - DNA, 521 bp, Homo sapiens
ggcaccctgactttcgcccccttcttacctgagtatcagcttacttccatctggggactgaatatggggcagattccagaaaaaggaggttggggcaccaaaaccaacaccaactctgccaacggagccagcacagctatttgtctccaaccacaggccgcaagggaagttcacgggctcggcacccccaggtcccggatgtaaggatattgcccgttagacaaaggaaaggccccaagtccacaactcatgtttgtgagcttaaccttgtcctataaagcactttggaacaggcccaggttctcccaccatgtacagctgccattgacctggacagtcccgcaaggtccttcagtggaaacccagaagggagagtcactgcatgtgaaccctaagggttctggaggtcaaagttgctgtgggtgacaggcaaccaagactaagggcaaacttgaaacataaatgagttaaaacccacaaaaataagacagttttaaataactaaactgttttctcattct

SEQ ID NO: 256971 - DNA, 233 bp, Homo sapiens
gctggtccaaggtcacttcttattggttttacaacacctataagacataaatgttgactattttcactatcgtgggcggggggtgggggtaggtatataaactggacatatatcccagtagaagtgacaagtgacagccaaagaggcccaagggcatagccttgagatgaccaagaaacatccctatgagttatggacagagttagggaggacaaagcccccatggaagccgg

SEQ ID NO: 256972 - DNA, 435 bp, Homo sapiens
tgtaattagtcagcccctaattctgtctatagcttagactaatacttcaaaactgttttccaaaagatactcattcattcaacgtatatttagtgaaggcaaactatgccagtcactgggctaggagaggcatacagaaataaataaagtaaatatggatcctgcactctgagagcttacagttggggaaaaaaattaacaagtaaacaaatcgtgcaaaattctgtgaaagaagtgaatacggtgttataattttatatattaaatacgtatatatgattttaggtggataaatcccaaaaactaagagtgaataaggcaaaatgcaaacaataagaagtgtataatacaccatgtggtaaaaatcttgtactttaacatggcagagtctcagttacctattgtgtataataaacgacctcaaaattcaatgtc

SEQ ID NO: 256973 - DNA, 998 bp, Homo sapiens
acaattaattggtgttgacaccaggattggtatgcatatgtatgtttagaattttatttttatttttctggatataaatgattatataaagtaaaaggctggatgaacctaggttatactgtactacagctttccctctttgcccattgactctgtgcttctcaccttgagcatcactggaccaggatgttccttagtcatagtgatgcatcctctggcatttcttgaataattttcctgtcagaactcttactataagatgatcatttgaccttctaaaatgaagttttgtataggctaagtgcttgtggaagttctactgcaaacaccagctacaactgtaggcaatacaatcgaatacgaggtgtacaatgaagtaaaaaccattggctacttgtagtgggtttgttttcaaggagaaaatgaaaagtgataaaaaatagagatgtaagagagcagaagcaattaatagagtttcccttatttttggctctgatcaactatgacaaaattgttatttagaaatatgaaacttttaaatctttcatttttctaaaactctacatatatactgatatatataacataaaatatattctaaaagtctgaacacaaggcagaaactcactagttatacttaactgttaaaaataatttataagtttctagtgtttcagattataccaatgaattgcttattttcataacatgaggattttatcactttatcttacgaagattctcagtggtttaaagaccctaaaaatgaatgcttctgctattgtcttttcttcacggtttacagacatggtttaaagtgacaggattgttctctaatagagtatagagaacggccacgatttattgagctttgcaaggtgaaagagaaaattggcatcagcaagcataaattcccaagtagtaaattcccgcaaagtagtatagcatcaaaatggtgtagccacatttatattctgcccactctgaagtgaaatttt

SEQ ID NO: 256974 - DNA, 431 bp, Homo sapiens
atatactggtctctgaccctggttcctgacatggagctcctaaaacccttgtaatttctgaagtgaaagggtactaggagcatctttgttctaataaaatgactctcggtgggctcttagatgggggctgttctcgaggaagaccaagccatgattagaagcttggaacttctggagattgagttaataatgaatcatgcctacatgatgaagcctccataaaagtccctgaagtacagggtttggagaacttctgggtgggtgaacacatccgcgtgatgggagggtggtgcaccccaactccacagggacagaagttcctatgcctgttctgctttcggaccttgccctatgtacctcttcctctggctgtccatctgtatccttatcatatcctttattatataataaactggtaaacgtaagtgttt

SEQ ID NO: 256975 - DNA, 674 bp, Homo sapiens
gccagcgggttcgagtgaagatgagaaacaatcagatacacctgtttcctccaggaaagaaaatgtggccagggaaagagatgggaggaaggctggtcattgcctattccactgtgcacagtttgaatttggagccatgaaaagtattgcttggttaaattaaaatcattcaaaagataaaacataaacatttaacaccagcacaatatgctgggaaacaaaatgaaaggatttctggtctcggtgctgtaggtcacatagccactctttcctggattgaggctttccagcaaaggggctgggacgtaaggctggcctgctggtgtggacagagattccagcaacatgcatgacctgggggtacaaggattgcttcctaaacaatgataagcacacagccacctaatagtctggatcggctgagaccatcctgatttcaaacacccagtccccttgccttcctaagaacccctgtgtttctcagactgaaaatgtgttttgaactttgttcacgaagtgaggccgctgttgaaattcgtcaagactgggaaagagccaaagtgggaaggagcatgggttgattggcacaaaagtaggtctgctgataaagaatggaagtaaaggggccatcaggtagaagcttttgctgtgagtcagaaggacaatttaaaagt

SEQ ID NO: 256976 - DNA, 136 bp, Homo sapiens
attagaaacatgtacacttaaaatatttccataaatgggaaattgtttaattaatactttttgtttattatacacacacatagccatagaaatatctttaaagataacccaatgtctgtgaatgcttaattttttc

SEQ ID NO: 256977 - DNA, 1306 bp, Homo sapiens
  misc_feature (1294)..(1294): n is a, c, g, or t
  misc_feature (1300)..(1301): n is a, c, g, or t
  misc_feature (1306)..(1306): n is a, c, g, or t
attttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggtaagcctctgctcttcagagaatctgagaagcttcttcaatgccagagcaacataggcaatatcagagctatctaattcttataaaaggtgaggtttccaatgtggagtacatttggtagtgaagggcaaaccaatctaaggctggtttcctcatctgtgcaatgaagctaataatagcatctacataatgagattgtgaggattaaatgagatgatgcagtaagaaaatccttggcactatgcctggcaaatattaaaggttcgatcatattaatataattgtacttattatgcagttatttcttgtctctctgtactgttctccgagcattgtctggtttcgaagattttccagaatatggggatcagaaaacattgctttctccagtgctcaggataactcatagattcacggggactataagtcttatttctattaatttcatattgattttatttccaagactagaaagaanaaaaannaaaan

SEQ ID NO: 256978 - DNA, 1395 bp, Homo sapiens
attttgacagggaacaaagtgctaatgccatgtgatgccgttctgattgaaggcagctgtgtggtggatgaaggcatgctgacaggagaaagtattccagtcaccaaaactccgttacccaagatggatagctctgtgccctggaaaacacagagtgaagcggattacaagcggcatgtcctcttctgtggaacagaggttatccaggccaaggcagcttgctctgggaccgtgagagccgtggtactgcagactggattcaacactgcaaagggagaccttgtgagatccattctctaccctaagccagtgaattttcagttgtacagggatgccatcaggttcctcctgtgccttgtaggaacagccaccattgggatgatctatactctgtgtgtctatgtgcttagtggggaacctccagaggaggtggtgaggaaagcccttgacgtcatcacaattgcggttcctccggctctacctgctgctctgaccacaggcattatctatgcccagaggaggctgaagaagagaggcatcttctgcattagcccccagaggatcaacgtatgtggacagttaaaccttgtctgctttgacaagacaggcaccttaacaagggacggcttggacctctggggagtcgtgtcctgtgataggaatggctttcaggaagttcacagctttgcctcaggccaggctttgccatggggcccactgtgtgcagcgatggccagctgccactctctgatccttcttgatgggaccatccagggagaccctctggacctcaaaatgtttgaagccaccacctgggaaatggctttttctggggacgatttccacatcaagggagtgccggcacatgccatggtagttaagccctgcagaacagccagccaggtcccagtggaaggaattgcaatcctgcatcagttcccattctcatcggcactgcaaagaatgacagtcattgtccaagagatgggaggtgaccgactggcattcatgaaaggtgcaccagagagggtggccagcttttgccaacctgagacagtacccactagttttgttagcgaacttcagatttacacgacacagggcttccgagtcatagcactggcctacaagaagctggaaaatgaccatcacgctactaccttgacgagggagacggtagaatcagacctgatatttctggggctgctgatcttggagaatcgattgaaggaagagacaaaacctgtcttggaagagctcatctcagcccggataaggactgtaatgatcacaggtgacaatcttcagactgcaataacagtggccagaaaatctggaatggtttctgaaagccagaaagtcattctcattgaggcaaatgaaaccaccgggtcc

SEQ ID NO: 256979 - DNA, 330 bp, Homo sapiens
agtctcagcaaattgcatgtgatgtgcatcccattctgatttaattcttattcagtcataaatctattttcattctctaaagaaaaaaataaattaaaaaaattctttaccatgactttagaggaaatctagaacaactgtcataatttcctaggtattattcttaggtaataataggccatatggctactttaaattagcaaaattcagttttaattatgtaatttaaatattcaaagcttctattaatgtgaagtttctctcttcccacagctaactcttattccagggagaaatcaacagttgcagagagaggtacagtcaattttt

SEQ ID NO: 256980 - DNA, 229 bp, Homo sapiens
agcacctccaacccaggaagggtggagtaagctaagccaggtagaagccttcctgatacctcgatttcccacggtgtgattgagatcccatttcctctgttccatgtccatcctgggcctgccaggtccagctttctgggtggccaactcagaataagactgcagcctccctgcccgctcctggattatttggagtctaagcagaggacatttgtgtgctcctagactc

SEQ ID NO: 256981 - DNA, 364 bp, Homo sapiens
gctttgtttctgtcactgcaaatcaaagagcccagcctaaaatcctctgtagccttcttatttcccccacggcatgtggccactctctaccctctcgcaagccttgccagagatgccatcctccacttccactgggcacctggagcctgaacctggaatcttccaagaccccagatcagcctctgctgacagttctcttgtaaagatactgaggataggattacaggtagtggctcacgcctgtaatcccaacactttgggaggctgaggcgggtggatcacttgagctcatgagttcaagaccagcctgggcaacatggcaaaactctgtctctacaaaaaatacaaaataatacaaaaataa

SEQ ID NO: 256982 - DNA, 298 bp, Homo sapiens
gcttgggaggggcctgaacaccaagcacctcacctcctagggcagctgacctggggctccgggtactctgagccctgctgcccattttactttttattttacagacaggaaacaattatacataaatgataaaagttcagagttcagggaaagataagtcgacccacccaaggtgatccctagctagtccttttctctaaggttaacagagcttcaagtttcttccatgctgttggtgaaaatgtgtatgtatcataacaacacacatatatacatgactgaagagtcatcctattta

SEQ ID NO: 256983 - DNA, 349 bp, Homo sapiens
cggcacgaggaaactataggtaaagaagaccctgaggttgaggtggaagagtgaagaatgggggaaccaaaggcacttcactctgccatagcagcccctagctgggatgccaaatactgcttggaatgtgaagctgggactatggggttgaggcaggccatggaggttgtagtggttatatgtgctatgcttactggatctgggctttgctaatcaagttctgtaccaggcagtgccttatacagcaccctgtactctacaccagccagcacagcgcctgcttcctctgcagcaatgagaaaagactgcccacactctcttctctccagtaaacacggttctccctgca

SEQ ID NO: 256984 - DNA, 705 bp, Homo sapiens
gccaatgatgactttccatttacaaagaaatgaacaaattaaataacatctgagtatgcatgtttaacattctctgtatttattaaaacacaactaaagctaaatatcattttgatgaagtttatctgcattttttctttttctagtctgactgtggcttttctcttagactgtaacagtttttgcaaaagttccatcagaagatttaataaactcttcatgcatcttttggagagttctaatctataaggctgaaaagttaaaaagtaacgcattggattttgttcaacctgtttaacaaatttattggatgagtaaactcctccctaatcctctctccctaccactgtaatatctgttcagatcccaagtgtccgtaggacatattttagagcaaagtttgactgacattttagaagaatgttcgaccaagaattttcaattggaaagaagttgacgtgagtctgaagttgaacagtcttggtgctggggagcttcagatcagcctagcaaaaagactctcagaagaccgtttgtcttgtgaaagggatttttagctacctacgtaaaacttcctctggaaagatctgatttgcactctgtgatagaaaaggcgtaggtttgggtgtcagaaagacctaatttgaatctacaaccaagctattaggtgagtgaccatggaggatgtgtccttacccttaattt

SEQ ID NO: 256985 - DNA, 427 bp, Homo sapiens
attctttgcaaaagcaattggattttatcttgtagtcaatggggagcaaattaaaagattttaagtggtgtgtattctaaaaagatcactgtgggatgggtggctggcaggggatgggaggatgaagaaaagttgggtaatgggggccgggcacggtggctcactcctgtaatcccagcactttgggaggccgaggcgggcggatcacgaggtcaggagatcgagaccatcctggctaacatggtgaaaccccatgtctactaaaaatacaaaaaattagccaggcgtggtggcaggcgcctatagtcccagctactcgggaggctgaggcaggagaatggcatgaacccgggaggtggagcttgcagtgagccgagatcgagccactgcactccagcctgggtgacagagcaagactcttgtctca

SEQ ID NO: 256986 - DNA, 360 bp, Homo sapiens
tattctttgataaatttagcacctggctcattggggcttttttcattattattctgatgttattctcactcacttccttctttctgacttcaatgcccactcaaatattacatctaataccttagactccagtttccagatcctcctgccttggactcccaaagtgctgagattacagacatgagccatcacacctggccctgtgccatcagactttggcacctattccccttccttgttgctgtcatctagagaattcagttaactttattctttgataaatttagcacctggctcattggggcttttttcattattattctgatgttattctcactcacttccttctttctgacttca

SEQ ID NO: 256987 - DNA, 192 bp, Homo sapiens
cagttttttatactaacttgatatgtgacatgagaaattgtgtaagctttacttgctgttgtttcttcagtgtaaaatgtcttagataataaaactaaatgataaagtagatacagggttaaaggatatgtatcttgtcccttttacattgtaagcattcaaaataaaacaaaacaattaatgaagaaaaga

SEQ ID NO: 256988 - DNA, 427 bp, Homo sapiens
tccaatccctgcttttggtgctaattttttcttctttaggtctttcatggggttttgttcatctgtctattatagaatttagagcataatgtttccttacacacctgcctgtccacaccaaatgtgaccagtttagaaatagtccctttatggttttcttaaatttgtctactttgcatatattgtgagaagatccctttttacaataaatatggtgatggatacttctgcttctgccaaaaaaaaaaaaaaaaaaatgtaaaaaggcgggttgaatattgtgctgctcaactgaaaagttaatcttgtctacacccatactaccccgaacgcacccaatctcgtttgaatattatactgcctcgtattgactctagataacatgaaattgatgacatttcaccctgactcttttctgctttgctgc

SEQ ID NO: 256989 - DNA, 483 bp, Homo sapiens
ggttgggtggaacttgagctggaggtggaggaggatttgggttggtggagggcagagaggagggccgtgcagagcaggggcgtgttgtaggagaggtgctccctggagctcattggatggggatcttagaggacaggagcttttatgttcatttttgtattgcctgaactcacacagggcctggcactttgggagtattctataaatgactgctgaatggaacgatggtttgtaacctattaacttgtcctgatgtgttagaaagtgggcaaaagtgaagcccattagcagaaagaaaatcttactgaaaaatggtcccatgtatgcatagagcctggtgcggccactttacttacttatgctgctgagttctgcatcagtccacaccgaggccaccgcaggggttgggagcaactcctcagacctccctccgggtgcctcagtctctttaccccctgttcttccaggtcctgctccctgtca

SEQ ID NO: 256990 - DNA, 361 bp, Homo sapiens
atcacctgctccccaaaaactattgaaataaaaataaaataaaatagtttaatagtttctttaaaaagttaaacaaacacctatcatgtgatctagctattccactacaggtatttacccaagagacaggaaaacacatgtccatacaaaaactagaacagaaatgaccatagcacctttatctgtaatagccaaaaaagggaaacaacctaaatgtccatcaacaggcaaatggataaacaaactgcgatatacctgcacaatgaaaaacaactcaataataagaagcaataaactactgatacagcttacaatgtgaatgaatctcaaataaatacatcgaggcaaaaaagccagacat

SEQ ID NO: 256991 - DNA, 280 bp, Homo sapiens
tttgcagtgacaaggtctccctatgtgttgctcatgctggtcttgaactcccggcctcaggcaatcctcctgtctctgcttcccaaagtgctggaattacaggcgtaagccactgtacctggcctctcccatccaatctttatccctctccttcctttttcttctcctggcttttgacccagctaccaaggatccactgggggaactccaaggaactggtggataatggagccccaagctggaaggcgcttggtttccaaataactgcagcctctacacc

SEQ ID NO: 256992 - DNA, 395 bp, Homo sapiens
tctgttgcaggggtcaccggccaaggaggcggtctactctgtgggtcctccccgctgcagggcacacagagtggcgcccgtggggctgagcacgaggcagtggctcctgaccctcctacagcatcagcaccgcctctgccggccgctgccgggagtccaggaccgggcggacaggagaagccccacctttggctcagcacaaagcccacagcacagccccggtgcacagacgcggtcacatgcacgcccgtccacacacacccagagatggctacagggctagtggatttttccccagactgggcacccaggagtttttaactctcaagcaattcatcactgtcaccatttaagtatttctgccagtttattaaaagttatagaatcctttagta

SEQ ID NO: 256993 - DNA, 701 bp, Homo sapiens
gtacattgggtgcctaattgtagacagtgctctgaaggagatttccatggtattatggaggtgtgtgacagagggaccagtttgatccaaggggtagtcaaggaaggtttcctggaggtggggacacttgagtcgaagcctgaagaacatttggcagttaactgggcagaagagaggggatgggatagagatagaacattccaggctgaaggaagtctcctgtgcaaagctcctgagataggaagatgtttgaggcacttgaagatagctgatgtggctgtagttgggggtgcaggggagagagggattggggaaaggagagaagtccacacagagccgcgaagaccatactggattctcatcatggtctggagggcaggacccaggggtcagcaagccctgcagcttctacagattcccactatggcacccattaccctctatgatggcccgtctcccgtccagccccatcctcacaccctggagtaactgatgtcattgacgtgccacatgaccttcaacccatggcttattcacagccttccaaccaactttagtatcactctgggatgccctttctccatcttgaccagctgggtgcatgcccagttctttttgtaacatttaccataacaataatgttctctctttctattatagttgtccttattatcctgttactttttcattcattttcctcg

SEQ ID NO: 256994 - DNA, 393 bp, Homo sapiens
ttttagaaagatcttggcccggcgtggtggctcacgcctgtaatcccagcactctgggaggctggggtgggcgaatcacttgagctcaagagttcgagaccagcctagacaacatagcaagacccctgctctacaaaataataataattacatatatgtatgtgtgtgtgtgtgtgtgtgtgtatgtgcatatatgtgtatatgtatatatatagtatatgtgtatatatatgtgtatatatatgtgtgtatacacacacagaaaaaacattagccaaccatagtggcgcacacctgtagtcccagcttcttagaaggctgaggtaggagcattgcttgagcccgatcacaccactgcactccacctgggtgataaagtgagaccctgtctca

SEQ ID NO: 256995 - DNA, 496 bp, Homo sapiens
cttaggattgggctcaggtgaagggaacccagaagcccaacatgccggcaaaacagtaaagtttttttaaccagtcaggcttttggctttcctctccctgtgcaaactggtaaaaaggcctcggaatttttgatctgtccttacccctccccttgttttgttttgatacttgttttctaataaaccggtttgtctgttctttccttcaggccatcaaactccaaacagtcatgcaattggagcctctgatgatggccccatctgccgggaacccttagataagcccctgagggacctcagactgccgtttccacaaaacggcgtcccctgtcagcaggaagcagttcttcgtccttaactgcagttagatgtacttctttagagggaggaaggagacagtcaggtgggagggggtccctggggaaactctagccagcctgcgcactgagttggagcctcgggaagttcatgtttgtagcagagagaactaaagagc

SEQ ID NO: 256996 - DNA, 405 bp, Homo sapiens
ataaaaaaccaaacatcgtatgttctcactcataggtgggaattgaacaatgagaacacatggacacaggaaggggaacatcacacacctgggactgttgtggggtggggggcggggggagggatagcattaggagatatacctaatgctaaatgacgagttaatgggttcagcacaccaacatggcacatgtatacatatgtaacaaacctgcacgttgtgcacatgtaccctaaaacttaaagtgtaataataataaaattaaaaaaaaaagtttaggaaaaaaaaaataaactgcatatatggaacgtaataaaaaaaaaccccacaatgagataccatcttataccagtcaaaaatggcaattattaaaaagtcaaaaaacaacagatgttggcagagttg

SEQ ID NO: 256997 - DNA, 318 bp, Homo sapiens
tcagatatgaggatgggattcttacaaaactgacttaacaggattcttgctcttgaggacaaggcccaagtaccgggcctagtagagaatgggctcaaaggaacctgactaaattttgcttaaggagagtctttgtcagtagtcatcatacttaaattgtttatttttgccaagtacctcttaccaaagctttataagcatttaattgtgcttctcattatgagaacagataaaagaaaaggctattaaaagaaaaggaattgttattagccaattcataaagtaggagagagttgttagacccaagatttcagagta

SEQ ID NO: 256998 - DNA, 406 bp, Homo sapiens
acccagtcagaggtcattgttatcagtcctgttgttgttgctgtcactattattttcaaaagaatttctgcagcatttataaaactgaactgatttatcaaatcatgtactcaggcttgagtttcttcattttctacatattttgtgtatcttgtttcagaagcatttgctaatgcttgcgggaccatctcagcattcagcaatacatattaaagaatggcatgtaggtctgagtctaccttgtgaataaatccctcctaataaaagaaaatgagatttcatgattaaggggtttagaaataatcaagagagggttaaaaataaaactagcggaggccgagtagaccaaagaatagctactggcatgccttccaaaataatgtcccagattatgatttcacatgaa

SEQ ID NO: 256999 - DNA, 171 bp, Homo sapiens
aacaggtgctatctatgtattacttgtgtaatttaacaaatgttccagctgggcctggtggctcacgcctgtaatcccagccctttgggagcctgaggtgggtggatcacctgaggccgggagttcaagaccatcctggccaacatggtgaaaccccatctctactaaaaa

SEQ ID NO: 257000 - DNA, 472 bp, Homo sapiens
aattttggaatcttctttgtggaaaccgtcaggaaacactgacatgtgttttcacccagcagcaggcgaaagggcttggatgtggaataagaatagctggcagatgattgagctataggctccagaggaaaggtacactccagaccagctccagagaacgagagaagacttcccggaggagacggtgctaaatccgaagggaccattaaggatgactagcgggatattgatgaagcttaaggtctcatgcccaggatgctttcttataggccaaatggtatcactccattctactggtgtcagctgcttgaaatagtgtagacacagagaattctgggacccgtgtcgctcagaaacaatgtcaaagtcctggctgaaggtatctacattacccacgaattgctgtatatgagtggaatgtacaagcatggatgcaacagcaagagaactaaatttgttttgtgcttcaaaa

SEQ ID NO: 257001 - DNA, 459 bp, Homo sapiens
accccatctctactgaaaatacaaaaattagccaggtgtggtggtgggcgcctctagccccagctccttgggaagctgaggcatgagaatcgcttaaacccgggaggcagaggttgcagtgagccgagattacatcactgcactccagcctgggcaacagagtgaggctctgtctcaaaaaaataaataaaaaggtgtcagcaacaattcccatggtggctcagcccccaacgtgctgtgtgacacaaaacaactaagagtacaaagtcacaagaagcagctcttctttttcgcattgtttttaagttcagcaagggcaattcaaaatatcactctccaaaaatctcttaagcaatgaaacatcttacagcctgggtgtatagtccccaagtggctcagcgtcatcctcttttggggacagtgccaagatacttactggcaatacattatcaagtaatg

SEQ ID NO: 257002 - DNA, 446 bp, Homo sapiens
cagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaa

SEQ ID NO: 257003 - DNA, 254 bp, Homo sapiens
aaaataccctgaaacgtaatgccaaatgtacagtttataggttcgtgttatttctgataagaatttaattgcattgtgctaatagttgtttattgctattaactttctgtgtatgtattattgcgatgcagacccaatagggttattttaagcacactaattagtcatctggatttttatagataaaatcacatgttgatcagaaatcatttttctacttatttttttgtagagtatttttccacacttgaaaa

SEQ ID NO: 257004 - DNA, 783 bp, Homo sapiens
  misc_feature (3)..(3): n is a, c, g, or t
  misc_feature (10)..(10): n is a, c, g, or t
cantgatacntcacgtagcggcccacccacccacataaactgtagggaaccccgttcaccaacggggaaccccattccaagggaatgtgttcaccggcagagctgggattacgtctaagatttgtccagggggcgagaactgcagcgacaccatgatgatttatcatctccagacaacacaaaaaaaaaggcctagacacataaaaatggcttctctgtagagtgagctcaacgagctcaatgtgattccagttaaggaattgggccttaagccaaatgcgcctaaacgcaacttgcctctctattatttatccagaggatgaatttaattcctacgtacatgcgcccacatctcgtcagctggtgcctcagagaaatgcgctgacaaatcttaaaggtggggcttcatgacaaaagtccgcccgttattgctgctcaacagacccatcaagtcacgctgttggacaggcctcgtggcgcaacggtagcgcgtctgactccagatcagaaggttgcgtgttcaaatcacgtcggggtcaaacaaaacattgttttccctaatcaaatagacctacggtgacatttttcaggataggaaaaaaaaaaagcctcctcagtagaaggataggaggggaatgagacaaatatgaacgttattcagaagttgggtgcagactttcaacattatgtgatatatccctgtggcaaaactgcgcatgtatccctaaggtctataaaagtaaaaataaatttaaaaataaaaaaattccctgttgtatggaa

SEQ ID NO: 257005 - DNA, 755 bp, Homo sapiens
taatggctgccgtcgtctgcccagcgcgcaattgtgagtgaccttcaccgctagcgcgcgccacccaccccacatgaacctgtagggttatgcccagtctacagacgaggaaaccaagatccagggaagctgagtcaccggcagagctgggattacgtctaagatttgtccagggggcgagaactgcagcgacaccatgatgatttatcatctccagacaacacaaaaaaaaaggcctagacacataaaaatggcttctctgtagagtgagctcaacgagctcaatgtgattccagttaaggaattgggccttaagccaaatgcgcctaaacgcaacttgcctctctattatttatccagaggatgaatttaattcctacgtacatgcgcccacatctcgtcagctggtgcctcagagaaatgcgctgacaaatcttaaaggtggggcttcatgacaaaagtccgcccgttattgctgctcaacagacccatcaagtcacgctgttggacaggcctcgtggcgcaacggtagcgcgtctgactccagatcagaaggttgcgtgttcaaatcacgtcggggtcaaacaaaacattgttttccctaatcaaatagacctacggtgacatttttcaggataggaaaaaaaaaaagcctcctcagtagaaggataggaggggaatgagacaaatatgaacgttattcagaagttgggtgcagactttcaacattatgtgatatatccctgtggcaaaac

SEQ ID NO: 257006 - DNA, 310 bp, Homo sapiens
atcctcttaagtctccataggccaatgcacaaatgatttagccgttccaagacgccattagattatggaggaagggtgttaactgtggtttctcttatctttaaataacaacttcctgtattagcctggcatgaagatggcgccaggcaaaccaaactgtgattctgctagtcccaccaaacaagacagggcaggggacaagggggatgggagcctctccatatttggaatgttcctttctgcttgcaagcaggcaccagtgtaccagcttggtaactcatttaaatatacatatatttaaaacaatagt

SEQ ID NO: 257007 - DNA, 285 bp, Homo sapiens
tcattgtttgaaggctggtgagagaaggggttacctgctgcacaccagtggggagtgacatactcctaacacatgccagaaacaaaaagtttggtcataaaacagttctaataagaaatctgcctggcctgctcacacctgtaaccccagcactttgggaggcagagggatcagagcccaggaatttgagaccagcctgggcaacatgaggataccccatctctacaaaaaataaaaaattagccaagcatagcgatgtacgcctctagtcccagctacttggga

SEQ ID NO: 257008 - DNA, 482 bp, Homo sapiens
acaggttctcgctgtgtcacccagcgtggagtgcagtggtgcaatcttggctcactgcagcctcgacctcctgggctcaagcagtcctcccacctcagctccttagtagctggaattacagatgctcactgccacacccagctaatttttgtattttttgtagagacagggttttgccacgttgctcaggctgatcttgaactcctggactcaagtgattctctttgccttgggctcccaaagtgctgggattataggcaggcgccgcgacatctaattatttttttttaaattgtggcaaaatataaaatttaccatgttaactatttttaaatgtaaagttcagtggtattaagtacattcatactgtgctaccatcaccactattcatctgtagaaattttctgtcttcctcagctgaaactctgtacccattaaatactaacctcccattccaccacacccccagcccctggcaacca

SEQ ID NO: 257009 - DNA, 683 bp, Homo sapiens
cataagcacaatcaaaggacagaggacagacttgaaacaatactggcaacacatgtcacaaaaacaaacagactttctgtgcaaaagcttcattacattgataagaagtacacaaacgacctaacattcatgagatttcagctcagctagcactttcctaaggccagaaaaatgtacagccctaagaatatgcattccctctgaccagcaattactcctctgggaattgacactgaggacatatcctaaacctagatagagtcttatgcataaaatgttgatctcaacattcatagattataaaaactggggccaagcatggtggctcacgcctgtaatcccagcactttgggaggcggaggtaggcgatcgcttgaggccaggagttccagaccagccagcctgtccaacatggtgaaaccccgtctctattaaaaatacaaaagttagccggtgtggtggcacgcacctgtagtcccagctcctccgaggctaaggcaggagaattggttgaacctgggaggcagaggttgcagtgaggcgagatcgtgccactgcactccagcctgggccaacagagcaagactccgtctcaaaacaaagcaaaaaaactcatcaagctgaatacttaagatctgcattctactgaatgttaattatatctcaataaaaaataaacacac

SEQ ID NO: 257010 - DNA, 334 bp, Homo sapiens
acactcttaaaaatggtagtgttttaaaggatatatttatcttcttttatcttttctttttttgcttttttctttttgaaatggaatctcactctgtcgcccagactggagtctagtggcatgatcttggttcactgcaacctccacctaccaggttcaagtgattcccatgccttagcctcctgagtagctggaattacaggcatgcaccaccatgcctggctgatttttgtatttttattagagacagggtttcaccatgttggccatgctggtcttgagctcctggcctcaagtcatctgcctccctcagcctcccaaagtgctaggatta

SEQ ID NO: 257011 - DNA, 201 bp, Homo sapiens
gcccatgtaattttagagtttaagagaatgggaagttgtatgagttgttaaagtttgaattgggggcagccaccgtgcctggccaattgttgcttctttgtgtaagtttttatttgaagaaaaaggccatttttttgtgatatgtgcagtcatcctaaaagacctatgggcaatacagcaagactccatctcaaaaaaaaa

SEQ ID NO: 257012 - DNA, 338 bp, Homo sapiens
accagggtctgatagatagacagacagacagacagacagacagatagatagaacacagcaactttcacccagcaccgtccaggagaaagaaagagacacagatgctggtggccacacctactcgggtcattccaagggcatcctgtggagcagggagaattcacccctcatcaggggctgtatgacatttctgtaacctgtcttggctctgtacttcctgattacaatttggcttcccatgtggatgtgccaacagggacaaagtgtatatgtcaactgtgtccatctgtactggagaattattgctagccataaatgaacagttctgaatgaaaaaa

SEQ ID NO: 257013 - DNA, 440 bp, Homo sapiens
tacatctatattctaggtagataaagcaacattatcaagcacaaagaagcatagattctccaagcataaactaaagtgtaccagtaatgaataaagtggcttagacagcaaaagatatgattctcttagaataagaaagccaaacattcttaaacagccttagaaactacgtgaagttttaacaattgtttatatgggctagtcatagaaagaaacagtctgaaaaactcataaaagattcaaatcagatgtagaaatcaagcttatgaaagatgtagtgttaagattcggcattaacatttaagagaaaactaccaaatttgtatttatattcatttaaatagtgctaaatatgtgtatcttctcattccactttgtacttcagtttctctaagtaaaatggggtatgaatatcaaattaaaaatatatttaaagcatt

SEQ ID NO: 257014 - DNA, 383 bp, Homo sapiens
caagattgcaccactgcactccagcctgggtgacagagcaagactccatctcaaaaaaaaaaaaaaaaaaagaaaagaaaaaagaaagtgaagacttcaaccttaatcaagaaggagtttaagatgcctctagcacttccaggtagaattggtagaaaaggagagatgtctatctagagataagttctataactctgtctatatagatacacagtatacatctatctatgtatttgttgatactataatctatatggtgggtgaaatcgggatgaataacatcatatacagagaatatgtaaagtaagcaaagcagaggacctaagacaaaaaccctgagggaccccaccatataagggagggacagaggaggagaaacctgt

SEQ ID NO: 257015 - DNA, 608 bp, Homo sapiens
tggactgggaggggcaggttcaccctcagtctgtgtgggcactgtctaatcagctgccagtgcagctagaataaagcaggcagaagaagttggaaagagcagacttgctgagtcttctggccttcatctttctcctgtgcaggatgcttcctgccctcaaacttcagactccaagttctccagcttttggtttcttggacttacaccagtgatttgccagggactctcgggcctactaccacagactgaaggctgcactgttggcttccctacttttgaagtttgggggctggcttcctagttcctcagcttgtggatgacctactgtgggacttcacctcgtgataggtgagtcaattctcctaataaacttaagtcaactctccctgtcatttatacttatatcctattagttctatcccttttgagaaccctaatacacctagacatgtacagccccatccaattcacccagtgtactccacctctctttcaatggcacaaaactttcaaattccaccaatttttagcaagatatcttagactcctagaagtctgtggtgatatgacaaaagggaggtgactgaaatctgcacaagatcttcttt

SEQ ID NO: 257016 - DNA, 667 bp, Homo sapiens
caataggattttttcagctttattataatctttattattattatgcagagacagggtctcgctatattgtccaggctggtttcaaactcctggcctcaaggaatcctcccaccttggccttccaaagcactgggattataggtatgagccaccgccatcgtacgcttatggaactactgccttataatgtggtctattgttgattaaactgtctttatgcggggcatgctgtaccagccataaacaaacataaaacgaaattttaaagcaatactatttataagagtatgcataaacatcaaatacctaaaaacaaatctaacaaaaaagagttgtaagatctctataacgaaaactgcaaaacatgatggaggaaatttaaagtcctaaataaatggagacatatactatgttcacgtatttaaagacttctgtaaagataccaattaccatcaagctgatctatagatcaaattcaatcaatagattaaattccaaacactctcagtggaaattgatgaattaattttttgcactttattttaaagaataaggggccaaaaataaccaagacaatgttaaaaaacaaagctagaggtccttaaacttgaagttttttagtacgtcagaattattttactatcatatttattttatcagtatgttc

SEQ ID NO: 257017 - DNA, 420 bp, Homo sapiens
agccgacaccaacagactcttagctcctgtgccctgtgcatcctggtgttcgtgcacgtgctgcacggatcatttgctctggagaaagccagcaggcatgagaggcccatgtggtgaggaactgaagcctcctgcccacagccacatgtgtgaacttagaaattagaagatcttctagcccagtcaatggctgtacaatggctacaaccctggctaataccttgacttcaacctcacgaaacactgagctagaaccacccaactaagctgttcctagattcctcaccatcaggaactgtgtgctgtaaaaatgcttgttattataagccactaaattttgaagtgttgtgtgacacaacaatctgtaaataattcagaatagtaaaatatgaatgggaacacaaatgtacagacatggta

SEQ ID NO: 257018 - DNA, 310 bp, Homo sapiens
aagcttatcagttgctaacccaatacaaggaaagtgaagatgcagagtaactgtggcgtttggcacgggcatcacgtgatgtagctaagcttaccaggttataaaattgtcagatttgaggaagccttttgaaatagaggtggaattggatctgggaggtacatttttcagaatatttggggatagttgatgagtagatgaaataatgtgcttagtataatacatatctgtcaaactagtgaagaataaaaaaaattaataaattaaatacataccagtataaaactgtcaattggcatatccaagaaaa

SEQ ID NO: 257019 - DNA, 420 bp, Homo sapiens
gacttcgtgaggaattcataggggaagaagatgcaagtggctggtcatggagaggactttttgacgagcgccggcaaaagagcacagcgaagaaatcctaggatacggaaagccctctgtacttgcaacaagagtctcactgtgtcagccaggctggagtggcatgatctcggctcactgcaacctccgtctcccgggctcaagcaattctcctgcctcagcctccagagtagctgggattacaggttctgcatgcgcagcacttcgtatgtccaactctgctctggaggacccacagggctcagggcgtctgcctgctccaagaggctgcataggtcaaagcatagccaccataacacaagatgcaacatcttccctggccccttgactatcttttcgataaaagccattataactagg

SEQ ID NO: 257020 - DNA, 338 bp, Homo sapiens
gacttcgtgaggaattcataggggaagaagatgcaagtggctggtcatggagaggactttttgacgagcgccggcaaaagagcacagcgaagaaatcctaggatacggaaagccctctgtacttgcaacaagagtctcactgtgtcagccaggctggagtggcatgatctcggctcactgcaacctccgtctcccgggctcaagcaattctcctgcctcagctactggggaggctgaggcaggggaatcgcttggacccgggaggtggagattgcagtgagccaagatggtcctgctgcactccagcctgaccacagagcgagactctgtctcaaaaa

SEQ ID NO: 257021 - DNA, 479 bp, Homo sapiens
cagggactggtgaaatatataaatgaaaatactactcttgtttcttggcatggagaggactatatttgccaacctccctgccatttggcctaagggatgtaggcagacatggtgggcaactccttattaaagatccggtcataatcatctctgccgtctcttctttttcttgaaaagacaggaggccacatgttgaaggcagcagggtcacaagatggaagaaccagggtcccagtatcatcgctccctgcttcaagctgccaggggcagcctaacccacatggcattatgacataagaaacaaagtaactattgttttattaaatcaatgagatattgggcttcttgttatagcaactagtataaattgccctgactgatacattatggatttagagtgcactgtactacaactgtttgttgtattttcaaaattgtggtataactgacttacaataaacttcatatatttaaagagt

SEQ ID NO: 257022 - DNA, 343 bp, Homo sapiens
  misc_feature (88)..(88): n is a, c, g, or t
  misc_feature (215)..(215): n is a, c, g, or t
ttctagacctccctcagggttcagccacttgaagatcatttccacttgaagaacactttctatggaaagtattcctcacctaatggcnttactttgtgccccaaaaacaagggctaaagaaatcacgctagactttatccactttgccatgcctgtttggcaatgttgtttaggtcttaacacttcatgcctatattctaagtccttgcaaggcnaggacctcatttgccacactagttaattattttgtatctccccaagcaataaatccaatcccatgaacacagcaggacttgctaaatgcacccactgcttctgcatctactgtgtgcatgacaacttt

SEQ ID NO: 257023 - DNA, 326 bp, Homo sapiens
cggtatgtccagtgcctagaaaagtacctggtaagtgttgtgaggtatttcctgaatagaggttgaatgttgtgataagtttcactgtgactcctcatcttgtacctgcacttgcaagtttcttcttgtctgcctggggcgttgcgctcagcaccttcagcccccaccactcaaggttcctgtctgcatgagtgtaatcaccatcgagtgtcaacagcaccatccctttccccactctcattcagaagctcctcatctgctctgggatgggacaaactcactcttgtgtcatcattctgccaagtttattaaaactcaaaatgtga

SEQ ID NO: 257024 - DNA, 668 bp, Homo sapiens
aagaaggtaaggaaggtagtcaaaattaacctaaaagaaatgagtagagaattagtttgaaaatggtcctaataataacaaaattaattggatctgcaagaaggaaaatatcaatttagactgatgagagaacagatttattggaagatactaggacttgctacaaacacaatctcatttttttcaatgcatgtttccgtgtgtgtgcctaccatgtggtaggttcttgatactgacaaagatgaacataacaaagtatctactcttaagagccaacctggaaagcacaaattagtaaacaggcaattatacaatctgggaatctaaattagactgagggataaaagaagggctgggagtacctctttctaatctaggatagaggaggaaggacaaagctagaagaatttagggatggattgaaggccattccaaaagaaggggagtttgtaagaatatggatgtataaaagagcaagtagaaatggccatcagttggtgtgaaaaagtgacaattaggctaaaaaggtaagcatgggtagaccatgagggtttttcttagctaaacagggaaaattattattattattattattattattattatttttggagacagagttttgctctggttgcccaggctggaatgcaatggtgcgatcttagctc

SEQ ID NO: 257025 - DNA, 331 bp, Homo sapiens
gcccccacccccccccttgcagaatcctctgggacagctccggccccactcttgactcccaggtgggacaggaaggcccattctgaggaaatgggtcagggaagcacctagttaaagacctgggctcaccagtctgaggggagagagagccctgcactgagagtctcctgactccagctctgcccttcccgttcgctgaatcactccccacaggcacttaggctctctgagcctcagttttttcatttgcaaagagggctgagaaaaggagtgtctctcttctgctcccaaacttccagtagcttccattaaaatccaaatgctttgcaat

SEQ ID NO: 257026 - DNA, 173 bp, Homo sapiens
  misc_feature (53)..(53): n is a, c, g, or t
  misc_feature (93)..(93): n is a, c, g, or t
agttgatggtaaggccccaagaagagagtgaggtttagacattctgtgttttnccctcaggggaaatcctggtgcttttgtttctaggtgtcnagataggaaaattgatattcaattataaaattcaaggcatttggttttcagtttcttactatgtatctacaacatggtga

SEQ ID NO: 257027 - DNA, 247 bp, Homo sapiens
tcacagaaattgataccaatacctgttattactcacaacaatgcgtcatcctttattaggctcctagtgccttttggccattttacactaagacaaaaccactaactgctttaaaaggcgttggtcacaacttttatgatttgagattaatcaaaggcaccgaatgtcagagtctcctacagaactcagccaacttttagggcaaggctctgtacttctccatctttagaaggaaagcagggaaaac

SEQ ID NO: 257028 - DNA, 423 bp, Homo sapiens
cagaacagcggaacagctaaatattggagcacctcctgtgtgttgaccgttccacaacatggaggaaactggtcttcccttggaagagcctcccccctattcaggtagtaagagaaataacatacccagggctaggcataacgcagacagtgtcataaaggaggcattgaacaaaggagagagtaactgaaggaggtggcatttcgagtgaccttggggctgattagggtggttacaggttgatgtttatatatatggcatatatgttgggggattgggtggcggagaggggtgcaggcagtcagaatagagcaaagagaggagtaagtatagaatggtgtatcaaatgtttatccaaaagcaggatatggaactagtaaacattttattcacagtgtgtattttttctgagagggagtctcg

SEQ ID NO: 257029 - DNA, 409 bp, Homo sapiens
acacattgagtccagaatcttggcttaacgtttctatatcaagatttcatccttgtccaatattatattcctttcctcctgatcagacccttaggatccatttccatgcatgttcctcgggtttctgtctatataaattgataaactcttgcaatatttagatgtaacttgcatcctctcatggttcacactttgtaactcacactctggggcctggtgagacttgaatctggttacaaatgtagaaacaagaggcactgaaggttttcaggaaggttggcaatcctttgcaagacaattaccttgaaagaagttatcacaatctttaaggcaaaggaatactaactttaatcttggagaaagggtttccatctgcaaaaggggctctgaagaatttagagattcatgg

SEQ ID NO: 257030 - DNA, 347 bp, Homo sapiens
tgggttgcttcactggttttgcttcttagctctccagttacgtgttacaaattccctaattaatttcctctgcttaaaatacctagagaggagaggtttctgcttcctggctgggtcttgattgattcactgatcacaggtatggagtaagacttggacagtcagagcataggttgtcaactgttccagatattaaccaaggtcaagtgaagcactctcctctccaagaaatttcagcatggagagaaagaaagttttaccaccaatttgtgcctgaaacacaagatgaacagacgtcttctgcattaaaaaaggacataggcatgcattaaatcccttatgtctta

SEQ ID NO: 257031 - DNA, 235 bp, Homo sapiens
gagccacctcccccggcctttttggtttttttttcaaattttagtttaagttctgggatacatgtgctgaaggtgcaggtttgttacataacccgttttgttgttgttgttgttgttgttgtttgttttttaccacaaatggggaggtaggaaccgcaaagaaacactagtttcttagtggaccgccagctcttggttcactgatcaatcgcacccaaactccttcactaactta

SEQ ID NO: 257032 - DNA, 582 bp, Homo sapiens
acaaatttggattaggcagcatactgccaacctacgttggcatactacaagacaagaaaaataaatattaacttaaaaagtgaccagaaaataactgaagacaaccaaaacacaggaaagataaaaagaccaattcggatcatctgtctcaacagcagcaggcttacgattcaattttttttaagttaatacaaatattcagttacagtttagtaactcctttcaaaaattcattcctcaagcagctgatgtcagagaaatgtgttgctgcactaagaggcttccccaagactttaacacttaaaactgatggaagaaactaacagaggattctgcctgtttctaacagccttccctctactctacaaacggcaatggtgaacatttacacaggctaaagtgcctgtaggctgcttcaacttggaatatctgctcctatcagatctagcactcagaaatgagagatgaaaaggctaattcacaaagtagccaaaaatacctcacatattctatgctgctatcaagcaatacaaaagacacatgaagttccaaattattttttaacaatttttaagggagact

SEQ ID NO: 257033 - DNA, 141 bp, Homo sapiens
gcaacagagagaacaagtttggatgtaaatatctgggatgtccactcttctttcaggctgctaaacaaggtagcaaagttttttctgccaactgagctgccacttaccatcttaaccctacatttttaggaattcatctca

SEQ ID NO: 257034 - DNA, 437 bp, Homo sapiens
tcacaatttttttttttggacagcactaatttatgaaatgtttcatattgggcagatatctttatctcattaagtctttgttttatcatctctacaagagtgatgattgtatttatagatgcattacaaattattatgagtcttcaaagaatgagaacattgatataaagttatggctgaatatagttatcattgtttttacagggtgtcagttgaatattgccaacaaaacagaaaagaaacaatattttattgttataagtatgtgcatgtgataggacatatagtataaaatatttttcttcgttaatttatgattaacacataattgtacatatttatgggatacaatattatgtttgatatatgtacacattatgtaatgatcaaatcaggataattagcatatccattatcttaaacatttatcatttttt

SEQ ID NO: 257035 - DNA, 641 bp, Homo sapiens
ccgtgatgcgagagaaccttgcttggccacccctcactttcagacacgaaacaaggaagccatgtaagcagttgtttcgttaatcccaaataaggaatagcaagttgtcagtaaaaaatagaaatgatggagtataggtaggatattataaaaatattcccatttgctcaaatcataaatgcacattctagacgtgtcaagtggaaattaacagcatataaatgcatttttaatggtttgagtctcagcttattacctaagtctatagaaagttatcacttctgtcaataagagtcttttgaatttgatacaaaatacttcaaacctacagagagggacattacatatagagacattaacatagagacatcaatatagagagggacgttgcaaacaccagtatactcatccccagatataacaaatcttactatttaccatatttgcgttaggttctttttttagtagatcaagacatccagaaatttcatggaaattcttatgtggcattgctaaggccctgtgaatcaagagtaatcaaccattacatttcttgaaaaccctacggatacataggtctcaaggctcctcatgttactctcaaccaaaagctaaaaccaaaatgtgtgcctcagaaacta

SEQ ID NO: 257036 - DNA, 326 bp, Homo sapiens
tccctgatctatatttgacacaatatgatgtcttctactgcaagacttcataaacagaacaatgtaagtttctatctactgctacctaaattcagctattagaattatttggaaagttttcaaagtatagatttctaggccctataggtggtattctgaattgaaatctctagggggttagctatagaaatctgattcttagagactctcaggtgactctgatgcaggtgtcagctgaccagcatttgatgactactgcttcagccaaaggactcagtcttgtgaatagagaagcattggttttcatcagaattctgcagctaact

SEQ ID NO: 257037 - DNA, 311 bp, Homo sapiens
tttcagtaacttatggggaggtttcttaatcttattttaacatggtattgcaatattaatttgaatttttttgatggtggagggattttaagaaacaattttaaaacaaataggtctattcatcaaaatgttcaggctaaaacagttgtgaatatcgtgggaataacttataagggagacgacatcttcattattagttcagtggtgtctagttgaaaatgtctatattacagagaagttggcaggagctgctaaagaatgcttcagcttgtccacaagtaagaattaatcctaactgattactgaaaacc

SEQ ID NO: 257038 - DNA, 290 bp, Homo sapiens
ggtacgtacagaacttggctctaaacaaaattaggggaaagaaaagagaagaatgaggaggaaaaatgagcctctgaatgctgcattttttgtggcagaccttgggcaggcaagggaaaagtatattttgccactgagtccctttattgaactatctttctctcatacacacaagttccttcagcccccaaggtcatcctgaccttccctttgagaaatgctgctttacgttttaaagttactaaagtgtggagcactaacacagactcttctagataatgtagcctctc

SEQ ID NO: 257039 - DNA, 268 bp, Homo sapiens
cacagtctacagcaagctttatggcgatcacatgtaaacatcatcaagagcaaacactaggacagagctacaacgagatggttgccaatggcagctgctccctctgggttactcctcaatttggtgggaaagagaccaaggttcactcgtttttctgaatagaccttggagttgccctaaataatacacagcaccgaatgagtccttcgggatagaggttgtctgcagggtcggtaaattttagaacttgtagcattttatgtacggg

SEQ ID NO: 257040 - DNA, 222 bp, Homo sapiens
acaaatgtgaaatattcccacattttttcatattttatgagaactgtttatacagttgaaagtttctatagaagaattacattatcttcatatgaaccatattgtattttcttccttttttgacaatttttaccaaagctatatctatggatgctttgttatgcatttacttacctagcaattcatgtttctaaagtgtataaagcaacaacattgagaagt

SEQ ID NO: 257041 - DNA, 834 bp, Homo sapiens
agaggggtccatacggcgttgttctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagtttgctgctgccactggagccactccaattgctggccgcttcactcctggaaccttcactaaccagatccaggcagccttccgggagccacggcttcttgtggttactgaccccagggctgaccaccagcctctcacggaggcatcttatgttaacctacctaccattgctctgtaacacagattctccttgtgctatgtggacattgccatcgcatgcaacaacaagggagctcactcggtgggtttgatgtggtggacaccggctcgggaagttctgcgcatgcgtggcaccatttcctgcgaacacccgtgggaggtcatgcctgatctctacttctacagagatcctgaagagattgaaaaagaagagcaggctgctgctaaaaaagctgtgaccaagaaagaatttcagggtgaatggactgcttcagctcctgagttcactgctactcagcctgaggttgcagactggtctgaaggcatgcaggtgccctctgtgactatt

SEQ ID NO: 257042 - DNA, 492 bp, Homo sapiens
taggccctcctacacactgctattagagtgacctttctacagcacatgtattatgagggcctccagtcagaaagcctacaacacccccatttcagagaaacactttcaggcaaaccttgaagactgctgggagaggataagtcatttcttgtaggcaggtagcccagaaacctgggagtgatgtcatccagactccacttactttggatactcaaagttattgaggcccctcagggtgaacttgatggttttgaccaggtccagtggtgggagaggcaaccactgggaccgtaagagacagtccccttggccaagcagcttgagcagcagcgcctcttcagtaattgcggagtcttcaacctcaagccctccctccagagaaggagtgatttcaacacacacccgaaagtcataccatgacccttcctcatcagttgtagccctctaagtaacattgcaaagactcatacttaataaaaactccgttcttgc

SEQ ID NO: 257043 - DNA, 466 bp, Homo sapiens
tatgctataatctgtccacttagaatgtaagcttcatgaaagcagggacttagtttacccacatcctatagccctagcatctagaacagtgcctggcataattagacacagtaaatatgtgttgaataaacatctaaaaaccatcagagtagaagatgaaaagtcagacttttggtaggggttttgttgtggccttgggcaagttccttagtagtttttatgcacatgatgtttcccatctgcagaattaagaggttggattagattggtggttttaaaactgctccagggaattctaagggttcttcagtgccatctgttgctagaagaggatgagagaaatgctaaggaagccaggcttcagaacgcccgactgcaccctctcactccttccaggattttattaataacctgctttaactgtttcatattgggctttcataaagacatggggttcagctactca

SEQ ID NO: 257044 - DNA, 324 bp, Homo sapiens
ctgagcagatgcatagattttttttatacagtcttctatcttcagcagtaggagagacgttgggttaacttttgtacattctcacaatggagggctatgtagctgtcacagaggatgaagatctctgtgaactaatatagcaataattccaagatatattggtatctgaaaaaaaccaatgcatgaagaacagttttaagaaaagattccaactggaagcccctacaacatgtactgccacacagttctttccctacccctgtttttgtccaaaattctttcactggaggattatcttcttaggctttcatgccatcccctgca

SEQ ID NO: 257045 - DNA, 444 bp, Homo sapiens
tattcccattctattttggggttttacatttcaagggggcaggctttatccacactgaaatcactctccatattttcccagcagtctaacaaccaggtagagaggaatcaaggcggggcggggcgggggggggattgccaagtgttggcaaggcaggtgctgtgatgaaaagttaacttcttccatgtgcatgaacccctcagcaaatctttccaccttcctgggcctgggcttccttgactgtaaagtgaaggagggaagtacattgatttctaggttctgcctcaaacgttaaagactgtaacaaatcttaactcccatctgatggactgcttgctcaggtagcaagatcaagggtatgaagaaagtccaagctggacaggaggaggagaggagaaggaaaagaaggtggcgtgtggggaattagaaacaagctttggcatt

SEQ ID NO: 257046 - DNA, 462 bp, Homo sapiens
actaggtctgagtatcatgtttgagaaggcagcatttaaaatgaatttgacatttataagtatttttttttttggtacttaagctgtgcgtagtgttatttttgtgtatgaggaggtaaattttaccttggattgttaaatatagtgtcttatatcatctgtaatcataaaggacagattttctcagtaacattttgtcagtgacacaatttttcatgaccagtgaatgctagctgaagaaactgaaaattttctgaaattgtcagtataaatcatttatttcagtagaccttgctatgctttgctgttggaagtaaatataacttttcctaagattagtcaaaattcactgagtttgtgtcatgctttgttagatgctgagaatagatcaaagtttgatctctatattttatttaattgatatcaaatgaacataattaatgatgatgttgaatttttttt

SEQ ID NO: 257047 - DNA, 155 bp, Homo sapiens
agaacaagaagtggtggctttatttcacacacctctatatttaataagcaggaccatgacgaggtttggtgacctcagggcccaaatggactgtctgctggcataagtggtgcttgagtcatttcccagggatgagcactgggcaggcttccagg

SEQ ID NO: 257048 - DNA, 379 bp, Homo sapiens
gggcagaatctgctttaagcctttgaattcttggctcttaaagccaggttgagggttatgtgtttttattcttttatatctccttttcacttaggcttggcaactagttcattgaaacagagccaacaagaatgagtgagtcactcagtgatatgaagcaagctgtggtcatttatctactaccttccatacctacttcctaggtttgataagtagtgtttgtagtgtagttgtcagtaacttttctcagcttacataagtttatgtggaattcatttacaaatgtgtgattattacgatagatgttattttataaatttcaaggttctttaatacagcatggacatgtttctaaatcaataaatatagcttacccaca

SEQ ID NO: 257049 - DNA, 1116 bp, Homo sapiens
agactgtgttattacaatgatttgaccttaggttgaggtttctgttgcaaaaccagctgaggaggtcctaaatgtggaaagcagatgtttctcttctggcatgtcttgcagaattatctggcaagagaatatcttctgtgaaaagaatgcgtgagaaatgtcatgcatttggcaatgattaagaaagaaaggtaaaccttcaactccttgttcttaaaagaatttggcttgttatttactgggaagacaactaagatgcaaagagcttttctgctctttgcaacaaatttcttaaaatttgttttcttttctactcttttgttcttcataaggccagaatatattatctcggggagagctgatgaaaacatgacttagtggctcttagagatttagcatagacgtaaacaacactgtatttctgtcacccagttctggtggctggaatttgatatctgggtgccagcatagtccagttcttgatgaggactcccttccttatttgcagatggctaccttcttgccctaccctcaaatgggggagagagaaatcatctctcatgtctctgcttataaggacacaaatactatcacgagggcctgaccctaccttcatgacctaattatctcccaacgcccaacgaccccacctccaaataccattgcaacgaggatgaggtttcagcatattaatggcgggggcaccaatatttgatccgtaactatgcgagtgccaactagctagtttcttgtcttttttcagtgccatatggaggctctgctgtacatcttctgagatcccatagttactatattaaaaagtaccattctgatgagaatgtgaatagcttttattatattacctttgatctggtgtgaagatgccttcaaatagatttaagaaattactcattaaaaggatatttttcaaaaggaattgccagttgattaaataatactaggtattaaattttacctcatggaagaacaaacttgtttgacaaaaaaacatttcttaattaaagccatatattttcatattagtaatgttgctatataattataatatttttaattttgtaatgtttttataattaaaggacttagtaaaatcca

SEQ ID NO: 257050 - DNA, 126 bp, Homo sapiens
  misc_feature (7)..(7): n is a, c, g, or t
  misc_feature (118)..(118): n is a, c, g, or t
  misc_feature (123)..(123): n is a, c, g, or t
gggaagncgtgtgtggtgcagcatttcaagtctggagtctacactgagacacagcagaacacgattggagtggactttaccgtgcgttcccttgatattgacggcaaaaaagtgaagntcagnggg

SEQ ID NO: 257051 - DNA, 554 bp, Homo sapiens
agaaatctcctttcccaccctgtaaggaattccaggacaccgtctatgaagagggaaatcataacttggctatttgttcaggacacccctaccctcttccagaccagcagctcattgagacacctgccctcgagataccacttgactactgccgccagtcgacaattattgatcaagtactgtgtcaggtcctctgctaggccgtttgagacatgttatctcaattaatccttacaacaacccaagaggtagacatgattattagcccatttcaaaaacaagaaaactgaggcacagattatttgcctaacttcactagctaataaattactgagatgagacttaaactcagtttgtctcaagaaccccatggtcttatccagtatgccctattgcctgttacgggcctttgtcaaacaagtcttctctcttggtgcactccaggccaactttctgtgttccagcttgagagtcctctttgcagccatgtgaatccagtgtcttcctctcgttaatcctctaggacacctctgcccagctttcttccatccccc

SEQ ID NO: 257052 - DNA, 2681 bp, Homo sapiens
ctctctggataggaagaaatatagtagaaccctttgaaaatggatattttcacatattttcgttcagatacaaaagctggcagttactgaaataaggacttgaagttccttcctctttttttatgtcttaagagcaggaaataaagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggttgttccacaaaaaaactcctttggacatattctacaaggagtgaagaggaatttgtcttattttgtgatttaccagagccacagaaatcacatttctgccacagaaatcgactctcaccaaaacaagtccctgagcacctgcccttcatgggtagtaacgacctatctgatgtccaatggtaccaacaaccttcgaatggagatccattagaggacattaggaaaagctatcctcacatcattcaggacaaatgtacccttcactttttgaccccaggggtgaataattctgggtcatatatttgtagacccaagatgattaagagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaagaatggaaaactcctctctgtggaaaggagcaaccgaatcgtagtggatgaagtttatgactatcaccagggcacatatgtatgtgattacactcagtcggatactgtgagttcgtggacagtcagagctgttgttcaagtgagaaccattgtgggagacactaaactcaaaccagatattctggatcctgtcgaggacacactggaagtagaacttggaaagcctttaactattagctgcaaagcacgatttggctttgaaagggtctttaaccctgtcataaaatggtacatcaaagattctgacctagagtgggaagtctcagtacctgaggcgaaaagtattaaatccactttaaaggatgaaatcattgagcgtaatatcatcttggaaaaagtcactcagcgtgatcttcgcaggaagtttgtttgctttgtccagaactccattggaaacacaacccagtccgtccaactgaaagaaaagagaggagtggtgctcctgtacatcctgcttggcaccatcgggaccctggtggccgtgctggcggcgagtgccctcctctacaggcactggattgaaatagtgctgctgtaccggacctaccagagcaaggatcagacgcttggggataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattaagttctgttacttccaagagccagagtctctacctcatctcgtgaaaaaagctctcagggttttgcccacagttacttggagaggcttaaaatcagttcctcccaattctaggttctgggccaaaatgcgctaccacatgcctgtgaaaaactctcagggattcacgtggaaccagctcagaattacctctaggatttttcagtggaaaggactcagtagaacagaaaccactgggaggagctcccagcctaaggaatggtgaaatgagccctggagccccctccagtccagtccctgggatagagatgttgctggacagaactcacagctctgtgtgtgtgtgttcaggctgataggaaattcaaagagtctcctgccagcaccaagcaagcttgatggacaatggaatgggattgagactgtggtttagagcctttgatttcctggactggacagacggcgagtgaattctctagaccttgggtactttcagtacacaacacccctaagatttcccagtggtccgagcagaatcagaaaatacagctacttctgccttatggctagggaactgtcatgtctaccatgtattgtacatatgactttatgtatacttgcaatcaaataaatattattttattagaaaaaaaaccggaattc

SEQ ID NO: 257053 - DNA, 2356 bp, Homo sapiens
ctctctggataggaagaaatatagtagaaccctttgaaaatggatattttcacatattttcgttcagatacaaaagctggcagttactgaaataaggacttgaagttccttcctctttttttatgtcttaagagcaggaaataaagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaagaatggaaaactcctctctgtggaaaggagcaaccgaatcgtagtggatgaagtttatgactatcaccagggcacatatgtatgtgattacactcagtcggatactgtgagttcgtggacagtcagagctgttgttcaagtgagaaccattgtgggagacactaaactcaaaccagatattctggatcctgtcgaggacacactggaagtagaacttggaaagcctttaactattagctgcaaagcacgatttggctttgaaagggtctttaaccctgtcataaaatggtacatcaaagattctgacctagagtgggaagtctcagtacctgaggcgaaaagtattaaatccactttaaaggatgaaatcattgagcgtaatatcatcttggaaaaagtcactcagcgtgatcttcgcaggaagtttgtttgctttgtccagaactccattggaaacacaacccagtccgtccaactgaaagaaaagagaggagtggtgctcctgtacatcctgcttggcaccatcgggaccctggtggccgtgctggcggcgagtgccctcctctacaggcactggattgaaatagtgctgctgtaccggacctaccagagcaaggatcagacgcttggggataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattaagttctgttacttccaagagccagagtctctacctcatctcgtgaaaaaagctctcagggttttgcccacagttacttggagaggcttaaaatcagttcctcccaattctaggttctgggccaaaatgcgctaccacatgcctgtgaaaaactctcagggattcacgtggaaccagctcagaattacctctaggatttttcagtggaaaggactcagtagaacagaaaccactgggaggagctcccagcctaaggaatggtgaaatgagccctggagccccctccagtccagtccctgggatagagatgttgctggacagaactcacagctctgtgtgtgtgtgttcaggctgataggaaattcaaagagtctcctgccagcaccaagcaagcttgatggacaatggaatgggattgagactgtggtttagagcctttgatttcctggactggacagacggcgagtgaattctctagaccttgggtactttcagtacacaacacccctaagatttcccagtggtccgagcagaatcagaaaatacagctacttctgccttatggctagggaactgtcatgtctaccatgtattgtacatatgactttatgtatacttgcaatcaaataaatattattttattagaaaaaaaaccggaattc

SEQ ID NO: 257054 - DNA, 941 bp, Homo sapiens
cactcccagccctttggtcaaatggctacaggactacaatcccagcatgcgccagtctccggggtaaggcatagccctggaagaaggggcaaagttgtacatgccccacctaatatgctgggagctgtagtccgttaactgctctcagcctatttgtcggtgggcttcagaaccataatctcagcatataccgggatccggggtgcatagacctggagggagggacagagcggtgtggacttcccagtgtccaaagcattgctgagttcttatgctatgccgactctttgccacagagagtgagtacagaggtggacctggaggacaggtctgggctgagcattgaggagggtattaccctatgtaggcaccttacctttgcccaaatcaggcgggttatcctcacccgattggccctatgcttctcaggttcctctttcagctgcacccagggttccttccagagcattgcaccttctgcagctcagggcactgccttttttcctaaactactgtggaaactgtcctgatgtctgagacactgtccattgtgcagcagccctcttttttctctagccagagcgcgtgctcaatggcttttgagagaaatcttccacatggcctgcttgtgaacagcttcagagctctgcaggggctgacaagggctgagccttcctggaaacgtcactctcaatggcgcctttttcacgaatgtgaaagtcgaggcatcaggaagttagtttaatgggttgcagaaaatctaagagcaagggagaaaacccgctttccaaggcgtgagttttgtgagccattttcatcaacccatttaagtggacaagctccaaaatgtaacctgaagctgctgactatttaggcattttacaattaaaatcatcggtctcatcccaagtcgtgcctcacttgccagtgtctcagagaca

SEQ ID NO: 257055 - DNA, 745 bp, Homo sapiens
aaagcattggaggtcgttgctgaaggacaagtcattagaaactgtgtctatgagacctttgggagcaggcagagaagtggctgatttggtagggccagccccgggcatccctgggttcaagtcttcttcctccagtgataacttgcacaggggttctaccaggtcagcctgctctgtggctgctgctgataagaagtacagttgtgctgggacgacatgttccagagtgcactaaagaaatggccaaaccctccatttccctttcacagaaagatgctactcagtatcatggagctttacttctccaagtgtggcccctgaaccatcagcagaatcacaccaggagcttgttagaaatgcagattctgaatcagagactccgggacagtggagtccaggagtctgcatcataacaagccctcttgattctggtgtgtgttcaagcttgaaaaccactgcgattgattaaggtaagtcagcatgtgccaaagtagatgacatttttcctgactgttggaaattgggagccccgaattatctttgatcaaacacctggagtgaaagcagggcattttacctgaatgccctgctctcaggattttccagggaaccatattctttccattagaggaatttaagggagatgtcccaaatatccccaaacaggtgtcctctgtcaggaagtccccaaatcaggcccagataaagattttactggagccatgattatcactcaattccacta

SEQ ID NO: 257056 - DNA, 580 bp, Homo sapiens
tgctgggattacaggcatgagccactgtgcccggcccaaaatatacatttttaacttgataacaatcttatgtcttagagaagagggttgattatgttcaatatgtgatgtttactaaggcaggacatgtaaatatagatgagaaagatgctcagtattaaaatgtaaaggaatggacttcatggtttaacttgcaattctctggctttttttttttttttcctgagtacttgcttaccaagagtttatattggtttggctagcagtgagctgtctaacaagatgcaatctcatggaatacatccttatgccaattatgaataaaagtagttcagacggccaggccctaacttaaatatagtgcctttggtggttaagggtgatcaggtgagtggttaaatagatcaagaaaaggaaagaaaaatccaactaccttattaaaaaacaaggataaaatgtcaaaacagtgggtaggcagtaggaagaatgtcactaaattatgtattctttgggttattaacaattagaacataatgttacaatgtaagcactgtgcctcgtgccgggggatcctgctaga

SEQ ID NO: 257057 - DNA, 402 bp, Homo sapiens
agaaatcctgatgcctaaatctgaccccttgaaatgctgatgagcttcatctgagctgtgtgatctctcatgtgcagctaaggttgagaaccactaacataaaataattcacattaaaatcaccaggaagctttaataacatttcaaatacttggacccaacccctaaagattctaatttaattggcctgggactcaggtactgatatttttcaaaagctcacaaggtaattctgaaattcagcaaaagttgagaaccactattcagactaagtgacttgtccaatgtctctgggtgcatcagactttacggccttccttacacaggggttgtgaatgaaatatggctatggaaagcaattgttgagtaatatgttataaagtatggtggtgatgatgatga

SEQ ID NO: 257058 - DNA, 495 bp, Homo sapiens
ccagtcccagaggcgttttctcaaaagctggcactgatctgggcacacaccccagctcagaagcatgtaggggctccccactgtggattacagctaacgcttattgttttacaaaatgcctggccctgtccttagctgtttgtacacattaactcatttaattctgataacacccctgaggggtaggtgctgttattttctccattttacagaaaggaagcagaagtacagagaaattaagcaactttcccaaggctatccagcattaattgctagactcaggattccgatcttggcagcctggctcagaatctgtgctttcagcactataatttagtcctctctccatactgaaatatacaatgtgatgagtagagacagcgaacaaagcagtctagaatattagttctgccatttacttgctatatgaccttaggcaagtcttttatttatttttatttatttatttagagacagtctccctctgtcacccag

SEQ ID NO: 257059 - DNA, 403 bp, Homo sapiens
aatactctataagcactcatggaaacttctgacaaaataatttgcactcattatccctcagctttgccacgagcattttacgttgtacgctaccacacagtaaagggtctcaaatgggggcaacgtgccccccaagggacaatgggcactgtctagagacatctgtggttatcacgacttgggggagctcctggcatggagtgggtggaggcctcggacactgctcagcaccctgcagtgcccagggcagccccaccccagagaccaacccggaccaatgtgcacagggccccggggagacctgttgtacgtaacggagaggcccatctgaggcgtgaacagcacattttagccgccgcgggagaggcggcacggcagccggagccccgtccagctctagggc

SEQ ID NO: 257060 - DNA, 429 bp, Homo sapiens
attcaattttttctttctccctcttccccatccaaacctccaatccctctctttcccctcattcattccattgcactgaacatttcctgcaggctagagtccaggacagggaggaaatctgctccctactctaaaagagctgcagtcaagatttagtagaatatgctctaatgagggcagcacagggcacactaggagcccagagcaagggaggactattatagaattgcctagagagatgggtagccagagagggctctgcaagaaagctccattggatctggatcttaaagagtaagcaggaggctgagcgcggtggctcatgcctgtaatcccagcactttgagaggccgaggtgggcggatcgcaaggtcaagagatagagaccatcctggccaacatggtgaaaccctgtcactactaaaaata

SEQ ID NO: 257061 - DNA, 455 bp, Homo sapiens
tgtgcctgagatagtgacctatttcttttaaatgtgggcattatttgaaatgatttttaaacaggtagagagtgtcataaaatttttatatgagggaacattttttacttcattctcattgcttttatttaatgtgcccatatgtgaatgcatagccactggttattaattttctaaatgtagaaaataagggaaaagtaactgaagcattatcttgaaccaatttgaggaagtgaaatgtgcttgcccaacttttcttaaaatgggctaagtcaggttaaaaatctagaagcattttcctgtgtgtgaaatatgcttttaatgttggaatttagtagtttcacatagccggacaataaagatgttagaaaaaaatcatgaagagtatgttaagataaaaggcaagagagaaataatgtataatttatataaatcatgacatttaaaaaattagg

SEQ ID NO: 257062 - DNA, 605 bp, Homo sapiens
aatatagggctcagtgaggaagggaaatcccataagcaaaggtggctcacagtgcattgagtaacaatttgatagtaactacacctcctggaactgaagaatttctttatgagataatttctagagcactgaattccagatgtttaaagagatggagatttaccctttgaacactggggagtcactggggtagcttcttgaatggggatgattcaaagaatgggacatgattttcaaggccatagtttgggaatattaatctaggagccgtgtgtagcattcatccacactttctcatttggacctggggtaaacagtaacatggatttcatgagagctgactaatcaagactgtagtctctggacttggaacatagtaaagctaattcaaaatggaagattgactattacctcccttcaatgacttcagaagaggaataaaataaaacctacaagatagaactattctattttagtcttctttttgtaatatgtaaacttctgaaccaaaaagtgacctcaggtgctccttcctcctaagagctgtcttgttccttttatataatttatttgatcattatttcgcctaaattgtcttacacctg

SEQ ID NO: 257063 - DNA, 252 bp, Homo sapiens
gagactccttctcaaaaaaaaaaaaaagtttgtaacctatttatgttattttgagcaattgtatactaaaaataatccaaaagaaatatttaatacctagggttttgtggtcaccagaaaaaaaaaaaaaaactatattaggttttatagttttaggccgcaccgggcctatgttaagttttcatttgtagtatatacatatttttgttgcagagaaataagatagcatgatcaataagactgttaggcaaa

SEQ ID NO: 257064 - DNA, 365 bp, Homo sapiens
gtcatgccgacagggatgtggtaagtgcacctgctttaggaaccagttctgtagtgtccaagaatccagagcgatcatctatgcaaaatgcctgcaaggttataagttcccaataattagtctctgcctagtgctgaataatgatccccaaagatgttcatgtcctggtctccagagcccgtgaataagttaccttacagaagggactctgcagatgtgattaagactcttgagatgggccgggtgtggtggttcatgcctgtaatcccagcactttggaaggctgaggttggaggatcgcttgagcccaggagttcaaaaccagcctgggcaacatggcgaaaccccctctctacaaaaaatac

SEQ ID NO: 257065 - DNA, 302 bp, Homo sapiens
gatcttaggcacaatctaccatcacatgccagtcctcagacaaaaagaagaaagttttcagttcattctagaagccatctcccagatagccagctttcacatggatacagttgttgtcaaccttttacagaagcctctgccttttgacagggacacaaagacattgtggaaggcgctggctgaaaagccagcctccagtgggaaactcttgcaagccttaatagacaaactggagactgagttagaagatgacatcgccagggttgaggcaatttcagtgagttggacagcctgaacccatc

SEQ ID NO: 257066 - DNA, 496 bp, Homo sapiens
aggctcctgagttcaacatggaaatgcagttaagtgtgatgaagatgatgacaaagaagaagacgatgatgatgattttacttcatgccaggcagcttgctaaggactgtacctagattacctcctttagcctcagaatcaccctaggaggttggcaatgcagccccacctccctgaggaagaaactgagtgtcagagctgtgcccctccctctctgtgttctctctctgcaggtgccctcttggggtcctgttctcttcactgctcaaaattctgaccagcctgcacccagccctgcacttccattccaagctccgtctgggacagcgtgacatcatcaaattcaacctgtgacatcatcaaactcaacccacaacatcaaactcaactcatgacatcatcaaacccagcccatgacatcatcaaacccaacctgcgacatcatcaaacacaacccacgacatcatcaaactcaacccacgacatcatcaaaccc

SEQ ID NO: 257067 - DNA, 644 bp, Homo sapiens
ttttaagatggagtttcgctcttgttgtctaggctggagtgcaatggcgcgatcttggcttactgcaacctccgcctcctgggttcaagcgattctcctgcctcagccttccgagtggctgggattacaggcatgcgccaccacacctggctaattttgtagttttagtagagatggggtttcaccatgttggtcaggctggtctcaaactcccgacctgaggtgatccgcccaccttagcctaccaaagtgctgggattacaggcatgagccaccgggcccggcctggtatttccgtatttcatttgaaactgcatagttttgatccttttaaaataatttttcggccaggtgcggaaactatgcctagctagtgattaggatgctaataactattagcattagaatgctagtaactatgcctagctagtgattagaatgctattttttaactcttctcattggttttataaatcatatttataatatagtacatccaatcaaaatgtagatttttgtttcgatttcaataagttacatttcatataatgacaattgtatgactgtttcatccaaagagtcttgaattcttttgttttcccagtaccaaatttactttagttttatctatgaaatggtgataa

SEQ ID NO: 257068 - DNA, 467 bp, Homo sapiens
aatgtcaaaacagagcctagtgcaagagctcaagaaaactttatcatgaacatcagctactctcttagtttggtttgttgctttgaagatgaaagtgaagagtgatgccagcgtcctgtgtgtgaatgtcccgtccagaactttactgcacagtagaagggaacatgcagagttacaggcatatccagtgcagctcataggaacactgcaaaaggtgtcttctggagtcttctggagtcagacatagcagcaaatagctctttaaatcccctcatgcctcctgaggtttctactcaggtaggaatatttgcataatagggcttatccaagggaactttaaaaatagatggataggccgggtgcagtggctcacgcctgtaatcctagcactttcggaggccgtggcgggcagatcacgaggtcaggagatcgagaccatcctggctaacatggtgaaaccccgtctc

SEQ ID NO: 257069 - DNA, 368 bp, Homo sapiens
  misc_feature (368)..(368): n is a, c, g, or t
tggacacccgcagaaggagaaggcctaggtagacagaggggaaggctattccaggcagagggagctgcatgttgaaaggagtgtgatttaagaaagtttgcagcagccaaaggactgaaaatgctggatctggctaatgtccattccacagtcactggtatgcattgatgggaattttacaaactatcccttctgcaacgtggagaatggattgcagcaaggagcgatcagacgcaaggagaccactacagtggcgacatttacagtggtgataggggagtgggagggaaataggtccacttaaaagatatttaggaggcttgatgtacacgattcggtgactactggatgcggtggtggtgggggcn

SEQ ID NO: 257070 - DNA, 270 bp, Homo sapiens
ccccagcaagcagacgtttccggttcttctctctctctccttcccacatcaaccgcaaaagccaccaacctcctctgggttcccgtgacagaggtcacagtccaggtcccccttgcatcacttgaatccactgtcaaatgctccctgctggggtctcctggagtctctccccaagccaaggggcttcctagtgcagcctgaacatctttccaaagcacgacaacctcactgcccacctgaacaacttccttagctgatgtctttctctat

SEQ ID NO: 257071 - DNA, 108 bp, Homo sapiens
cccggctccctcctttcccaattcacccacttcttaatttgagtttcttaatgtgcaagcgccagggccggctgtggtcaggcgggctattttctggcaagtgtggcg

SEQ ID NO: 257072 - DNA, 642 bp, Homo sapiens
gcacagcacacacgcacacacagcacacacacgagcacacagcacacatgaaagttacatttctttattcatgtctaaattggtctgtttaacaatagtagggagaaaatcaacaactgcattttctctgggcctctattctgtgataaaatggtaactccaagctgtatttattctgcctggaaaagaggaagaaagcgttcttttcctccaattatggtggaacgcggcccttgagaaaataccgtggagccttttgagcaggcttcactggtgtgagaacacattccaagttaaatcagcagagctactggaaggaatgcaaggtgggagagggggaagtttatatgtttctctcttcagtggtgactttagcttcatgtgacatgtcctcaaaccttctgggccagtgactttcaaccctggtggctgtggcggtgctgcagtcacactaggttggagactggatgcgccatgagtcctgtacttacgtatgaggcacagctgctttccagtgtaggaatttactgtaatggtcagtacattaggatttcatttaaaaccttcatattaactagttatccttgggatatgctggttaacagcatgttaatcagtcagataaagcccaactgtgccata

SEQ ID NO: 257073 - DNA, 264 bp, Homo sapiens
ctatggcttccccaacttcacaagccattctgctaagacacatggcgtatgcatgtgaggaatgaatgctgtcccatggcatcctacaaccagtgatgggagttggtgttttgtaaacttccaaaactcctttacccctcaaatgaaataaactctccctagaatttcccaggctactttttgagctgtttcccttctctttctcactcttctgttcccctattggtttcctgaagttttcaaataaatgatttgcacttaaat

SEQ ID NO: 257074 - DNA, 332 bp, Homo sapiens
catggcaaagagggattaaggtggcaggtggagtgaaggttgctaatcagccaaccttaaagtagggagatgatcctgaatgagacaaaagagagaaccagtcatggtgtcatgagaaggactcaaaatgcaactgctgactttgaagattaaggggctacaaaccaaggaacgtggtagtctctggaaaagacaaggaatagacgctgccttggggccaccagaaggaaccagccctgtcaacaccctaattttagcccagtgaggcctgtgctggacttctgacctccagaactgtaaactaataaatgtgtgttgtttctgccactaga

SEQ ID NO: 257075 - DNA, 378 bp, Homo sapiens
taataaagattacatttaagattaacagagaataggaaaacagtagaatgaatgaaacccaaaagttgggtcctttggtaagatcaacaaaattgacaaatttttaacgactggtcaagaaaaaaagagaagactcaaattaccaaaattaggaagaaaaatgatgacattactgttattacagaattaagaaggattatagacaaatactatgaacaattttaatgccaacagattagataatttagatgaaatgtaccagttcctagagtgaatgtaatgaaatgcaccaattcctagaaactcgtaaagtacctgaggaagttgaaaatctgaattgacctatatcaagtaaagaggttgaacccataataaaaa

SEQ ID NO: 257076 - DNA, 294 bp, Homo sapiens
cggcacgaggcggcacgaggcagacctcaaattagtctccctctgcttctccaacagtgtggcctcttctatgaagctgtctacccatgggtttccccaacatcccatcccccagccctcaggtttctcctccccatcatcttcacttcagaaagagaaatgaaaaagaaattcaagtgactcatcggtccacataggcaggagtgggagaggctgagagagtgaatttgtgggtccagatgaatatttccgcaggcctcttgactgcttcacacgatctgctgtgcttcatga

SEQ ID NO: 257077 - DNA, 983 bp, Homo sapiens
cagctcctgggatggcctcacctgaggagactcttgggccttggcagaaacattccctaaagttctccaaataaggcttcttccaacaagatcccaccctgggctgcccacacaggggcaggccaatcaggtgctcctctagggcagggtcttccctggggtaaaatggagtacacgccaagtcaattcagagctcatggagttgctgaaataaaggttgccaaggctgggcgtggtagctcacgcctgtaatcccagcactatgaaaggcggaggcaggaattgagctcaggagtttaagaccagcccgggcaacatagtgagaccccatctataaaaaaaaatcttaaaaattagccggccacggtggtgcgtgtctgtagtcccaactacttaggaggctgaaatgggaggatcacttgagcctggaagtttgaggctgcaccaagccatgattctgccactgtactccatcctggtgacagagcaagaccttgtctcaaaaaaataataataaaaacaaagtttgccaaaaaaaaaaaaaaaaaaaaaaaaaaaacaagaaaaaaaaaaaataaacaaaaacaaaaaagaagaaaaacaaacacaagtacaacagccacaaacacacagaccacgaggggcgccccgccacaaaacacaacgcgaagggcgccgccacaaacaacaccagcagccgccagagaaacaagggcaccacagagcagagcatcacacttacgacagacaccgcactcggggcgcgacatatgaaacacacaacaggtggaggataggacgaaacagcgcagacgcgcgggctggtcagggagaggtgccaggccacccactattagtgggtgggtggggggacaacaccatagccgagcgagaccccacccccagcccgcgcgagcgagtaacccggcgctgaggccggatcacatcaaccagttgcggcagtggtaaggcggtgagcaacc

SEQ ID NO: 257078 - DNA, 307 bp, Homo sapiens
  misc_feature (296)..(296): n is a, c, g, or t
  misc_feature (301)..(301): n is a, c, g, or t
tgggattctaacgtgttttcgggcctccttagagccttcagcgaattcactcatatgcatcacacacatcacgtggcatttcccaaaccacctggtccacgggaccctttctgcccagagctcctggaggggccagcattccttgggttaggtccctgcaggtgcacagcagggctcagggtcccatcgttcagccagaggcccgatctcgcagtggacggatgcagagcccgggacggtctcacgaattccgctgaggtctcacgaattccgctgaggtctcacgaattccgctnagtantagtag

SEQ ID NO: 257079 - DNA, 725 bp, Homo sapiens
caaaactatgaaccatctcacagacttttttaagtgaccatctaatctgtatttatcatagacataaggcgtttcaaatgatgtaatttttggcatattataaaggtcacataaaattgtcatattacttatttaaatgtagctaaatactaaagactttttattgcctggcagaggagcagacagactgggaaaggaagagggagcaactaagttaagcatgcccaatcctttatcccaaattcaccaatcagataagacactgaattaggggtggagagaggctggggcattaaactaatgtttccttcacaggaaaatatgaaatcacaggcaaagagctttctgcctctccaccctcatgtgcacatcctaggtaattgctcccaaattgaactggtctcatcagagtcacacgaaggcatttttaaacaatagagatgccaggagattctcacttggagatggatgaaagggacttgaaatctgttaagcagacatctcttgttagtgcagtactatcaggggtctggagtgttctagaaaacccacagtcatacaagtggtaccttggtccaaagccatagccctgagtatgaacaaatcattttctttatcagaaaacaaagataaggatgcccgtctcctagacttgtttgaggagtaaatgagatggcacattcattcactcattaaatatttatgaaatgtttgctatgtgcaag

SEQ ID NO: 257080 - DNA, 341 bp, Homo sapiens
acataaattttaagatgatttggttgatgaagaaaatactgaaaacttgtgggttgcagttaaagttgtgcttcgaggttatagctgtaaatctgtggctctccaccttagctgcacctagaatcacttgcggagcttttgatgtccaagccactcttcagaccatttgactcagaacctctaggggtgcaccccaaacatttgaaaactctccaggtgattccaatgtgcagctaaggttgagaatcactgctttaaaagcacatattagaaaagaaaaaacattcctctcaataactcagaactgctaattaaacctaaagaagtagaagaaagaaaaa

SEQ ID NO: 257081 - DNA, 262 bp, Homo sapiens
cttagagggcaaagtagaaccacctttaactcaacgttttgtgccttgtattgtgtacactgactcaggattgaaattctcctgatttcattgttaccaacaatttatttaacgagctgttcattgtctcaacggtgaatgatcagcaaacaactatgcctgctcatttatctactctagtttaacttttttttaagagacagggtcttgctctgtcacccaggctggaatgccacggtatgatcatgactcactgcagcct

SEQ ID NO: 257082 - DNA, 821 bp, Homo sapiens
ttttggacagattagctagagttttgagacatgtcttttcacaaacaacatcgtaattcacccgagtttccatttttgttcctctaaagcagaacaaaaatctgaaggcagtttcaaatctgagagcagaattatcatcaatgttaaacatttttccccaatgtcatacccagttaagtactttgcaaatatagcctttttatgaatccaaagcattctatttatttttcataaaaataataatgctatttttaaaaaatgactatgttcaccttcttatttcattcatttatgtaacatttaaaattgcataaacctatcccaggcagtgaacagagatttctgagctacccagatgacttaggcagaaatgtcttaaaatacaaataaaacagcattttgtttttggtttttttttttttaaagaaatatttcttgcacacctgagatctgcaccagctgcagaggtaaacatggataaaaatatttctgaaatgagtctggagttgtcgtgtgtgtatttctcaaactgagtgtggcgtggcagtgtggtaagaactaacaaaacccacaatcctcataaaacatatttttcaactgcctgacaaaagagacatcaacttaatttgaaaaataataataataaggaaagacaatagaaaggcatttggttttctgaataagacaatctaaattttccgtccagcagtagggaaacaattgaggagcaatgacaaaacaatggccgaatgcataaaaagaccacactaattcagtgtcagttcctccacacaacactactaattttcaattttcccctt

SEQ ID NO: 257083 - DNA, 152 bp, Homo sapiens
tgcagtgagccatagtcatgccactgcatgccagcctgggtgacagagatgctgtccccctttaaaaaaaaagccaaaatgtaaaaacttttaaatcaatttggttaaaaaagaaaactgtaaaaacttttaaatcgatttggttaaaaagc

SEQ ID NO: 257084 - DNA, 633 bp, Homo sapiens
agaaaattaatttacaatgaaggtacagggttgacctgataatgttagtggcttgcttggagcctcataacattggtggtgctttcaagattcattacccttatttttaaacaggataaggaagagcttggaaacctatttctagcaggtaccagagttaaatcaacagcataagctttgaatttcaattaattttgttaacttttttattttctagtataatatttagaacaaataaacaaatgaagaataaatatggatcttatgagaatatgcaacttattacaaactctaaagtttttttttttcattttaagagttacaggagcatagtattgtcagaatcccttgaatataatatcctttatttgtttattatattcatttatgggtaaatacccaaagtaagtgtcagtaggatagataataaaatttatcaatgacatcctgtccaagatagaagcaacatcccattcagcatggatagacacatgttcaaggatacatttatctggcctgagtctaggtgcatctacctcagatttcaaaacatcctgaaacactatgagtcacggattaaataattatttttaagactttatatcaaatacttggaaaaggattcaagaataa

SEQ ID NO: 257085 - DNA, 250 bp, Homo sapiens
tatcattttgggggtgggtgaaaacaaaaacaatggtttttaatggatttaaagtcaacaatggattgcttgaagagaatgtaaggttgaggggaggagatgtttgaaattttcaagtcatatagaattatattcccttaatttacctgactaaaaatatataagtagtatgttagagtcagatgatgctgggagttaattctccaactttacagatggaggcttatgacctggagctcatactggtata

SEQ ID NO: 257086 - DNA, 311 bp, Homo sapiens
tgaaagataaacatggttaatgctatggccagaggaatgaacttgagatacagacaggcaaaccctcatcttttatgcggtctacttctgtgaggttgacattcatttatttattttttttgcaagtctattttcatgtattatttaaaattcagtaaaattattgttaaagttttcagtagtatctgtacatgtagagctctggaccaatgtctaaatgcatcttatagacacatagcagagatgttttaaaatttgtttcctccagaatatttaacttgtagccaaaactttaggggaagagggtagta

SEQ ID NO: 257087 - DNA, 618 bp, Homo sapiens
ccattggccagaattgagccaaatgcaaactctagaacaagggttgtagggaggggctaggaaagcagcctttattctggccatcaatgtgctgaaatgaaagagctctgttactaaggaaaaagggaagaatggttattgagaggcaactgttgttctctatcacagtcatacaccactttggggagactggtgtgaaagcacaatggggtcttgataaatgctatggacacatttcatcattaacaggcagcatgagttgccagtctcctttcaggctgctttcaccagcagaacaaacctttgtggccaaattcttgcctttgatacctctgcttccaagaaatgatgtggtgtgcacatgttctcacttgtaagtgggagctgaacaatgagaacacatggacacagggaggggaacaacacacactggggcctgtccaagggattggaggggagggagagcatcagcttaaatagctaatgcatgtggggcttaatacctaggtgatgggttgataagtgcaacaaaccaccatggcacacgtttacctacataacaaacctgtacgtcctgcacctgtatcctggaacttaaaatcaaataaatttttttta

SEQ ID NO: 257088 - DNA, 113 bp, Homo sapiens
accatttttaataataattttctaacttattttgaactgtatcggtatatgttgtcagttggtattgttgtatttaattactacattttccctgttgcattgagttaaccttc

SEQ ID NO: 257089 - DNA, 418 bp, Homo sapiens
tactcgaaaataaatgtttgtttttaattctcagcaaggcaaggtacttctatagaagggtgcacccttacagatggagcaacgatgagcgcacacttggacaagggaggggaaggggttcttatccctgacgcacgtggcccccgttgttgtgtctttctgctattggccagggttagaccgtgcaggctaaactaattctgattggctaatttaaagagatcgacggggtgagtggtgtggcgggaaaaatggttatgacagagcaagtaattggaatgagtcagggtgcatcaggtaatcggaatgacttacggcggagccggtaattggaatgaatcagggtggagcaggtaatcggaatgagtcagggtgcgtcaggtaatcggaatgagtcagggtggagtaggtaattgga

SEQ ID NO: 257090 - DNA, 1643 bp, Homo sapiens
aaacccattggcagggctaagtaaaggacagtcaatagataaatctgtgtgtagcaaagaatctgacacttttccctagactcatggtatagctttgacaaagtgcttttcttcaggtgtaataaaagtgtattcattgtgtaagcagctgataactactttacaacgtagaatagagagcagggggtagccgtgtctgtctacacgcacctgttgcagcagggcatattagggtgacacctgattcatctaaaaataactcacacatattcatccttaaaccaggatcccctttgtctgcacaaggcgctaaacaaaaccctcttctgtcggaggcagagtgagaagggagaagcagccccgcctctctgtattttccccttcagccaggcatagctcagtaggttccatccttaaccccagtactaattctctaggtctttatctgaactacttttaaattaaatttaagcaactatttgctccattaatccatgcaacccattaggacactgtgtgcacttactgtacagtatttcaaatgaagtaaaacttcaaagccgtctgataggtatgggaaaaggggggctgatatagccagaaggaagtaataatctcccaaggatttcagcaggagagctaaacttagtggcagacttcacttttcgtttaactttaaatgtatagtgacttggagaggcttgggaccctgccttgtgttgcagataaagccttaggagtaaggaggagaatggatctagctggtcagaatgaatatttctgatcatcttaaattctctttccctgcccgagttaccagggaaaccgagttcttgatatctcacttgaaaataagtatttttaccttgaagcaggagtcttatgtcgggggagggtttggtattatggggagactccgagggctggcaggagaggggcagggtcaaaggacaaaagccactgcccctggagttagtccagcaacttgggtctgacttcagggagattttatggatccaaaggaacaaggccgttttgttccctctccttgtgagaactgaaatacataaaagatgggtgcatttctccactttgattttctctcccagttatgaagtggactggactgaactaggtctttccaggcaaattggaaatagatcagcatggatcagtcttctgaagcctacctctggcatccagtcccataaagcacacacacacacacacacacacacacacacacacacacacacaaccttcgacggtatagtttcattttctccatgcacagctcatatttatctgaccctaaggatcttcaaatacatgaatacctacagtttctacagtatggtacagggggcacacatccaaatccatgtgaaggaaaaacttttgtcgcaactccctctcagcaaatagccttttatcgaaaaactagagaaactctcatcaatgacttctcttcccattttaatacaatattaattcaacaagaatctatcataccagaacctccctaaaaagactaaaagcacccccaaaacaattattcctgaaaacgaagaaaacaatactagataatggataatgaaatgctgaatggaatacactcagatgcaaaaaaaaaaaaaaaaaaa

SEQ ID NO: 257091 - DNA, 1056 bp, Homo sapiens
atccttatgccttatccattcttcttctagacaggtcaatgagccccacagattatttaaaatgaatctccaacatctacagattggtgcttaaaaataaagtgtctgagtttctatgtaaaatgacctaatgattaagaccttggaattcaagtttattctcccaacagcttttgggtatttgggaaagcagactacactaaaagaaatgactgcaggaattaatgtcaaggttttattttaaccgccaaacaaacctagacatggatctttgcatctcccaagtgttttctgaatgtttggggaaggaatagcataaatattcatgaaactctaacaaattcacatattttggtagctgtgatagccacgtggtcccaggatattactttagataatatatgtatcctttcagttacaaaggcattttctgttcttgccttagtctcattctctttatcactgtggcttcctcagagacagaatgagacagaagctcaattctctgcccctagaagaataacagtggttgggttcttcatgtctctatggaaatcatgctggtgcaagtgaagcctattttctcatgcgtcacacaaagctctcatgataattggaaggtactctgtggaggtgatgacttaataacaccttcccttctcaaaagcacttgaagaagcaagatccttccttggcatttctcagatgggcagcagagttcccagcaccatcagtaaactcagccacactgtagaaatgtttgccttttctatatgaagattatctaggttcttacacagcagtcatctctagacacctggatttcctaactgcctttgtgagttctggtcaaatataatttaaggtcattttcattgcttgtttgcttttaccgtcacactttaatatcatgcaaaagtacatttctactctcttaatgctcaaattttgctcaccaatagttttagataataggataatatgactaaaatatattaatagatatcagcatattatctatcagtatattaatatattaaagcaatcaatatgtta

SEQ ID NO: 257092 - DNA, 428 bp, Homo sapiens
aacagagtatgatccagaatctggtacaattctaattgagaattctctgctcttaacgactgactgacctatgtactactgtgcctgatcttagagacacataaatctagcagggccatcctcacagtatggacttaacgaccatctgaacggcatggaatgactgtaggcagaaaggacagggtatcatactgtgagctgatacatcctaccaataatatccaatacaatggatcaccctcagacataagagacagactagctcaagaatgaaggctcacaaccggtgatcctcacatgatctggttttctaatatttgaatcaataaagagattgatatcattctaacatgcctgatatccagctataactatttccctttccaaacacaaacactgctttaaataatccaagatttggtctaatt

SEQ ID NO: 257093 - DNA, 427 bp, Homo sapiens
cgaccatctcagatgcttctgcctctgaaaaggcacctccaggtgcccattcagactgtgccctgtcatttatctggctgttgcacctcaaaaccaataaacaatgatttggagggggaaaaaaaggaaaatatcttggtctccttctagctcctcccttatcttgatccactcatagccagtttcttctcttttttaaaaatcttaatagctttgagagtacaagttgtttctggttacacggatgaattctgtagtggtgaagtctgggactgagaacacccatcacttgagcggtgtacactgtacccgatgtgtactcttttgtccctcacctgcctcccacctgccccggagtccacaaagtccattaaatcactctgtatgtctttatgcataacaaatttcttaaaaacatcctgacccc

SEQ ID NO: 257094 - DNA, 403 bp, Homo sapiens
cagaaccgttgggtatcccaaacaattgttaagtgggtggagattacccttgtctgggtattccaaaaggcttcccagaggcaccctggtcttagagtggaaattgtgctgtcagggacctctgtccaaaattaactcccataaatagttctttatgggcagtgtcagtgtggttggtgctggataggtgcatccagctgcaagcacagggcaggtggttatttagcaggccatgctatggcagtttacacaggaggtagctagatttttcccattataaccgggcaattgtctcaactgatcatccctaatatctattgttatgcaacagtctacctggttagacccctcagtagtcgttctgaggcattgttatgagtcctttgtctaaatagtactcaat

SEQ ID NO: 257095 - DNA, 618 bp, Homo sapiens
gtggttactaagacacagctagaaagacaatgttgagggaataaaaagacacttttgtgagacgtgaggaatgggaaaaaaatatagtaggaaaggaatgaataaaggtttgaagagccaaggaagcctaacagtgaaagtcagtctctgaataaaacatgtcagaatctgaaccacaccagttcacaattttacttctttgaagcatattattaaagataaggaaagaagttttgacttcatgtgtttatattaatgaaatgaatccacttagaattgatatgcaaataataaaatattatgtagaaaattagcatgttccatctaggtcctttttattttttctgattattgagaaacttttggtttctgacagagctgtctttatttttgctttaggtagccaaatatatgtctatagctagaaaattttaggagcaggaaaaagaatgcaaaaatgacattagtcaataaagttttagaaagggcactgactgactgacaaccatttacaggctgatttaaagtctcaaggcaggccaggtgcagtggctcatgcctgtaatcccagcacttttggaggccaaagcaggtggatcacctgaggtcaggagttca

SEQ ID NO: 257096 - DNA, 368 bp, Homo sapiens
ataactcaatgatctcagccctatttagtgcagtcagtgactgcaaagaggttattccaccagcccacaaaactgaccactttgtaatatctcatggaaaaatacttgtcagcatcaatgctcccagacaaaatcagagtaagaacatctgcagtctgcttcttgactgtaaagaaataataagttggatgttctatttttttcttttcctaatgatgcttattcaccaaaagtcacttgccaggttgaaagatcaatgtaagtcaagagcaaagcagggattaacaggatttttttttccccataaaaataaattagtagccaacaatgagaaactattagttgcaaggagtgaggtggttaagacc

SEQ ID NO: 257097 - DNA, 275 bp, Homo sapiens
ccaagtccctattttccgaactttatatgaatagaagcattctgtacacattcctttgtggctggctttgttcactccacattttatttgagagagtcatctgtgttgaggtggagctggaatttgttttgttccattctatgaaaaaaaagtcatgattcctctgttgaaggatactcgtttggttttgctgcttgttcttgttcacatgtatacacgagttgctgggtcatgggtacctctgccttcaccaaggaatgctacaactatttcca

SEQ ID NO: 257098 - DNA, 379 bp, Homo sapiens
gaagactggtcttaaaatcttgggctcaatcagtctttctaccttcacttcctaaagtgttgggattgcaggcgtgagccaccgctcctggccatggccgttctcttgaaaggggctggtggagttagctgatggcacagtagtgggagggagttgggattgtctctgactgcctgaggagttagtaatctcaacccatgttggtggaggtttagtttgcagaccaagatagaaatgggcctgctttactctgaatggtcaggtgcaccatttcatgggtacagttggctctgggaaccatgttttagttacagctgatggtgagaggtaacaagaacctggagaaagacgaggaagaggggacaggcaattggtgaga

SEQ ID NO: 257099 - DNA, 437 bp, Homo sapiens
gcttcttcaaagattaagggaacatcagcctgcctagataagaaaatcagtgcaagaactctggcaacttgaaaagccagattgtctttgtattcagaatgaccacactagttctctagcaatggttgttaaccaggctgaaatggctgaaatgacagacatagaattcagaatatgaataggagcaaaaatcatcaagattcaggagaaagtcaaaacctagtccaaggaatctaagaaatacaataaaataatacaggagctgaaagagaggaaatggccattttaagaaggagtcacaatcatctgatagaggtgaaaaactcactacagaagttttatgatacaatttcaagtattaatagcacaaatagatcacactgaggaaagactctcagagctcaaatactggtactctgaattaactaattcaaaca

SEQ ID NO: 257100 - DNA, 259 bp, Homo sapiens
cctcaaactagatcctgttcagacacaaacaagttagtatgagtttgtttcagtgaaaaaaaaatttgaaattcatgcatagtttttcataatgtgaatttttcatgaacttttggaagaccttttgaatacttttttaattgcagcactcttttgcaccataaaactaattggtggctttaccattaagaagttgagccaagcaaacaataatgaaaatgctttatgtggaataaaaatttacacttaaatgcctttt

SEQ ID NO: 257101 - DNA, 279 bp, Homo sapiens
tgagtactgttctggtgatagtgagtgagctgtcgtcatgagatctggtcgtgtaaagggcctcactctgtcacccaggagtacagtggcacgatcacagctcactgcagccttgaactcctgtgctcaagggatcctccagcctccaccaccacagtagctgggactacaggtgcgagccaccacacctagctaatttttgtatttttacaaaacatggtctggctatgttgcccaggctggtctcaagctcctgggctcaagcgatcctcctgcctt

SEQ ID NO: 257102 - DNA, 315 bp, Homo sapiens
gattttctcctggattatctgatgtaaatgccccttctccttgtactggggtcggtagaggatattataatgatgggagaggatggtatttcagataaaagaagacaatggttgttatctttacggtaacattacataaaatacggtcttattttacttttatagccttttccttcaattcataaccagttctcttaatcgccaagaaaattaggtaccacatattttgattattcattctaatacattgacagtgtttatttagtattttattttacctatgagttatctcccattggaaatataataaaaagt

SEQ ID NO: 257103 - DNA, 525 bp, Homo sapiens
tagagatggggtttcgccatgttgcccggggtggtctccaactcctgggctcaagcaatcctcctgccttggtcttgaaagtgctgggattacaggcgtgacacttgcgcctggctgcctttcttccatcttctatgtttacttaaaatcagggaaatccaaggataatcacatggggttctgcttgtgcctctccatcactaggattgacaaattattcatcagaatttcaaactgcagaatccgtcagccttcttttatcacatttttgttcagtctctagccgtggactaacagacttagctctttcaatctttctaacgctggggtacttatctatcttccttttctgatttctacacttaatattagaacatagctaattacagcatctcactctgttgcccaggctggagtacagtgacatgatcatggctcactacaggccttgaccttccagaatcaagtgatcctcctgcctcagcctccctagtagctgagactacaagtatgcactaccatgcc

SEQ ID NO: 257104 - DNA, 379 bp, Homo sapiens
atcgaaaccatcctggctaacacggtgaaaccccgcctctactaaaaataacaaaaaaaattagctgggcgctgtggcgggcacctgtagtcccacctactcgggaggctgaggcaggagaatggcgtgaacccaggaggtggagcttgcagtgagctgagattgcgccactgcactccagcctgggcgacaaaacaagactctgtctcaaaaaaaaaaaaaaaaaaaaaggctgaaacgagccagtgtataaggagcagctatgtggtattttagagattaccatgtatagattgttgttaattgtgataagaggaactgtaaatgacggctcaaagttgaaatgcttggatgatagagagcatttacaggaaacagc

SEQ ID NO: 257105 - DNA, 348 bp, Homo sapiens
tggttggtctcaatgttctgagctcaagcagtctgcctgcctcaggctcccagagtgctgggattacaggtgtgaacaaacgcacctgacctctcctttcttctattggtatacatgtctggctttataccaatgccatactgttttgattaccatagcttttggaactggaacaagacaaggatgcccactctcaccactcctcttccacatagtactggaagtcctagccagagcagtcagacaagagaaagaaataaagagcatccaaattggtaatgaggaagtaaaactgtcgctgtttgctgatgctatgattgtttacctagaaaaccctaaagactcctc

SEQ ID NO: 257106 - DNA, 464 bp, Homo sapiens
tggtttgtcctgtttgtgaaacttgcctgctctcccttgtgaaacttgctggccccacacatcccaagtgtcacccaaaggaatttggagacaaaatcattctggagaagttaccagatggggcatatctcacctgcctgttttttcctggggagaggggggcaagtggaggcagggagactccactggctcgctggagttgccattgcgggaggacagagaactcagatgtacctgccagcttacctttcctgaccagcacgaaaggcccccagcccaaaagtaccagccttggccctattcagccagggctgtcaccccaacacaaccatttgggagatttcctgagtattttagggaaaaggaactttcaggcagttcacttctacaaagagctgaataaatgggtgtagttatccccataacaacattctctgcactcacacccccatgagttttcttga

SEQ ID NO: 257107 - DNA, 358 bp, Homo sapiens
gcccaggaaaaaatgtctaaaattctgaaggcatttctattatgaacttgagaagcattttggagaactaatttatgagtactcatttatttgtaagtcacttgctaccatgtagacagtataaaaacagacatgtatacgcatgtatacataaaagtacaaacattaagattgtatagctttgattttatttttagccatgaatcagataaaactcattagtttaaaagaacagttgagaccacgcatagtggctcatgcctgtaatcttagcaccttggggcgccaaggcaggaggatcccctgaagccaggagtttgaaaccagcctgggtaacatagtgagaccccatctctac

SEQ ID NO: 257108 - DNA, 198 bp, Homo sapiens
gagtagaggagtggtagagcatacagtcagacaccaacagatgccagcaggccatctaccgtgggacaacgaggaagccggttaggggcagccagactccaggggaagaccactttcccactgcctccccttctggctccccatccatctgctgacagctacctccactcaataaaaccttacactcattctccaaaa

SEQ ID NO: 257109 - DNA, 373 bp, Homo sapiens
caaaaattaaccgggcgtggtggtgggcacctgtaatcctagctactcaggaggctgaggcaggagaatcgcttgaacccaggaggtggaggttgctgtgagctgacatcgcaccactgcactccagcctgggcgacagagcaagtctccatctcaaaaaaaaaaaaaaaaaaaaaaaaaggaatcctttcggaaacttcaaaataattatagatgtggatgatgatggtgatgatgatgatattgacagaaatggaagagttataattgaactcatactttgtaacaggtatctaagatttgaaagaaatcaagtgagaggcggatagaaatcatctgaaatgcgctaatggaatatagaatggagtagaga

SEQ ID NO: 257110 - DNA, 1282 bp, Homo sapiens
tttgagacggagtttcactctatcgcccaggctggagtgcagtggcactaccttggctcactgcaacctcctcctcctggattcaagcggtgcctcaacctcacgagtagttgggattataggcactgccaccacacccagctaattttcgtatttttagtagagacagggttttgccgtgtcggctaggccagtcttgaacccccgacctcaagtgatctgcccatctcggcttcccaacatattaggattacaggcatgagccagcgtgcccggtcgcttggctttttcatgtcacccccgaggtggccccattctgggtgggggagttactcttgggtttgggtctccctgcccctgaacatagctgttgcacaagtagctgctcacactgaactctacagagccatcagtcaaccttgagggattgttatctgaccaaagactttctatctgtccattatttattgctgcaaacataccggaaagcaaggaagccataaaaagcaaacagtagggtcatgtcaaaatgaggcagagccagcaagaagaggctcctaaacatgggacattttgaacatcagtaagggtaataactgcagttgatggaaacacattgattatatttaagtacatgaattcataataatacctaaattcatgttatcagtattggaggatgtgggcaaaccaactctatttataaaactagttaatgaaaggaaagaagcatgtttcctgccttttctaaataaactgtaccattggtgttaaatatctggtttctaaaaaatgttattttaatatatagagataggatcttgctatgttggccaggctagtctcagattcctggcctcaagcagtcctcctgccttggcctcccaaaatgctgggattacaggcatgagtcagtgtgcccaaccagtcatttcaataaatgtgctggatcaattgtatattcatgtgaaaaattacctcacatcataacaacaacaacaacaaaaatccagatggatttttaaatccatctaaatgtgaaaggtaaagcaataaagcttttgaagaaaacataggagaccaccttcatgacctcagagtaggcaaagatttcttaaacacgacacaaaaaggctcactataaaagaaaaaaattgataaattagactaaagggccactgtattagataccttgagtgattgcaaaacctggttcttgtccttatgaagttcataataaagccgattgttttctttttctttctttttttgttaagagcag

SEQ ID NO: 257111 - DNA, 438 bp, Homo sapiens
gatctccagctgcaaccctcctattgctcctttgtttgttacccatatttctccaacttctaagaagttttgttactaccttggttcatcagaaaacttcagcacaaatgtattacatgaatgtcttgtaatacacaagtgtattacatgaatcactgtcgatctgtcttgcagaaagacctgggtagtgaagatgagagtgagacctcccactagtgaataaggttctcaaatgggggaatgaagagagaggttaaagattagcccccctctaatcacatatgctatctctgaatgtcaatctatcacaaccctttcacgtgaaccccttagagttgtaagttcttaaaagggccaggaactctttcttcagagagctcagttcttgacatgcaagtctgctgatgctcctggccaaataaagccacttccttctta

SEQ ID NO: 257112 - DNA, 576 bp, Homo sapiens
cagtctgcttgatggttatacgacttcagtgctctggtacagtgagaataaagagtttatttgggctctttggctcaggataggagtgtacagttataaccaactaagccttaaagttgagcagaaagaggagagttggtggaggttgctgatttctctctctagtgatctctgcttaatgcaaaaactgccatgaataaatagttgagacagaaaaatttagacctgaaaataaggtgttaaaaagtgtatgtactctttttttttttaacatttatttaagtaaatagtttgttctgtattttgcagtcctcccacaaacacattgtactgttaaaatgttttctcaaattgttttcaatagtgtctcagatgtgtggttacattaattgcattcactgggttatgatctactcctggctggatctactcagctgatgacggtctttacagcacacttctggttagactgctgtagttgaaaggtgattccatcccttctccaaagtataatggagaaggatttgaaaaagggcagaatgggaaaataaagatatttcgctattttttctctga

SEQ ID NO: 257113 - DNA, 409 bp, Homo sapiens
gcagggctcaggcacactgtattggtgaattatagcaacctgtagatgggaagctgtgtagtttttttatttcttcaagtagaaatgtgagtattagcacattcattcaaatagagttacatgttataaatttttaagcaaaataactgacctaagtatgttatacagctcaaatttccccccagaaaattttggactgttttactaagattttagtttttagtgtcaagtattaaggccaggatttttatgtggaagcaggtttttaaaaatttatatacacattgacttaattttaacatcctcttgatcatcaagagattaagtatttaaatgtttgtaggaaagtagcttttttttttttgagtctcgctctgttgcctaggctggagtgcagtggcgtgatctc

SEQ ID NO: 257114 - DNA, 2814 bp, Homo sapiens
agcggagtctcgcgggaagctccgttgtgggcgccccggctggtggctgagctcaggccttcaggcagaggggaggcgagggcggggcggtcacgtgagagcactgccgcggtgggttgtgggggtgctgcggcgccgtttgctttgccaaaccgacaaaagagagatgatggccaacgacgccaagcccgacgtgaagaccgtgcaggtgctgcgggacacagccaaccgcctgcggatccattccatcagggccacgtgtgcctctggttctggccagctcacgtcgtgctgcagtgcagcggaggtcgtgtctgtcctcttcttccacacgatgaagtataaacagacagacccagaacacccggacaacgaccggttcatcctctccaggggacatgctgctcctatcctctatgctgcttgggtggaggtgggtgacatcagtgaatctgacttgctgaacctgaggaaacttcacagcgacttggagagacaccctaccccccgattgccgtttgttgacgtggcaacagggtccctaggtcagggattaggtactgcatgtggaatggcttatactggcaagtaccttgacaaggccagctaccgggtgttctgccttatgggagatggcgaatcctcagaaggctctgtgtgggaggcttttgcttttgcctcccactacaacttggacaatctcgtggcggtcttcgacgtgaaccgcttgggacaaagtggccctgcaccccttgagcatggcgcagacatctaccagaattgctgtgaagcctttggatggaatacttacttagtggatggccatgatgtggaggccttgtgccaagcattttggcaagcaagtcaagtgaagaacaagcctactgctatagttgccaagaccttcaaaggtcggggtattccaaatattgaggatgcagaaaattggcatggaaagccagtgccaaaagaaagagcagatgcaattgtcaaattaattgagagtcagatacagaccaatgagaatctcataccaaaatcgcctgtggaagactcacctcaaataagcatcacagatataaaaatgacctccccacctgcttacaaagttggtgacaagatagctactcagaaaacatatggtttggctctggctaaactgggccgtgcaaatgaaagagttattgttctgagtggtgacacgatgaactccaccttttctgagatattcaggaaagaacaccctgagcgtttcatagagtgtattattgctgaacaaaacatggtaagtgtggcactaggctgtgctacacgtggtcgaaccattgcttttgctggtgcttttgctgccttttttactagagcattcgatcagctccgaatgggagccatttctcaagccaatatcaaccttattggttcccactgtggggtatccactggagaagatggagtctcccagatggccctggaggatctagccatgttccgaagcattcccaattgtactgttttctatccaagtgatgccatctcgacagagcatgctatttatctagccgccaataccaagggaatgtgcttcattcgaaccagccaaccagaaactgcagttatttataccccacaagaaaattttgagattggccaggccaaggtggtccgccacggtgtcaatgataaagtcacagtaattggagctggagttactctccatgaagccttagaagctgctgaccatctttctcaacaaggtatttctgtccgtgtcatcgacccatttaccattaaacccctggatgccgccaccatcatctccagtgcaaaagccacaggcggccgagttatcacagtggaggatcactacagggaaggtggcattggagaagctgtttgtgcagctgtctccagggagcctgatatccttgttcatcaactggcagtgtcaggagtgcctcaacgtgggaaaactagtgaattgctggatatgtttggaatcagtaccagacacattatagcagccgtaacacttactttaatgaagtaaactaggcttatttctaaaaagtcaagtctattggctttggcccaaaagcactggtatctttgtattaaattcatgtttattgtcacaaaaccattatttatacctatacagttgtactgtttcttttaaagcaaagccatttaacatctttcttcattcctaatttggaaattaaagtttacctttctgttaatctatgtataaatgttactctgagttattaatgtggattttaaaattgtaagcaatagaataggaaataaaacaactacctaatacaaatatttctgataagactacaaatatctgactgagctggggattaaagtagaggtaactgtatcttaaatgagtatgatttccttgtaagttaaaaaaattgaaatttaattgtagacttcaatagtccaagttttgaaggatgtttgagcttttgtataatgccatttatacctgcagttttacagataatgtttgactgcagttgccttggaaattcctccaaagtttgccttcatctctcctctacagtttggaggtgatggtgcagcagtggaacatctcttgatgcaccacactacttgtgttctgtgaagtgatgaaagtataactggttctagtttgcacactacacacatagttttgtgaagcttcagaaatgttttttcttttccttgtggccaaaccagtttgttaatctgattatattcatctgctaatgatactaaagttaatgtaataaagcatttaaaaatcaaaaaaaaaag

SEQ ID NO: 257115 - DNA, 488 bp, Homo sapiens
atctatttaatacttaatgttgctatcttttggatctcttgcgttggtactgtgcgtgcctggctttaaagaaaggtagagaatcttttcttcatttgatccttgatctataactcaaagctgtttttatgcattttgtgttttctgattttatatccttcatgttcttgtttttaagcagtattagtagtgaaaactggctgcgcgtggtggctcatgtctgtaatcctagaactttgggaggttgaggcaggcagatcacttgagcccaagagtacgagaccagcctggacaacatgacaaaacccagtctctacaaaaaaatacaaaaattagcgaggcgtggtgtcatgtgcctgtagttccacttcctctggaggctgagttgggagaatcatatgagcccaggaggtcgaggctgcagtgagctatgatcataccactgcactccagcctgagtaacagtgagaccctatctcaaaaaaaaa

SEQ ID NO: 257116 - DNA, 168 bp, Homo sapiens
tttaagttttaactttgtgtttggaatagtcagcttaaattccagaaacctaaataatcaagtttaactgtttcttcagttgagttaccatatatggagggaacataaatacactaataattatgcttgaatttgtctgcccttgatttaagcttcaaaaacaaaact

SEQ ID NO: 257117 - DNA, 1154 bp, Homo sapiens
  misc_feature (76)..(76): n is a, c, g, or t
  misc_feature (438)..(438): n is a, c, g, or t
  misc_feature (694)..(694): n is a, c, g, or t
  misc_feature (927)..(927): n is a, c, g, or t
  misc_feature (934)..(934): n is a, c, g, or t
  misc_feature (954)..(954): n is a, c, g, or t
  misc_feature (1143)..(1143): n is a, c, g, or t
tggcagaggagaccaccagcaagtagaacaatgaaggaccccagcattgccctgaacagaagaggcgaggatgttntgggtgagaggactcgtcttggggctctatgtgctttctacaatgctgagttgcacagtgagtgaaggtatgagtttcaagccaaactatctaggttccttcacttggtaactatgtgatcttggagaagttattagtctgtttgtgtctgaaattccatatgtgtgaatggaagtaattatatatagctgacttataaattattttgaggataagatgaaatatgtgcaaacacaagaatgtttggcacatagtaagcattcagtttattcagttacaatcaagtaaggcagtatgggtagtgcttaaggaaggactatgaagacacagagattgatatataagatcttggttctgttggnaggactttgctgagttctcctggacagtgcatgtaaagtgaggtttagggtaccagttacctgatccagcaatggtggtgagttgactcctttccagtgggggagcccatttgacccaaattgaatactgaccagttaataccataacctggggggaaaaattccattcttggagatctgaggtcattctggaacctatatccacttatacctggaaaacatcttggtacctgggctatgcttgtacaatccggangcaatgagcaaggccactcccgcattagctgccagtggaatgaagagggtcaggaatgaggaaataaacaagccagcaccaaccacatacttggctccaaatattccagccacatagccactgggattggagccaagaatgagcatagttgagggagctgaggatgattccctggatttcaggactccagtcatatgcaggggcctagatgacaaagagagttactgtttgtntttagtngaaggattgacagttttcantgtgaggacttgagaggcaaaaattaattggcagttatctttctgtttacatttctccagttcctccaatataccagtatcatgtattaaacctaatatatgccatatactctttccgctcaccctgacacaactaaccaaaaattaaatataagagagttcgtaaagaaacaaagactataaagaagnaagcatataag

SEQ ID NO: 257118 - DNA, 477 bp, Homo sapiens
ctgatgttaaggatggttttggtgcattagccagaatatatttagccttcaattttgtttaggtactgctgaaattgatgaaattgaagaacttcagtcatacctgtaattatatttttctgacaaaagggctgatgtggaaaataccccaactgtttggaaggccacagtattgcataactctacgcagtgcctcatcattaattcatatgcccaataaatatttggcgagtgcctattatgtatgttctaggcactgtcttgggtgctgggcttatagaagtgaacaaaacagacaaaaaccaaattctgctattgttgagcttatcttctattagagaaatcacaaaataacaagataaatgcccaggtggaaattaaatcaaagaaagggagaagaaatacagagtggttgcaactttagattaggtgggcagggtagttttcatggagaaagtgacatgtgagataagactt

SEQ ID NO: 257119 - DNA, 489 bp, Homo sapiens
agccttggctggtcttgcctttccttcctgttcccactgccgccatgttggttcagtctcctgtcactcacaacaagatgaacagcaatgttctcttctctgtctccttgatggaacagatgccttcctcgttgtttggacttgagtcagtcccggcaaatgtttaagtggcctggagagctaagagagtgctagaagggagactgctgtccccacaatggctgcagccccattcctttttccaagctgcctgggtgaacattccaggatcctgacattctgtggaaattgatgagtgcttgctcaaaggtcgatgatgtgctacagatggcatcacctgttagagacagagctttctcaagaggagctttgatttcctttacttcccgaactgctatttcacagtctctcagtagatgtcagcagcacagcaaacatctcactgcccatcatggaagcaggttggttcaaaaacttttccaattaaag

SEQ ID NO: 257120 - DNA, 1303 bp, Homo sapiens
agccttggctggtcttgcctttccttcctgttcccactgccgccatgttggttcagtctcctgtcactcacaacaagatgaacagcaatgttctcttctctgtctccttgatggaacagatgccttcctcgttgtttggacttgagtcagtcccggcaaatgtttaagtggcctggagagctaagagagtgctagaagggagactgctgtccccacaatggctgcagccccattcctttttccaagctgcctgggtgaacattccaggatcctgacattctgtggaaattgatgagtgcttgctcaaaggtcgatgatgtgctacagatggcatcacctgttagagacagagctttctcaagaggagctttgatttcctttacttcccgaactgctatttcacagtctctcagtagatgtcagcagcacagcaaacatctcactgcccatcatggaagcaggtaccagggctatatccacattgaaatgttggatgctccgaagaaatgccacatgtgtctgggcctctgatacttagcacacgctctgtacacttggaacatcttacaccattttctacctattggaattgtatttaccctttaaaactcagtaaatgctgtctcctacatgaagccctccagaatgccctaggtgcagctaatcactcattgcattttatatcgtcttatgaacatacgctgtaacaatgggactaatgtttctgtatttcttaccaatctgtgagccccttgagtctataaccatatttttttatctttgtacctcaattatctggcccacagaagacatactgttattgattgaatcattaaaacaaaatatctagaacatctttttaatatttaaaatgttttactctgacacatccttattttggcattgcttatgtattagaatacttgtagcaatttcagaaattctatctgcataaacttaagtcaaataagagacaagtattggttcacatgacttgctgtgaaaagggtagtgtaaagctgactttctgggcagctgaaaacaaggattcaaatatgctcagaactctctactccagattctaccctgcacgagggctttattccttccatggattttcttccagggaagttttgaatcaatattaacagcaacataacagagatgaaagagctttactcctaaatccagtgtgaaacattttggagaactcttattggctgcatttgggtcaaatgcttgcctctaaaccatctgggaaagtagagtcagctaagggaatgaacaaatatggctaaaatag

SEQ ID NO: 257121 - DNA, 190 bp, Homo sapiens
agacagagggtgcactgcccttcgtttttctcctcaaacataccaaacttttccctgcattacactactctgcactagttctttcttttgtccggaatgctattttctgtgtatgaaatactattgccccttattatcatgtaactgcctctttcatgcccctcaaatcttagcctcccctgcccaccca

SEQ ID NO: 257122 - DNA, 1113 bp, Homo sapiens
atgtcgtctggaactacagcaaaggtgtttgggcttagagatggtacttctagattgattagtgagccctggctgtaatttaaagccctgggagaggatggatgtagggagagtgtagaatgagaaggtgctcattgaaggactcctatagtgcattggtctcagacattagtgttcattgtaaacattcagaggatttggtaaaacagaagtgctgagcctggtccccaacttttgattatgtctgagtgaggcccactctttcagtgatacagatgctgccggttcaggaaccacgtcttgagtaccgagtaccactgatttcgagcgggcgaagaagactaagaagaaggtgctagagaggtatgaggaataccaggacactctgatacctggaaacttgagagtatttcaagaaggggagggagtgagcagttgtgttgctgcaaagtcatcttacttgatcacatttgtacgcctggcattcacagttattcatgctcacttcttatctttaaaagcttacctgtaattatttgctaggtgaatactctttgcgcctggtgcaatgtgctccactccctgttggtccgtgactgaatcttgtacttgcctagcactctgcctttgtctctgtaatccctgtttcctaagtactggttatgatcacttcctcctttctgtggacacttgtaactatttgcttttttccctcttgtcacatttaacctgtcttgagatggaattatgtaagcacctagaaacactaaggttgttaagtactgttcctctgtcatctccactaccagatagtaaaattcttaaggctagacagactctgttttaattgatgttgtatcacacaagttggccataccatgaacattcagctacttctcaaaggaaatggtgcttgatttttttatttttaatcagatgatgatcttcagtagaatttaaggcctaatttgcaaattgaagagcaccaatggagggctctttactggaccatcaaaggttttgtacttaggccagaggactctgtgttttctagtttggtgaagacaaacaactgttaaggcagtgtcatttcacttaacaacttgaaacagg

SEQ ID NO: 257123 - DNA, 292 bp, Homo sapiens
gacatcatttggggaaatgctcagggcttcctttttaggtgtgagaagtcagctgccagttgtcgttttcagctctataggattcctcagtactttggaaattccagtttagaaagagttagttttgggagagagtgctttgcttagagctaagaatcttactattctagtcatatcttagaaagtgacaaactttctttgtgtatcattcctctttttctgagtgctgtaaataaattttgctcaataataaaatgagatattagagctctcggaatgaatgccactttta

SEQ ID NO: 257124 - DNA, 393 bp, Homo sapiens
agcaaatatagagggctgtaggtggcattgctttgtttagcatgctcccagcccaccctacttggaattggggaagaactggattcccatgtcaggcaccatgggtaccacggagctgtagtcgcctatcaactgggcagctgattctggactgggtgtcttatatcaacgacaagtttaagaacagtgattaattaaactgcccctccatggttccctttggtatctggtggtattggctcctcccaattcactacctgctgtatctggaaccatagaagacctcaggatagacatctaggatatccacagttcaacttgagagtatatttctctgaaaaaaagctttgatgttttgatgcatatagtattaaacctcacactgaaacctga

SEQ ID NO: 257125 - DNA, 428 bp, Homo sapiens
aagaaaatgcaactgtaacaaatgaacatgggttatggaaaagaagtggggccgaggacgagcagtgtgtgacaagaatgacgataagcaatattctcttcttagaagtttggctcgcagaaacaatattctgttctgcagttattggtttgcattacatttattcaaaatacaatttgaaatgcaagaatcatgaactagacctacttttcctcttctcccttgctacctgtaagggagatttcaatcttacaaccactgaaaaccataatcaatgtgaagagggattgggatggctacagtaccagtcctaggaggaggctagaaagcacaaaacctcacaattccctgtcaggctggtatagggcatgttgaaccaacaatcacattcaaggtagacatttgatgggaagtatattaaatgtgtg

SEQ ID NO: 257126 - DNA, 386 bp, Homo sapiens
aactgtactttcttacctgttgcatcattcattcccagctcagagtcatctcatctatgtaatgacctcaaatcagtttcgagtatggaagaaatgccaagacaggtgaaaaaagtgagacttcaaatgtaatttttatttttaattaaaaagtttttgctctcacagtcatactaggtcaaactttgtggtaatcagcatatttttatattcctgcactgtatgtagaagctgtaaatattttccagttgatcttgaatacttctaagagcttgacaccaaggatcacaaaattaccataaattgcaacaatcccactactatctaagtatacccaaacacacacacacacacacacacacacacacacacacacacacaccctt

SEQ ID NO: 257127 - DNA, 317 bp, Homo sapiens
cctgcactcctgcttcctcccaagtaaactacctgccctcacgtccttattttaggctgtgctttcagggcaggtgatcacagaaaactctttttattaggttggtgcaaaagtcattgcatttttggccattactttcaatgacagaaaccgcagttacttttgcaccaacttaatcctttattagttatgtacctatgggttaaaatatgttaacatatatatgtttaacacatgcatatattaaaatataaacagcacagataatagcccaaaggtggaaacaacccaaatgtccatccttgatgaatgggtaa

SEQ ID NO: 257128 - DNA, 287 bp, Homo sapiens
aaactgatgtctttggacaacagccagcgaggatctgagacctgccaagaattacataaatgtgtttgtggaagtggatattcatctagcccagcctcgtatgattggtgctccagccaacaacttcatgacacccttgcaaagcatcttgatcctgagaaatccacttaaactttgccccgattcctgacccacagctttgggataatgaacgtctgatgttttcagccactaagttttggtaattttttgtgccctggaagctaacaagtatatttgttatcatt

SEQ ID NO: 257129 - DNA, 438 bp, Homo sapiens
actacaacctaggcaacaaaagcaaagctccatttcaaatatatatatatatatgtatacacacacacagacacatatacacatatatacatatatataaacacacatattttatatatatattatatatattatatatattatatatatatatatattatatatataatatatatataatatatatatatctcctcaggcaagaataaatgaatattgaattcagaagtgaaataaacttttatttaaatcaaacattctgttctactcttggaaattttagacaagaaaattgttttcagaaccataaaatttagcagatttccaaaatagaaaagaatgaatgaatgaactgagaacaaatcaaaacaaacaaataggtctttgaaaaaattgtgtcacacaatgaaagagaagagtattaagcaaagtatcaca

SEQ ID NO: 257130 - DNA, 343 bp, Homo sapiens
gctctggtgggcattttcacctttgttgtttctcataattaccctgttaacatttaggttattatcctagttttatagttgataaaaccaaggcccaaatatgtgaagtgacttatcaaggattaaacagatgaagaagtgtcatcattttctactaaatgataacctgtgatttatgaatcagatttcccattttatagatggtaaaactaaggctcagatacagatgctaagtgatagaaccaggataccgattcactcttttgctggcctacaaaccctttatactctattcttacctccccatcatgttctaccttttttcagatgagaaaactaaggc

SEQ ID NO: 257131 - DNA, 301 bp, Homo sapiens
atatcaccttttggcaacccctaatgaaataatggatcctggcaatgatcactagcggctgttaacgtcagaaagagagacagctagacaatgcgtgctgcctaatggggtactcccatcagacagcacaccgtttgtcttatcaagtattcttggagtaatgggggtggtgtgtatagatgaaacatgattgcctatgagttaacagttgttgaagttcaatgatgggtgtatggcattgcattatgctaatctctacttctgtatgtgtctgaagtttttcagaataaaacttttttta

SEQ ID NO: 257132 - DNA, 294 bp, Homo sapiens
gtgctgtgctgacctcaagagggacagcagaggaaatgggggtggaggtggagggacttcacagagcactgaatgaccactcacttttagccagtctgatctgagcccaaggagggatggagagaccctgccagaccttaaggagacctttagaattaaaataatcctgaaccccaaccccttcaaagagaaagtttctttatctgttattctgtaagcatcaaggaaccatgacctagagctgaaacttaaatttcctagctaaattctattctccaagctcttgcttctcaa

SEQ ID NO: 257133 - DNA, 273 bp, Homo sapiens
ccttagttttctaagacaatgcaatataataaaatgataggctgagcaacagaaaaatttggtggaaatcaagtctgatatatgctgagcatatgtgaaatcagtttcttaatctgagtgttagtcactgttagaatgtttgataatgtctggaatgagtcttttggttttatagttgacttgaggttttgcttaaaaagaataatttcatcctttgttagttgttttgctgttttctacttcataatataaaagtaaaagcactccaaattt

SEQ ID NO: 257134 - DNA, 295 bp, Homo sapiens
acaaaaatcagaaagcacactagcccagtgcccagccacaatggtgaggaaaccccactcaaaatcctgggttgtgcccctgatgccaaagatctgcaaaattgggactcacctgctgcaaccctagcccagacttgtgtacatttcaggggtggctggactcatggctgcctgggacgtcagggtggtacaaagtactcttaatctaagactgtcggggtacaaagataagcatttttttcccttttcttgagagccagatggtaaatagttcagctttgcaggccataggtct

SEQ ID NO: 257135 - DNA, 1306 bp, Homo sapiens
agagtggtaggcaggggccagattgtcaacaaacctgagtgggctccgccgtgagaatgatagtaagcacaaaccaggaacattcctctttgtctgctttccctgggccctcttacacccacttggttctctattaaatatgggcatctccggccaggcaccgtggctcacgcctgtaatcccagcactttgggaggccaaggcaggtggatcacgaggtcaggagatcgagaccatcctgggtaacatggtgaaaccccgtctctactaaaattacaaaaaattagccgggcatggtggcaggtgcctgtagtcctagctactcgggaggctgaggcagaagaattgcttgaaccaggcaccgagatcgcgccactgctctccagcctcagtgacagagtgagactccatctcaaaaaaaaaaaaaaaaaaaaagtgggggcatctcccaagcagaaagcaaagcctaagcctactcacttctttggggagagaggaagaaagtcttggacagtaattgagcatcctctttgggcacctgccccaacaacttcacacacattatcatctcatttaactgaggttggatctgcaaaggcagcttggcttggcagaaagagcgggagctttggaatgagggcctagatctcaccgtgggctctatcacttggtgctatttttagcaagcatgcagtaataatcataatactctcagcagttaagcttaattgggtgattatgatgtgccagacgtggttctaagcacttcatatctattagctcataattttaagagctgggtagtattataatttctctttgcaaatgagataactttgcccaaagtcaacaaagccaataattggaagaggtaggatttgaatctatacaggtatgattgacatttgtgaacttgtttagctgctaagtctctataccctgatttcctttggaagaattacctctgctccactgtatgtggtcctggtgggatagttaatgcacgtgcccattttctcataatgaaaagcaagcagggtccctcaaagctccttgcaccagatccttatttttacactaaagccaaccaacctttgtcctaagccaggctaatcagactgcttacctggcactttaaatctcgaattgagtaaagcaagagtggaagaagcagatttaatgcttttcaggtgagagtgttgagtggctcatgatacagaaatctcttggtttcccaggcttcactctttcccaaacccactctccagccttcactttaatcctttgaactccacccctttgccag

SEQ ID NO: 257136 - DNA, 309 bp, Homo sapiens
caaggactcaaatcttggatcttgaaaaaaaattaattgaaatgctacttgatttcaaaagacttagaataccactaatgatagaaataatggtaacttctaaataagtaaccaaaataggcctctattggtagctgagaaaagctcttccagctgcggaagacagcgtgcggcagcgtgggtgctggcggagacactgatttgattgtggccatgatcataccacgtatacgtacatcaaatcatcatgtggtacatcttgaattagtcaatctttatttgtcaattaaatattttttaattaaaaaa

SEQ ID NO: 257137 - DNA, 522 bp, Homo sapiens
cagtggattcccgaaaatctctgtgcaaataaatcccattataaaaccagaaatgattcatcttttctgattgatcttcaatataaatggttcttaacatttaacctttaagatcctttgtctgagccacatggggttcaacttccttctctatactactggctcctaaatattagttcttaatgaagtgttcaccatgctcttgtgaaataagaaaatgaagggaaatgaagtaacattttgggagataaatgtattcaaattaaatggccttgtttaattctgagattatgccattatgttttccctttttgatgttaaaaagaccttttcttttatgaaatcatgctaacagtagatgttcatttatagtgtgttgcttataattttactggtttctgaaatctaaaactatttgtatctcaatatgcaaccatacaaaacatctcaagccaacctctgccaagagttaatgcatttttcaacaaacgaataaatatagaacttactttataaagaaaa

SEQ ID NO: 257138 - DNA, 204 bp, Homo sapiens
attattgttatatgttctgtgattcaggcatttagttcaactcatgcatgaatcactatgggattctattaaaaagaactagccacgaggcataacggctcatgcctgtaatcccattactttgggaggctgaggcgggtagattatttgaggtcaggagtttgagaccagcttagccagcatgctgagaccctgtctctactt

SEQ ID NO: 257139 - DNA, 414 bp, Homo sapiens
gaaagagcttgtaggctatcatgaaaagttgaatattaacaaaatccaatgaaaaactaatgaaaagtttaagcaggtgcataacacaatcaaatttctgttttaaaaaccctactctggtacagagtaaagaacagatttgagtaggaggcaaggagaatgcagaagtcagtaagaaaaagtctcagtaagagataatagtggcaaagagaatggagtcaaaaataattagatttgctgtagaatagaaatgggatttgagagagaagaaatatcaaaaataatacaattaacaggttttaacaagcttgatggatggtagtgtcataaagtaaatgggggaaaactggggaggaatagttattttttgttgaaggaggaggagtttttgcatgttactacattaagttgcta

SEQ ID NO: 257140 - DNA, 650 bp, Homo sapiens
agcaatttggactccctttgtctcttattgtcctgtgacagttaccatgagtgcattctcccatttttgtttaccagatctgccccaggaactttttaaaagattgatttctttcttttgaaaataaaacaaatatgtgaaacatactgaaaatgctaaaacctacatgagagtattagaaagtaaagaatgtaattctataatcagctacatatggataggcagagagaggggtctgcttcttgtccagctgtagctctgtgctagtggaagcatgtcctggagttcacgatgtggccaagagaacagatgtagttaggcaatggaggtgggacagagagctgcaaagtgctgcacttgcccctcttactggacccaaaaggctctcaagtgtaacacctttctgtagtgctgtagatcattaatctgggtgtgtgatgaccatctgatctagcacatccagtggcattgtgcatattgggataggaatttgattttgtgaactcaagctattcagcagggcccatgaaaaatcaccagaagggtaggtgggtctttgccactgtctgatgtttcaaagatttcttgtattaaatgctgtgtccaaaattatagaatactctccagtttgtatttatgtaaaaaaaaaa

SEQ ID NO: 257141 - DNA, 987 bp, Homo sapiens
gtatcccataaatatacacacctactgtggtacccacaaaaattaagttttttaaaaagtgacaaaatgaaagcaacttgtacatttatattctctaatgttctccttgatttctcaatgatacaaccttgccctcacaagtgttaaagcagtaactttactatgctcaagtaaggtgtggcaggtgaattctaacagtgcctccatgatctctgttccctggtcttatgtctgtgactaggttacattatacggcaaagatgatggatttggttacattttatggcaatggtgaatgaattttgaaaatgcagttaaggtcccaaagcagctgaatttactcaaaaaggagatgatcctgagtgggcctcatttcatcatgtaagttctttgaaagcgagtctagatgtgagagacaatcttctactggcctcaaatcagaaaacagccacattatgttctgagtatggagaggggtggcctctgggaggtgagggcctcagcctcaaaaccacaggaggtgaattctgccaagaagcatatgagcttgaaagaggaccccaaagcctcagaagatacagtaaccccatctgacaccttggttacaacctgtgagatctcaaagagaggacccagctcatctgtgcacagacttctaacccatggaaactgtgaaataagaaatactgtgttttgagctgttaaattggtggcaatttgttacacagccacagacaactagtacgtaaagttatatccaatgcactataaaacttgtcaatttatgtagaaattatatacacatacacatgtaatttatacatatttgcacatacacacccccctccgtagttcagcagtagcatcactaacttagagttttaattgcaaaactttcattgaagctgtggagccactctacaaaagttatgagagaacatatttttaagaaaattgcccccctgccctccaacccccatcactaca

SEQ ID NO: 257142 - DNA, 760 bp, Homo sapiens
caggagagaagaaacgcaaatcccagaaccgtgccaacatataaaaccccacattaagggttgtacagtgcactgggatttctcaagtcacccgcttggtcctcttccaagtatactttacttcctttcattcctctctaaaacttttttaaaaactttcactcctgctctaaaagttatcttggtttcttactctaccttatgccccttgggcgaattttttcctctgaggagggaagaatagagttgctgctgcagacacatcagattccctactggtaacagctggagtgcgtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccaggtaggaggccagctctggaggactgatgcagcccaaggactgccccgctcattgcctgctccagcattagctttgccccatttgctttggaaactggacccttagacacatggtatcgtcctcagtggtgagatgttccaagcagtggttcacagacctctctgtgactggctaggcctgcatgattgaaaaattcatcctgattgcctgcccaaagatgaaattagtaattatagacttccattccagccacactccagagtatcttcattgt

SEQ ID NO: 257143 - DNA, 652 bp, Homo sapiens
caggagagaagaaacgcaaatcccagaaccgtgccaacatataaaaccccacattaagggttgtacagtgcactgggatttctcaagtcacccgcttggtcctcttccaagtatactttacttcctttcattcctctctaaaacttttttaaaaactttcactcctgctctaaaagttatcttggtttcttactctaccttatgccccttgggcgaattttttcctctgaggagggaagaatagagttgctgctgcagacacatcagattccctactggtaacagctggagtgcgtcacctctgacaaaattctggggacgctgggaacactgaatcaacatgggcaatgagaacagcacctcggacaaccagaggactttatcagctcagactccaaggtccgcgcagccacccgggaacagtcagaatataaaaaggaagcagcaggacacgcccggaagccctgaccacagagacgcgtccagatggtaacgacttcagccagcctgaagggaagccacatcctttcctaagttggcagttcctgtcagaggcgtggacaagaaagtggcttcgtttctttccagcttgataaagccgacataaataggagcacttcatttctgaattacacaccattactcttatcac

SEQ ID NO: 257144 - DNA, 438 bp, Homo sapiens
cgagggcggagacgcgctgcttgaggtgtgtcagggcctctgcttagaactcgcgcaattctgaacggaggaggagaaagtccagttgctgaagggcagaatttccatgcgcccgcagcttccaagtccagaccacccccgaattcacctctgacaaaattctggggacgctgggaacactgaatcaacatgggcaatgagaacagcacctcggacaaccaggtgggtgtcaggaagcttctctctcgagctacgtggtgctcttggcagaccttgactaggttctttttacagcgtctcatcttcacccaggaaggagcaaacaagacagcttctgcgtagatgtgtgcgggcatttatggatctatgcagccatttttcatttcattggaattctcttacgattaaggctagctctagttaaagccggaaacgcta

SEQ ID NO: 257145 - DNA, 508 bp, Homo sapiens
ctaactcatgatctccaccccattttgtacttacacagcctctctgtgaagtctgtaaaactaatgactttgaagtggagtaaaatattatttccccaatttttatcagcttctgagttagaaatgttcagagaatgggtcttctatattccaaatccccattgaaaatacttaaaacatttttttctttccctttgagtttcttttgtgtgtcagcttcaagcatgctttgagcattctctctttgttccctggggactagcagcagagctgactggtcccttgaactgaatgaggcccccacctccaccctgcatgtggtcttttgttgggcttaggtagaattggaaagatgaataattttcagagatttcccagtgtaacaggacagaaatagcttgtgtcttgtttgacagacaagttcctttcatgtggcttcagctttgcttagtggtccatcctagccccaccaggtttctcttgtttttttttttttttcttttctttt

SEQ ID NO: 257146 - DNA, 255 bp, Homo sapiens
gtcttttctggtagagatgggggatctccctgtgttgcccaggctggtctgaagctcctggcctcaagccatcctctcacctcagcctcccaaagtgctaggattacagatgtgagctaccatgcctggccctttaattgttttttatactttaaaaggtatatattctttactttattctacatcttaatttatatgtataatatattcttatatatctcacgtgcataatatattctactaaaagcttttttt

SEQ ID NO: 257147 - DNA, 394 bp, Homo sapiens
ttttgagatggagtctcgctctgttgcccaggctggagtgcaatggcacaatctcagctcactgcaacctctgcctccagggtttaagcaagtctcctgcctcagccccctgagtagctaggactacagatgtgcaccaccacacccggctaatttttagtagcgacagggttttaccatgttggccaggctggtcttgaactcctgacctcaggtgatctactcgcctcagcctctcaaaatgcagggattacaggcgtgagccaccgcgcctggccagcaaggcttttaaaatacagtgtttaattcttatgacataatttactgtgattttaaaataataacctgttatgtggggggtacttctttgttaatatttagagatttgtgaggc

SEQ ID NO: 257148 - DNA, 535 bp, Homo sapiens
acctagcataacaggtatttagtaactgttaatattctttctccattcctaatcctgttatttctttatcctcatgaaagttgatgcttttaaattttttctttacttgtctgtcactaccctagattatattctagttacagctaagaatagtgtctttcaccactgtggaagacactgatacttgtctactgtttggccattgctcttttattattcttagttttattcacccatattctctctgttgacattttagaccacacttctttgtgtgaaatagacaaatattttccagcatattggatagttttagctgtcatctattaaatgctggtggtggaccccagtctccatgacaaccaaaaatatcaccgtgcatttcagaaaacttctggcatgttaatgctactattaatctgatcatagtcatttccttcttaccaaatttttaatttatgcctgtgacaatgtcattgtggctaaaaagtatgagttctttgggggctcctgaaaaaagtttttcttgctaaaa

SEQ ID NO: 257149 - DNA, 195 bp, Homo sapiens
gcggccgcctactactactactactgctcgaattcaagcttctaacgatgtacggggacatgttaatgctactattaatctgatcatagtcatttccttcttaccaaatttttaatttatgcctgtgacaatgtcattgtggctaaaaagtatgagttctttgggggctcctgaaaaaagtttttcttgctaaaa

SEQ ID NO: 257150 - DNA, 499 bp, Homo sapiens
aagttcaacaatcggctctcgtgaacagctccaactcagcattagtcttatctgagaccccatcttggtccactggagacagagacgctcctgctggccttgcagaagcaaacagcatgttgtgaacagtccctggagaggaccccatggcaggggactatgagtagcctccaggacctgagggtggcctccagcagaaggccagaaagaagctgaggccatcagtcatatggccacaaggaaatgcgtgctgccagcaggctgagtgaccttgggagaggattcttgcccagttgagcctccggatgagaatgcagcccaactcaccctggattacagccatgagaggctctgagcagaggacccagctgagctgtgcccagactcctgccccagggagaccatgtggtgctagatggatgttggtttaagctgctgaacctgtggtcatttgttacacaggaatagcaaacaaatacataattattcaacataaaaa

SEQ ID NO: 257151 - DNA, 267 bp, Homo sapiens
cttagtttgacaatgtttaaatgagaaacggagccttcaccttggatctgaagacttgtgggctcacctgagaactccatttcactcaatttaatagcaagtttaaaacagacttatctaaatattaggtctccttaacttacagtgatgtgggtagtgattctaattataggaagaaacagtcagtagagattagaccagggcaatccaggcataattcacctgagatttggcacaagctgatatttaaaactcaccttttacttg

SEQ ID NO: 257152 - DNA, 469 bp, Homo sapiens
aattgcacttacgccctcacattgtttgatatcagtggtttatggtgatagtgctgagtagtattaaagcaagcagccccaggagaagagtcttctgtttcccttactttcatcccacacacgtttgcaccatttgaccaaatttctgctagttttcaggagaaagaaaagtgacttatggcagcctgtggacagtcaagggtaccggggccagggcttataggacctgccattctgaagggtttggggctggtaggggtgttcgtgactctgtgttgctggtgtcaacattcagagccaatttgagtaaaacggtaactgtttgttatgcagaaacagagttgttgcttcaaatgctcagggaatatattcattttaactatttgtgcctgatacattggaattacactcacatatctgtggtctggtgattcaggaacagatttggtcacagaaacttcaaagggca

SEQ ID NO: 257153 - DNA, 504 bp, Homo sapiens
aggcccaaactctaggcagcttctcccagggacttcacagacactttttatgtcttgaatacctgcattcccagacccaaacccacagttcccagttcaaacacctggttctagtgccttttccgctgcccagggatgccccaggtgccaccgctcccagtctctccaagtctttacgcaaatataaagaacttctcactggcagggaataattcttacaaggctgtgtggcaaatggaaagtttttttttttcagcaaaacaaaaacaaagattcttttaacatttgtagaaagtcattcaaggaactgtttctgaaggcactactttggagtttggactgagtgtgggagagtgcggggtgagggtgtgtggacaacagggtgtctttgcctgacatgaaaatttaaaaaacaaagaaataaagggggtacttgagggtgaaagataaactcacaaacaagtcaataaacttccttttcagagttactgagcacacaggtga

SEQ ID NO: 257154 - DNA, 428 bp, Homo sapiens
ggatgcgctgaggatgctggagcactaagagaaagtgcgagcatccttgaagactctgtggagctgtcagacaagctctgcaaggctgacttctgaactctcacagaagtcaatgatatttagggtttttgttatatatagctatacttaatccttaccgatacaacttctctatcaggtgctcctatacctaatcgatgagcaatcctattgattgactctaataggcccattctctctcaatccagctaatgcctttctgttcagttctatattgtaaacctatgcctagattatggcacaggtattcctaaactggtgtcctgcctatagtcttgccatctctgatctaccttctatgatgggtgatctttgtgaaatgtaaatttaatgattccattaaatttgaaaatctcttcctcattgta

SEQ ID NO: 257155 - DNA, 413 bp, Homo sapiens
ttcctccacaagataattttagtgtatctgtttaagaatataagagtggccagaagacagaaagcagtcgtcagtcacatttcaccaaaatttacatttgtctcaggtgcattatcgcagagctttattgtatttctagtattagctatccctgtcattgctgctacttttttatcatcttcaagtaaaatttaatgtcaacaaaaattaaggtagttaataatactatagtatactagtaaagttgtctgacacagacaactaggaaatgtgatttttactttaaaatgtattttagttttagaatgtctaaattttagttttagaattgtctaaattcgagaattcataaagctgtagcccggtggaaaaagttatttgacatctcagaaattaaaaattgcagagattta

SEQ ID NO: 257156 - DNA, 385 bp, Homo sapiens
gcaccagggagcagatgagtgagactctgcgcaggtcagtggtcacgttagggaggttagcatgtgtagcggatggcagtcctgctgggatgtgcagagacaggtgagctcagaaaagggaccttggccctgcctggggacaaggagctgtcagactgcttctcaacttcccaccttgtgcagacactgtatgcaaagacaggccacatgggtgtgtgtcatggggaactgattattagattgtaatgttaaattgcaggtgtgagccaccgtgcctggccttgcttgtgaattcttagtgttagagtgcttgtttctgttgagctatgcccaagttctatgaagcatatacttaggctgttaattattgatgtcagtctcccca

SEQ ID NO: 257157 - DNA, 351 bp, Homo sapiens
ttttatatatatatatatatatatatatatactttaagttctagggtacgtgtgcgtgtgcacaacgtgcaggttttttacacatgtatatatatgtaacaaacctgcacgttgtacacatgtaccctagaacttaaagtataatataaaaaaaaaaaagaaaaaagaaatatcacttctctatggaggattttcttggtcttccagcctggattagttccctattatatgctctaacaggacctaaatttctcattagttacatatacctacagttcaatcttacatgtatatatatgtaacaaacctgcacgttgtacacatgtaccctagaacttaaagtataatata

SEQ ID NO: 257158 - DNA, 269 bp, Homo sapiens
gctctcagtcttgtaaattttcattgaaacaactcaatagtcgaatttctgcattacacagtaggcgcaaggtttgatgtttaaaatgcctaaaactggacatgatgttccttccttaaactgagcctcttccccagtcagcaaaattgccgtataagactcacatagcttattcctacttttttcttatttcacttattaagatgcccagtgcatcaccttacatctcattgattctaatgagagtggaagaggatgacgggagtgtg

SEQ ID NO: 257159 - DNA, 405 bp, Homo sapiens
aaccgtttaaggtaggtgtttagcactatgaacttttttctaacactgtttttgctggatcccagctggtatgctgtgactgtgttttcatttatttcaaataattgttttatttttgtattaatttcattgttagcacaaaagtcattcaggagaaagttgtttaatttccatatagttgtgagatgtaatggttttgaaagatcttggtattgatgtctatgtttattccactgttgcacaaaagtatggttggtatgattgcaactttttttactttactgagacttgcttgtggcgatcttggagtatgttccctgtgcagacaggaagaatgtatattctgtgtttgatgggtggagcatcctccagatgtcttttaggtcttattggccaagtgctgag

SEQ ID NO: 257160 - DNA, 440 bp, Homo sapiens
cctgcaacaacacagtcagcacattgggtggcatcatagtgaaggaagaaaaatcttccttcacccagcactgtaccagcacggagcatgggagagagtctgtgcataaccccttacaaggcagacaccagcacagaggaccaggaagagaaagcatgggcagaaagaccttgttttaggaccacaaagtcttattttataatattatagtcttcatttattgatactaaatttgtcccaatctaaatccattttctgagaaaatgtttatattactcagtttgcatcagtggcagtttacatctctaggctcttattacacggtccccaagaaggcctactcgtttactaacaacaatggggaatgacaatgaaaaaaacctttaacattttaagtgtcttttttctttcattataaaagggaaaagccttcattatta

SEQ ID NO: 257161 - DNA, 333 bp, Homo sapiens
cgtggacgggacctggaggaaagtggtcacatttaagaaacactagggaggccaggtgcagtggctgacacctgtaatcacagcactttcggcggccaagggggggtggatcacctgaggtcaggagttcgagattagcctggccaacatggtgaaaccccacctctactaaaaatacaaaactcagccgggcatggtggtgggtgcctgtagtaccagctacttgggaggctgaggcaggagaatcacttgaaccggagaagcagaggttgcagtgggcagagattgcgccactgcactccagcctgggtgacaagagtgaaactctgtctc

SEQ ID NO: 257162 - DNA, 412 bp, Homo sapiens
ggcttctactcagtagatgccaatgttgaccctcctcccagtgtgacgatcaaacatttcttcagactttggcaaatttcatctgtggggggcaacattgtccccagttgagaaccactgaggtacaacatggactgaagaggagcatgtgttaaaaacgtgtgaattatttatcctgtagtatcttactgatgttcagataaagaaaaagcaaaacaaaagacctaaaactaggctcttcccccacggggtcaggttcatgtgtatagttgcatttaattgtattacgattctgggttgttgatgggctgatcatactgtgttttctccgaaaaaacaaagaattgttcatgagtacttactaaatgaataagtgaaatgacaaatgaataaagaaacacataaaggagaa

SEQ ID NO: 257163 - DNA, 337 bp, Homo sapiens
acttagatggtctagcctactacacacctagatggtctagcctactaaactcttaatggcgttgcctactacacacctagatggtctagcctactacacacttagatggtctagcctactacacacctagatggtctagcctactaaactcttaatggcgttgcctactacacacctagatggtctagcctactacacacctagatggtctagcctactacacacttagatggtctagcctactacacatctagatagcctaacctactacacacctagatggtctaggctactacacccttagatggtctagcctactacacacctagatagccta

SEQ ID NO: 257164 - DNA, 689 bp, Homo sapiens
gccagagcagggcagaggatggccagaggaacaaagaggggagagaaagagaggatgggacgaccagctgtagagaggagctattctctctgctgatagctgcagatgatgggatgaccagttgcagagaggagttatcctctctgctgagagctgcagagacgacttgctggcagagaggagccgtcatctccagggcctcctctctgggggagagctgcagagctgcagacatcaggatgaccagttgcagagaggagctatcctctccagggccacctctctgctgagaactgaaaactccatagatgacctgcctacagagaggagctacccactgcaggtctcctctgagctgttgtaacactcagtaaagctcatttttgtcttgttcacccttcacttgtctgcatacttcattcttcctggattcaggacaagagcttgggcaaaggtgctgtggccacagaggtttctggccagaaaattgacaccccaaagatcccataacaccaggacatgacttctgatgtttcttctgatccttgcacattttcattcctcaggaaggaggcacctgtccccttactctgacctgaagccttgtaagattatcagcatgcagccgggcgcagtggctcatgcctgtaatcctagcactttgggaggccaaggcgggcagatcacga

SEQ ID NO: 257165 - DNA, 586 bp, Homo sapiens
  misc_feature (110)..(110): n is a, c, g, or t
  misc_feature (299)..(299): n is a, c, g, or t
  misc_feature (308)..(308): n is a, c, g, or t
  misc_feature (426)..(426): n is a, c, g, or t
ctgacgtccaaaattctgcctccagccctgagatcccagtttgcagatcctgcttccttctctgtccctcttcggtaaccatatacgtccccatgaggcagtcctagttncactccctaaagctgcttccctccctcccattgttcctggctcagtgaaggggacctcaggcccctgtggttcacaccagaagcactgcggtaaggcttgattcctctttcccacaccaatagccatgccaccagcaaaccctccagtgtggataccagatctgcacgcttcccaccaccagcaccctncaagcctgngccatctctcctctgtccaggggagtgacctcccaagcagctttgctgtggctactcctccccaaactgtcctggacacccagagctttcctgtcttcctggcccctgctcacgcctnttcagtcccaggagcctgttctcacaccagcgaagccgttcccacccagggccttcacatctgttcttctgtgggctgggaagccaagatctgtgtcaccagggtctggttcaattgtcatctgcaggtccttctgcaacgttaaggctcccgacagcac

SEQ ID NO: 257166 - DNA, 347 bp, Homo sapiens
ccccacagggaggggcttcttctggggtgggagtagaggcatctctggccccagaggcccaggggaaagagtcaatgagcagatgctccctggtgcacatctgaaagagcctgcagcccggcagacagcctggcagatacagacacacacatgggcccccacagccttccagccacataccctactagaagcttcagcctcctcccagcactgtcccttcaccacccacacctggtccagcccctgctacctccccctttaggcctcttcagctctcacttctagtctggaccccttccactccaaacttaatctatgggtgtttcctaagaaaatcagtcatatga

SEQ ID NO: 257167 - DNA, 666 bp, Homo sapiens
gtgtggttgcccaccttgcatgtcatccactgaagtcatgatagatgactttacaacttttaacttctgcatggttttcctttgaataggtgaagttgaggtaatttgtaactgatcctaatgtaattcttagatgcagtagatacaacatataacatttatcagaaggcacagttaagattgtgtttttgggtgaaggatggatgctataaagtataaggattttatttccgagaggatgaaagagaatgaaggaaagaaaaaaatatataaaaggaaactgaggacagtgagtggtgatgaactggtcgggtaagaaaactgagaatgtcaagaaaatcaaacagattttggagaagaaacataaacgtagtttttgaagttgtacactactcatcaagagatgtttatatcatgaatatgtttacccatttacgttcctcccaggggtacttatgggtaagggcaaatcaaactagaattcatctctatccacagtcatgtggtattttttttttctttattatactttaagttcttggatacatgtgcaggttggttacataggtatacatgtgccacagtggtttgctgaacccatcaacccatcatctacattaggtatttctcctaatgttatccctccccttgcccccaaccccagaa

SEQ ID NO: 257168 - DNA, 704 bp, Homo sapiens
aagatgttaagtctttgtatttatctattgctgtatataacaaaccaccctaaaatttaggtgtttacatggcaaacgttgcatatttcatgtattggttgatcaggaactgggagctgatttgactgggtgattttggctcatgaggttacaacatgttgactggggctgcagtcatctgaggacttgatgagggttggatgatattctttccgagcttattcatatggcttttggcctcagttccttgccacacaggtctctccttagctggctgcttgagtgttgattttcaactcaagctggctgcttgagttatgattttcctcagagtgaatgatttaacagtagccagggataagcccccatttatgacctagtcttagaagttgcacatagtctcatcggctttattatatttggtagaagtgagtcattaagtgtagtccacacttaagaggaggagacttccacttcttgaaaaggagagaactattggggaatttgtaggcatattttgaaatcaccggtcttacaacctaaaatcaagaggagactccttgtgatgattagcctgtggccaaactcagagtggagtcttggcagaacaggctatgggtaaaagaggatttaggctgggtattagccccctaaaatgggatgtaaaatagcatgaagaatctatcagaaatttaggagatgat

SEQ ID NO: 257169 - DNA, 404 bp, Homo sapiens
gctttcagctgctagtcaggagaaaggcagaagatcatgtgagaaagaattttctgggccagttccagaaatggtttacacagtccactagacaaaagcgagtccaacagccacatctaactgcaaaggaagctgggaaatgtagtctaattttgtgcccaggaagaaaatgagaactggtaaatatagactgtctgggggtagattaaaagaatgcaaatattagtacaaatagattaaagactgcagaaatatggcacacgatttatgcaacttaattccaacatagatcagtatttataatagaaaacttattttaaagaattttatactatataaataataaaaaagaattttatactatataaataataaaattaatgtaataatgcaacagtgtgttc

SEQ ID NO: 257170 - DNA, 692 bp, Homo sapiens
ttgtactcatttggtaattttgatatttaagactattccttggacagaaaagtatatgactctctaaatgtcaggcaagtccataccactatgatgatattctcaaagatgagttatgttccatgcaagtatattcactaaacgtgtacggtaccaaatactctgactccaagtaataaaaaaaaatagcttttgggtcttttccatgcctttagacatgacgaacatagactatttaattgtataaagattttcctggcatatcttccttttggaaaaaaaaaaaaagtcctgaaagtccttctgttttatgaaatattctagtctctgttctgcattatattattttacatagaacttacagtcttaaaaaagaatgttcatttgttaaaaagctcccaaattgactaatattattgctattatagtttgtttttacatagtgtttaatagaacatttgttgtgattaagcaagattgcttctttgtcttcttttctcttttcttccaaatagttcaacgccattataactttcctgtaacagagatgggaatgttttccttcactgaatccccatctcatgaatctacagtcttgaaacccttattttaacagaacagtcatctgactcggtttggctgtctcataccaagatctcagggcagcaacagagtaacccttgctggtacct

SEQ ID NO: 257171 - DNA, 455 bp, Homo sapiens
aagtaatatagagaacagctgtaattgagacgtacaggttgagaaaattacatgaaaaaaacatgaccaggcaatgacaatctcttgaccggtgttaacaaaacaaaacccaaacaaaaataacaatcaaagagaaagagtgaagagcttctacaacatgtagtagttgtcctctttagctttcttggaaacacttttgtccatatgtgtttttgtgagccatgtttacaaaaattacatgagtagaaagttaaaagtattattagatctttaattactctattactcttgtttttgcactgtaaaaagttttctaaatagtttgaagtttttttacttaatctttactctcctctacaaccaaattcctcctgcttttgtgtaagaatgatagttggtgtagaatacgagacctgacaaaactttctaagtcaggagtcacaaaatgttgaagc

SEQ ID NO: 257172 - DNA, 348 bp, Homo sapiens
  misc_feature (1)..(1): n is a, c, g, or t
  misc_feature (256)..(257): n is a, c, g, or t
  misc_feature (293)..(293): n is a, c, g, or t
  misc_feature (342)..(342): n is a, c, g, or t
ntctgtccccatctctcaatctcatgctgagtctctctgtctccaactgcctgtcactgtctttgtgtctctgtgactctcatttctttttttctgtctcctgctgtctctgtgtgggattccttgtctctctgcccctgccctccctctcctatctgaaccctggtctctgtgtcccttagggcttatcacaccgttctccccagagtcaccgggaggagagccgggactggacacaagccagggctgggacaanngcagtgcctagtctgtggccctggggagcatgcctncctgtgatcttcctctccttgggatttggcctggatacagtagaggtgngcccca

SEQ ID NO: 257173 - DNA, 536 bp, Homo sapiens
caaggacattaatttctttcatgagggctccttcctcatgatctaatcaccttccagagatcctaccttttaataatattacactagggattagttgtcagcatatgaattttggaaaaatataaacattcactccatagcaactagtaaataaagatttatttattgttggcagttgctttttttacttttttttaaacccgagttatctttctctgagtttagctttattatatatttgttaaatgtattttaaaaatgttttcctaagatagtttgaattgaaggtacactctttggatttcttgcatatccttaaatatttttcactccgataggtgataaatttctagactacataatggattcttgagttgaagttcactcatttaacaagtctgactgtgcttatctaatgttttcccatttttcaaatgctttcccatttttcaggagcattcaatcaacctgtcatttaacaaatatttattgaccttataatttcaaaataaatgtgtattttaattatttattta

SEQ ID NO: 257174 - DNA, 191 bp, Homo sapiens
gcatgataaattttaattataggtaagcagacctggaccctaatttatgctaattaattttaagttcctagggtctttaaaattgtttttttaattaaaaatattttgtagagacagggtctttctatgttgcccaggctaggctagtcttgaactcctgggctgaagcagtcctcctgccgttggcctct

SEQ ID NO: 257175 - DNA, 374 bp, Homo sapiens
atatttacttcaagagcagaaatttatgggataaagaagtatattgcatccagaacacatacagacactggatttccttttaaatggtcagtattgccggtgcagtggctcatgcctgttatctcagtactttgggaggttgaagcatgcagattgcttgagcctgggagttcaagaacagcctaggcaacatggcaaaaccccatctctacaaaaaatagaaaaattacctgagtttggtggcatgcaattgtggtcccagttattgagggtgctgaggcaggaggattgcttgagcctgggagggcaaggctgcagttagcggtttggtgccactgtactccagcctgggcaacagagcatgacactatctc

SEQ ID NO: 257176 - DNA, 462 bp, Homo sapiens
tctgagtcaaacggactcttcctgttgtactgcgaggttctgcaaaccttgaagggcaaacacagtgagggtctctgacttgctgtgtggacagcccactctctgacagcccagatcatctgaagctatccctgggctgggagctggaagccattcttgtgaaccactccttataccttgagcgaagcctctttgggtcccagaagtctgaagctccagctgcctggcaagactgagtctagatgatttcttgggtaccagtagtttggcatttaaaaatactggattaactgcagtgtaaacttagattgcatttcagattgtaaacaataacccccgtgcttcatgtgatgttaaatcagaaatgagctattagccaagctagtcctcttatgaatgagcccctaaccctgatccagggatcgttgaatgaaaatcatcaaaatgatttatcttcacttt

SEQ ID NO: 257177 - DNA, 224 bp, Homo sapiens
gtcccagtcattttatgctaaggaattaggttgaatatgtgcagagcacctcagctcaggcaagccaataagctttagggtccctttagcctttaataacaagataatcacatagcccttccaatatatatgactgggagtccatgacgagcttccatctacaaatgcagttgtgtgtcatcaaagctggtttttccttatttaataaacaatgttgacagtga

SEQ ID NO: 257178 - DNA, 635 bp, Homo sapiens
gttttccaaagaatcagctccaggacttatcaattaattatataatttgttgaatgacaatggttttgtaaaatattttctgccttctttagatttgtttcctttttggattgtgggcttagttcattttttttgtttcctttttaatactaagagaattaaaatgtaaacttacctatctctagagttttgattatatattttaaaattttacacatttaaaaatactttgtttattggcttgttttaatttttaaatcaaaggttatttaggcatgtgtattattttctatataatggtttctctcctttaaatattatttatctgaaataatttttgcttcatatatttgatatgctattcaggaaaggtttattattatgtatgcattttaaattctatctttattgatataaattttcagtccctatactgttcagtattctacctgaaattccactttgtcagaaataaatattgctacactttcctatttttaaatccagttaaaaatttgtttaacaaatctttgttcatttaaaaaaagttttcctggtcattttattttcaaaatatctcttgaggacaaaatatatttgatttaaaaaattcaatctgatcatcttttaatgtt

SEQ ID NO: 257179 - DNA, 564 bp, Homo sapiens
caaacatctcaaattgaacatatccggaaaaatacacttctgaacttcgtagcattcagaataaaactcaaacctccagatggccggcagggcctccagtgatgggaatcctgtctcacctcacttggtgccactctcccctttactcattttcctggcctttccccggccccacttacccagaaatcttttactgtgcatctcctatgtgccaggcacctgataggtgctgggaatatagcagtggatgagaaagaaaaaagacccagtcctcatggagctgacttcctagtgacaggagcagcggataaagcaaatcactgaaggcagctggaaattactttccggttaagaggacaggctccttcccctcctcacatggctaccttcagatcacttgggtctcagcttaaacaccacctattgacagaggcctcgcatgttacctcattctttagccctactttgcatccttaaaaagcactcatcaaaatttgcaattatcttgtcgggtttttgttctttggtcttgattagtttcagtaaaaacttacataatgaaaa

SEQ ID NO: 257180 - DNA, 417 bp, Homo sapiens
gtgcttcgacagcacaaaccaatttcttgtgtgtgaatagcgaccgtgttatccgcgaccaagacatcgtatgtacaaacggggctgaggaattcccatttagtaattttacatcttcatatagtacattgtaatctgagtcacagggacttagacgtcatctagttcaagctcttccatttttcacgtgagaaaactgaagaatatgtagtggcataacttggagacacatctaagctctgtgagaaatgataaaattgaactcactctatttcaggaggactttcaagtagaggtactagtggaatatcctttacgttgtctggtgttggttgcccaggttgttgctgagatgtggcgaagaaatggactgtctcttattagccaggtacagcaaagtctattattcatatttat

SEQ ID NO: 257181 - DNA, 3458 bp, Homo sapiens
  misc_feature (411)..(411): n is a, c, g, or t
ccggccacaggtttccgcttgcctctggccgggggtcggcaactgcaggcgtcagtttccctcaagatggcggacgaggaggctggaggtactgagaggatggaaatcagcgcggagttaccccagacccctcagcgtctggcatctggattgtgcaattgatccaacatgtgtactctgtatggactgcttccaggacagtgttcataaaaatcatcgttacaagatgcatacttctactggaggagggttctgtgactgtggagacacagaggcatggaaaactggccctttttgtgtaaatcatgaacctggaagagcaggtactataaaagagaattcacgctgtccgttgaatgaagaggtaattgtccaagccaggaaaatatttccttcagtgataaaatatgncgtagaaatgactatatgggaagaggaaaaagaactgcctcctgaactccagataagggagaaaaatgaaagatactattgtgtccttttcaatgatgaacaccattcatatgaccacgtcatatacagcctacaaagagctcttgactgtgagctcgcagaggcccagttgcataccactgccattgacaaagagggtcgtcgggctgttaaagcgggagcttatgctgcttgccaggaagcaaaggaagatataaagagtcattcagaaaatgtctctcaacatccacttcatgtagaagtattacactcagagattatggctcatcagaaatttgctttgcgtcttggttcctggatgaacaaaattatgagctattcaagtgactttaggcagatcttttgccaagcatgccttagagaagaacctgactcggagaatccctgtctcataagcaggttaatgctttgggatgcaaagctttataaaggtgcccgtaagatccttcatgaattgatcttcagcagtttttttatggagatggaatacaaaaaactctttgctatggaatttgtgaagtattataaacaactgcagaaagaatatatcagtgatgatcatgacagaagtatctctataactgcactttcagttcagatgtttactgttcctactctggctcgacatcttattgaagagcagaatgttatctctgtcattactgaaactctgctagaagttttacctgagtacttggacaggaacaataaattcaacttccagggttatagccaggacaaattgggaagagtatatgcagtaatatgtgacctaaagtatatcctgatcagcaaacccacaatatggacagaaagattaagaatgcagttccttgaaggttttcgatcttttttgaagattcttacctgtatgcagggaatggaagaaatccgaagacaggttgggcaacacattgaagtggatcctgattgggaggctgccattgctatacagatgcaattgaagaatattttactcatgttccaagagtggtgtgcttgtgatgaagaactcttacttgtggcttataaagaatgtcacaaagctgtgatgaggtgcagtaccagtttcatatctagtagcaagacagtagtacaatcgtgtggacatagtttggaaacaaagtcctacagagtatctgaggatcttgtaagcatacatctgccactctctaggacccttgctggtcttcatgtacgtttaagcaggctgggtgctgtttcaagactgcatgaatttgtgtcttttgaggactttcaagtagaggtactagtggaatatcctttacgttgtctggtgttggttgcccaggttgttgctgagatgtggcgaagaaatggactgtctcttattagccaggtgttttattaccaagatgttaagtgcagagaagaaatgtatgataaagatatcatcatgcttcagattggtgcatctttaatggatcccaataagttcttgttactggtacttcagaggtatgaacttgccgaggcttttaacaagaccatatctacaaaagaccaggatttgattaaacaatataatacactaatagaagaaatgcttcaggtcctcatctatattgtgggtgagcgttatgtacctggagtgggaaatgtgaccaaagaagaggtcacaatgagagaaatcattcacttgctttgcattgaacccatgccacacagtgccattgccaaaaatttacctgagaatgaaaataatgaaactggcttagagaatgtcataaacaaagtggccacatttaagaaaccaggtgtatcaggccatggagtttatgaactaaaagatgaatcactgaaagacttcaatatgtacttttatcattactccaaaacccagcatagcaaggctgaacatatgcagaagaaaaggagaaaacaagaaaacaaagatgaagcattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcagatgtttgacacagtgaagcgattaagagaaaaatcttgtttaattgtagcaaccacatcaggatcggaatctattaagaatgatgagattactcatgataaagaaaaagcagaacgaaaaagaaaagctgaagctgctaggctacatcgccagaagatcatggctcagatgtctgccttacagaaaaacttcattgaaactcataaactcatgtatgacaatacatcagaaatgcctgggaaagaagattccattatggaggaagagagcaccccagcagtcagtgactactctagaattgctttgggtcctaaacggggtccatctgttactgaaaaggaggtgctgacgtgcatcctttgccaagaagaacaggaggtgaaaatagaaaataatgccatggtattatcggcctgtgtccagaaatctactgccttaacccagcacaggggaaaacccatagaactctcaggagaagccctagacccacttttcatggatccagacttggcatatggaacttatacaggaagctgtggtcatgtaatgcacgcagtgtgctggcagaactcctccggaggctgaggcaggagaatcgcttgaacccaggaggcagaggttccagtgagccaagattgcgccattgcactccagcttgggagacaagagcgaaacatcgtctcaaaaaaattaataaacacaacaaata

SEQ ID NO: 257182 - DNA, 2474 bp, Homo sapiens
ccggccacaggtttccgcttgcctctggccgggggtcggcaactgcaggcgtcagtttccctcaagatggcggacgaggaggctggaggtactgagaggatggaaatcagcgcggagttaccccagacccctcagcgtctggcatctggattgtgcaattgatccaacatgtgtactctgtatggactgcttccaggacagtgttcataaaaatcatcgttacaagatgcatacttctactggaggagggttctgtgactgtggagacacagaggcatggaaaactggccctttttgtgtaaatcatgaacctggaagagcaggtactataaaagagaattcacgctgtccgttgaatgaagagggaatggaagaaatccgaagacaggttgggcaacacattgaagtggatcctgattgggaggctgccattgctatacagatgcaattgaagaatattttactcatgttccaagagtggtgtgcttgtgatgaagaactcttacttgtggcttataaagaatgtcacaaagctgtgatgaggtgcagtaccagtttcatatctagtagcaagacagtagtacaatcgtgtggacatagtttggaaacaaagtcctacagagtatctgaggatcttgtaagcatacatctgccactctctaggacccttgctggtcttcatgtacgtttaagcaggctgggtgctgtttcaagactgcatgaatttgtgtcttttgaggactttcaagtagaggtactagtggaatatcctttacgttgtctggtgttggttgcccaggttgttgctgagatgtggcgaagaaatggactgtctcttattagccaggtgttttattaccaagatgttaagtgcagagaagaaatgtatgataaagatatcatcatgcttcagattggtgcatctttaatggatcccaataagttcttgttactggtacttcagaggtatgaacttgccgaggcttttaacaagaccatatctacaaaagaccaggatttgattaaacaatataatacactaatagaagaaatgcttcaggtcctcatctatattgtgggtgagcgttatgtacctggagtgggaaatgtgaccaaagaagaggtcacaatgagagaaatcattcacttgctttgcattgaacccatgccacacagtgccattgccaaaaatttacctgagaatgaaaataatgaaactggcttagagaatgtcataaacaaagtggccacatttaagaaaccaggtgtatcaggccatggagtttatgaactaaaagatgaatcactgaaagacttcaatatgtacttttatcattactccaaaacccagcatagcaaggctgaacatatgcagaagaaaaggagaaaacaagaaaacaaagatgaagcattgccgccaccaccacctcctgaattctgccctgctttcagcaaagtgattaaccttctcaactgtgatatcatgatgtacattctcaggaccgtatttgagcgggcaatagacacagattctaacttgtggaccgaagggatgctccaaatggcttttcatattctggcattgggtttactagaagagaagcaacagcttcaaaaagctcctgaagaagaagtaacatttgacttttatcataaggcttcaagattgggaagttcagccatgaatatacaaatgcttttggaaaaactcaaaggaattccccagttagaaggccagaaggacatgataacgtggatacttcagatgtttgacacagtgaagcgattaagagaaaaatcttgtttaattgtagcaaccacatcaggatcggaatctattaagaatgatgagattactcatgataaagaaaaagcagaacgaaaaagaaaagctgaagctgctaggctacatcgccagaagatcatggctcagatgtctgccttacagaaaaacttcattgaaactcataaactcatgtatgacaatacatcagaaatgcctgggaaagaagattccattatggaggaagagagcaccccagcagtcagtgactactctagaattgctttgggtcctaaacggggtccatctgttactgaaaaggaggtgctgacgtgcatcctttgccaagaagaacaggaggtgaaaatagaaaataatgccatggtattatcggcctgtgtccagaaatctactgccttaacccagcacaggggaaaacccatagaactctcaggagaagccctagacccacttttcatggatccagacttggcatatggaacttatacaggaagctgtggtcatgtaatgcacgcagtgtgctggcagaactcctccggaggctgaggcaggagaatcgcttgaacccaggaggcagaggttccagtgagccaagattgcgccattgcactccagcttgggagacaagagcgaaacatcgtctcaaaaaaattaataaacacaacaaata

SEQ ID NO: 257183 - DNA, 740 bp, Homo sapiens
tggttatcaatgtaaataacattaactagaaattgtaatttgtacataattatgaagacataattgaccctccatatctgtgggttccatatctagggattcatcccatcgcagtttgaaaatattcagggggaaaaaggaaaaaggatggttgtcactgtactgaacatgtacagacttttttttcttgtcattattccctaaacaatattatctaataactatttacatagcatttacattgtattaggcattataagtaatctagagatgatttaaagcatacagaagcatgtgtatagattttatgcaaatactacaccattttacataagggaattgagcattagtggactttgatgtccacaggggtcctgaaaccaattccctgaggataccaagagatgactttatgtatttatgatgtgtgattttgtgttttaaaaaaggattgggaagttcagccatgaatatacaaatgcttttggaaaaactcaaaggaattccccagttagaaggccagaaggacatgataacgtggatacttcaggtaaactaaaaaagtaaagtgatcatatcttggtttaaatatttaagaattctctgcttgcctccagtgttaaaccactgtaccattgtagacatttactactggttttcataatcacttatttttcatgttaataattctattttcctatattttattgtagttttaaaaataaactaagatttattca

SEQ ID NO: 257184 - DNA, 556 bp, Homo sapiens
tattatgactactttagatacttcgtatgagcagaatcatatagtatttgtccctctgtgactggctgggttctatttcttttcaatgtcattaatacctgttctgtcttagagagagccatgaggatctggggaaacaagctgtgagaaaagtctttgtaagctataagggataaacagttgttacgtgatatcatcgtaattagctactcagaaaggcaggtaggaacattcataagagagtatatcactaatggggagacttcatggttctgcctcctttctgtcatcagtaacaccaacttggccacaaggggttaagctaaactgatctaaatatatagcaaccctcttgagctcaacttgaattcattcctggacgatgttgtaatgaattcagcaaagtgattattttaacttaacattaccttccttatccatttatttgtatacaatcttgactagtatgtttttctcggcttttttatagaattcacgctgtccgttgaatgaagaggtaattgtccaagccaggaaaatatttccttcagtgata

SEQ ID NO: 257185 - DNA, 248 bp, Homo sapiens
tgtcatttcttaatacccagattactcatgataaagaaaaagcagaacgaaaaagaaaagctgaagctgctaggctacatcgccagaagatcatggctcagatgtctgccttacagaaaaacttcattgaaactcataaactcatgtatgacaatacatcagaaatgcctgggaaagaagattccattatggaggaagagaggtaaaataaagcaaaccaaaaattaccaactcaatttttttttttt

SEQ ID NO: 257186 - DNA, 396 bp, Homo sapiens
aggcatgagccaccacattactgatgataaacatttatctagataacctgtctaatgggcttggagtatccagataggtgttgtctagttactgaggagtagggaattttttcttttagaaaataacttcttagtagttgctattcagtgaaactaaggactgtgtttaacattcaataacaaacatttattaaaaatgacatactgactaaccaaatgaatgaataaattaagtccataccacaatgagttaatgctaaagaaaatattcttgaaatattccgcaggctcgacatcttattgaagagcagaatgttatctctgtcattactgaaactctgctagaagttttacctgagtacttggacaggaacaataaattcaacttccagggtt

SEQ ID NO: 257187 - DNA, 481 bp, Homo sapiens
ccattcagctaccaagagctacgcctgataaattagaggggaaaaaaaaaatctccagtcccttcacgtcgtgacgcttgcttccgggaagcgggccggaagccactcctcgagtctgcgtcaaacccgacttcaggggccgtcgtaaaagtgtcgtccctgtctctccgaccggccacaggtttccgcttgcctctggccgggggtcggcaactgcaggcgtcagtttccctcaagatggcggacgaggaggctggaggtactgagaggatggaaatcagcgcggagttaccccagacccctcagcgtctggcatctgtaagtccctataggcaagtctcttttgtcctccccccggtccctccctactgcgcttaggaggatgtggggcttcaccccttatggcggctctggggagggggagttatctggattgatctggaaggaagccaccgaataaaaagttagtcgcaacccacat

SEQ ID NO: 257188 - DNA, 277 bp, Homo sapiens
aaacaacatttaattggggctagctcacaggttcagaggttcagtccattatcatcaaggtgggagcatggcagcatccaggctgtcatggtgcaggcagagctgagagttctatgtcttcatccaaaggctattagtggaagactgacttccaggcaactagggtgaggatcttatacccacacccacagtgacacaccctttccaaccaggttactcctattccaacaaggccacacctccagatggtgccactccctggtccaaggatatacaa

SEQ ID NO: 257189 - DNA, 861 bp, Homo sapiens
agtctctaacgtcactatattaagagatagggcctttaagaagtgatgggggcatgggaactctgccctcatgaatggattaatctattcatggattaatggattaatgcattaatggattggtggtttatcatcgcaaggaaactggcagttttgtaagaagaggaagggagacagtggcagggaaactggcggctttgtagcaagaggaagtgagacttgagtcctctcaccacaggttgccctgcaccaaccaccacaggactctgtagagagtcctggctagcaagaggatcttcaccagatgtggcctcttgacctgagacttctcagcctccataactgttaagtttcctggagaattctgaaggatatgcccccttcctctcctacagctcagagttgttctgtgcacttggatcagcctccacaacttccccccgggacagggcacccatcaccatctcctacctggacagcagcaaacactgcccccgtgacttcctggtgccatccttggctccattacgtccattctccagtggctggcagagtgagcttgaagaacgtgtgacatgcccttcagaatgttctacttcctgttccagaaggacagcccctcatgccttcccgcgggccacacgccacctcttcctcagtgccccagcctggcatcctcttcctgcattcagccttcttttccgaggtagcgctgataccagttgtcactaaatacaacatgcataactgttcagcttctctctagtagaatagatcataagcctcatgagaccccagagcctctgtcttcttcaataccccccagcacccaccccagggcagggccacaaagagttgtgg

SEQ ID NO: 257190 - DNA, 973 bp, Homo sapiens
agtctctaacgtcactatattaagagatagggcctttaagaagtgatgggggcatgggaactctgccctcatgaatggattaatctattcatggattaatggattaatgcattaatggattggtggtttatcatcgcaaggaaactggcagttttgtaagaagaggaagggagacagtggcagggaaactggcggctttgtagcaagaggaagtgagacttgagtcctctcaccacaggttgccctgcaccaaccaccacaggactctgtagagagtcctggctagcaagaggatcttcaccagatgtggcctcttgacctgagacttctcagcctccataactgttaagtttcctggagaattctgaaggatatgcccccttcctctcctacagctcagagttgttctgtgcacttggatcagcctccacaacttccccccgggacagggcacccatcaccatctcctacctggacagcagcaaacactgcccccgtgacttcctggtgccatccttggctccattacgtccattctccagtggctggcagagtgagcttgaagaacgtgtgacatgcccttcagaatgttctacttcctgttccagaaggacagcccctcatgccttcccgcgggccacacgccacctcttcctcagtgccccagcctggcatcctcttcctgcattcagccttcttttccgagggtcaacatcttgtgagtatggggaccaggcaacgtgagctccagctctaactctgtcccaatcagctgtgtgaccttgggcaagatgcttaacttctctgggcctcagttttctcatctgtgaaatgaagtgtcatcttgctggagggcagaaggattccctggaacctgggggccagcaggacagaggaaacagaaagtacatgaccgatgatgtctttcgaccacagaaagggctggaagaagcaggggacctactgtttgaat

SEQ ID NO: 257191 - DNA, 638 bp, Homo sapiens
cagtcccctggggcagctagctgtgctgtggagatgcacacagcttgaactgactcgatattctttttttttcatcaggtgtcatcttgctggagggcagaaggattccctggaacctgggggccagcaggacagaggaaacagaaagtacatgaccgatgatgtctttcgaccacagaaagggctggaagaagcaggggacctactgtttgaataaacccagtggaaaaacagaagccccatttcatacttgactcagctcttcaagtttaaatcttgaatctcctcaactacacggaacagtgtctctcccaagtcatctgacacccactctgttctctggatcattccttcctagagaacgttgctcttggagggctgtgatctgctctcacccacttgcctttctgacccactgagtgcatctcaacagtcacttggggtgatccgatctgaccaggaagggttgggtggctcgtggagcttgggaagcactctcactgtggcggtccccattggtggtcatggggttgccacagtgagctacgtttctaccctcatctctctatatgttaccgtggaatctctgactgaggacccatgggctcacccaatgtgataaagtcctgaagctcagc

SEQ ID NO: 257192 - DNA, 687 bp, Homo sapiens
aggcaagggtcatgaccagggtccagcctcagtaatgcactcacccccaccctggggcactgctgcaggcccaccatcaagcagcctacatttgctcccctcctgccctctcttcccaggaagcccctcacctgtcacttcctgaagaatatggaagccaaggaggtcttcttcaggcattcctctccacccatgcacttcctccctccttgcaagcttcaaaggaattgatttccagagagacccttcccagttgccccacctttccgtcagcctcttccaggaactgtcctctgacatctctctgtctaggtctccttgtcactcttgtgcacaccaagactgttctccccctgtcagccactgagtccactcagatatcttctgcttcccaaaattaaaattacaaaccaaaacagagacagcttccatgaccttacacattgtagacacttggctacagcagtgaatgacataaacaaagtccctttcctcatgtagccctcatgctagtagagtgaaacagataataaataaactagtcaaatgttcagcatgtgagttggtgatgacagcacggtgcttcatgcctgtaatcctagtgctttgggaggccgagatgtgaggatggctaaggtcaggaatttgagaccagtctgggtaacatagtgagaccctgtatctaca

SEQ ID NO: 257193 - DNA, 647 bp, Homo sapiens
aaagaacaccctaacaatgaggcattattaaaggcccacataaaaaacctaatagacaccagctgccctctcttcccaggaagcccctcacctgtcacttcctgaagaatatggaagccaaggaggtcttcttcaggcattcctctccacccatgcacttcctccctccttgcaagcttcaaaggaattgatttccagagagacccttcccagttgccccacctttccgtcagcctcttccaggaactgtcctctgacatctctctgtctaggtctccttgtcactcttgtgcacaccaagactgttctccccctgtcagccactgagtccactcagatatcttctgcttcccaaaattaaaattacaaaccaaaacagagacagcttccatgaccttacacattgtagacacttggctacagcagtgaatgacataaacaaagtccctttcctcatgtagccctcatgctagtagagtgaaacagataataaataaactagtcaaatgttcagcatgtgagttggtgatgacagcacggtgcttcatgcctgtaatcctagtgctttgggaggccgagatgtgaggatggctaaggtcaggaatttgagaccagtctgggtaacatagtgagaccctgtatctaca

SEQ ID NO: 257194 - DNA, 731 bp, Homo sapiens
ctttaaaatccattcctgaccactgcttaccacttcctggtctggggaatggagttgagggggccaccctcagtcacctgaatttgactctccccacagaaacagcagaagaaacaagtggaacatcagctggaagaagtaacgtgatttctttgctcacaacatgactgctgggtttggggggcactcagatgtagaggcgccaatctcgtctcacccactcccagcctggggaagaaggctcacccctcagattccaccccatccccacagggtccctgataacctggtcccatgggtgggcctgtcctggggcattggtggcattctgggggcatgtctcttgctatgccatgtctgcctccctgtggtaagagccctgtcttcctcttcctataggaaaagaaagcaaataaggaaatacacaaagcacaaacggagcagttagaggtgagtggtgggtggggagttttctcctgtcctccggagaatgtttctttccttctctttcagcacttgcttggcttttctcccaaacattcaattccagacaatcaacatcctcacgttggaaaaggcagacttgaagaccaccctttaccatactaaacgtgctgcccgacacttcgaaggtgggaatctgggcatcccgtcatccttcaacctggcactttgacaggtctttagggggagtcttttggcccccatctcaacctctctcattacagaag

SEQ ID NO: 257195 - DNA, 435 bp, Homo sapiens
ccttcttaggagcaagtaaaaacgatggcgtaacacgaccacatttacacaactgttgcacggcggtagtaaaagaatcattaacacaaaaatcaaacgttttcaaataaactataaatcgccgaggctgggaaaggcctaggtctggggccagctggacccaacgcagggcactgggggaagggggtgtgtggacaggtggctcgggatcatcggccccacaggtcccaggggcaagactccgcgggttcccggccctcaatccgaccccgcagaccgccccctccccaagcccggacccgaggcctcgtccgccggcccctctgacccagggccccggacagaagcgcaatgcagcctgcgccccacctccttccctcgccccgccacctcgatcccggcccggagccgccgacacctctcacgcagcagggg

SEQ ID NO: 257196 - DNA, 430 bp, Homo sapiens
atcacactcatacattgcatttctgtgtgattatcatgtaatcaatcaatgaaaaatttgtccttggataaaatagcatgttagctttgttaggttaattttagtttttatttatttacaaccctaaactctatcttatatagccttgcccttcctggatagatagtgattgactgtatttatttggccacaactaaagcttactaggtagtgttggtctgacttatcatgtcggtgctttgctggggaacttcccagagagagttcacagccctgagagtgagtccaaaggaggaggcttcccctaccttctccacaacaagaacaaacatgcctatgtgaaaatagagtaggaagggcacctcatcccagcagaatgtggaggggacatatttctgggtgattctggtcaatgcttctaccattgtag

SEQ ID NO: 257197 - DNA, 544 bp, Homo sapiens
tgagttggcatcaagcctgtatccataatagctagcctgatgactagagctatggaagccagcttggtgttgcagcaggcctgaaacctggtgctctgagggttgatctagcactggtctggaatctggggccactggggctggcctggcagtggagaaaacacagagaccaagtcctctgtgcagactaaaagccagaggctgtgaaattctgcctggcagtaaatgggttgcaggctttgctcatgggtgttatcctggaatctgtggctgtggggggcctgtctagtgccttattttactgcaataagcctggtgttagagtctgaggcaatgtctggtgctcactaccctctactcgccccaagaggagggtatctctctccagcctgtactgcctgattttggaagaagagtgatggagatcctgtaagactttccctcctaccttctttgatacattttttcttatttttgtgctacatgtaggtgctataatttccttagttcttgtgaaggtattttcttgaatggatagttgtgc

SEQ ID NO: 257198 - DNA, 100 bp, Homo sapiens
atctgcttcctgtgatattgctaaatattaataattttaatgtaaaactgtaaaacttgtttatttcccaaattgcttgagcaaaataattatgatatag

SEQ ID NO: 257199 - DNA, 300 bp, Homo sapiens
gagtggataattccagtgtgctctggggtgtaggggctgtccttagttgtctggctgctggtgctggggtgatcaatacaggtggaagggctgggcacagtggctcacacctgtaatcccagcactttgggaggctgaggcgggtggatcaccagaggtcaggagttcgagaccggcctggccaacatggtgaaaccctgtctctactaaaaatacaaaaattagccgggcatggtggtgtgtgcctgtaatcccagctactccagaggctgaggtaggagaattgcatgaacccgggag

SEQ ID NO: 257200 - DNA, 680 bp, Homo sapiens
tagagattattttaacataatgtaggagagatatagttttaaatccaaattgaggaagtgttatattatttcaacacttttggaattagtggtgtctcacaattaggaactgttctctgatttcagtaatctctaatatcatacatagcaacatctctgtgggtttcctctgatctctccaaatggggttctgttgaatcaggaatcagcctggagagtggtggctagaatgatctccagatctattgttatatactgggcaaagtcccttaaaccatggttaaatgaggcccttttagaccagatactcatattgagtccatcagactatgattaattacagactcatctatttgtgaagatttcattcagttttcttttaagcaaagttttgacataaacaagtactttaaatagggacacaagtataatagaaaaacatctgaacatctgaccatttaaatttacatgaagagggggtgatagatctattgttttttcctgcccttctgctgaatcaagaaatttgctttgaatatctatattcttataacactttctggattgagaaaagtgctcgtattagcttacatataggttataagtccagaattcttgaaaactttgaatgcaaaggagtattaaaatacattaccacagtttctctgcattggataaaa

SEQ ID NO: 257201 - DNA, 379 bp, Homo sapiens
ctgtgggaggggtaggagtgacactgtctgccttatcccatttggaagtggatctggctccgtgtctctgcaggctcttggtcttctcctgacttctggctctagggggcgctcatagaggggcctagacacttcccatgatagtgtctggctctgcgaggcccacctctgttctgggacaggatccgagatttgaagccttcaagattgggacctaggccatatatggccagaatgacaggcagacaaagctggagtgaggtcacgcagaagcatggaggggggtctcggcaccatgccctagtccatcctccggcgagtgctaagagctccatcagggtaagcagctatgagattgcccagggccaagcaaatatag

SEQ ID NO: 257202 - DNA, 445 bp, Homo sapiens
tgtgctgctcatgtggagatggttagcggcacatggcattttaagcagatattggtaacacttgagctcactcaccacaatagcaacaggaggtagctacaaaattattacagtagtgcagtacatactacagttaattttatgcagttatgatttaatactacatctttatgtttgtttacatttctctccactaaatggtgccataaagatataagaatatcaatactgaaaaaaggctacttaaataaattcactatcaacaaggtatttcataaattccaattaaagttggaataagactttatcttaaaaaaactagttacaggccgggcgcggtggctcacgcttgtaatcccagcactttgggaggccgaggcgggtggatcacgaggtcaggagatcgagaccatcctggctaacacggtgaaaccccgtctctact

SEQ ID NO: 257203 - DNA, 1044 bp, Homo sapiens
accatggagtgcaggtgggttggagcacagatgaagccccggtccaacctgggcattcctgcagccatgtgcagtgacccttgtgtatgtgagtacctgtcatgtgcccacgtatcctggtggcacaaaaggtacttcatgtagattgtcaggaccaagacacagaacgttcttggggcacaccacaataattcccccactagcattcaccttaagatgaaagaatttttttctagttgatgtggattccccagatttatctcatttcatgatgtcttcggaattgcatgttgtgccaccatcacacttcacactctcagtaaggagctctcagttgtctcacctgttattgctcctctttattgtaaacgatgtcctataaagaagatatatgtctacaattgagctttgaaggaggaccatggagccagttccttttaaggggaatgaagtcaagcagtaaatttgctggtcactcttttcatatggaccgcatctcagccagcagttggtctttgatgttgtaacaatggcactgggacctgaggcagaggagcacccccataatactgaaaccagcctgcattcattctaatttggagaacaatctgtgggatagtacgcacatcagggagcccagagagtgaactccagggctgtgggtaatctttcccagtgaaaatcagccatctcttctacaccatgtaccctgcctgctgcattctttactcttttattaaaattgaagtatgatattcctacagaaatacacacatatataactctacaactcaatgagatttcacaaactgaagacacctaggcaaccaatgcctagatcaagaggcaaaacattaccagcaccctagctgccctccttggactcccttttcatcacttccctgacaaaggtaactctcttccaacagcacaggttcctttttcctggttttgaactttacctaaacagaattatccagcatgtactttactgtgcctggtttccttcactcaacattacatttgtgaaattgtgaaaaaaca

SEQ ID NO: 257204 - DNA, 426 bp, Homo sapiens
gcaacaacagccagaaggacccacccacaggagcttaaactggagcagtggcatgaggtggacagcaggacaaggtgaagaaagttccagttttctgactggaggattgaaatggggagctccagcacatttgaaaagtgccaggacatcatggaggaaaaggagctcagaacaccaggacattgtggaggaaaaggagctcagaacaccaggacatcgtggaggaaaaggagctcagaacaccaaatccatgaagctgtttatgaacgtctgggctcacctctgaactatgcatgcatagatctgacttgaaacatatgtacaattttcataagacttaaacaagacctcaaatactgtaccataatattcaaattgtccaacatacaatccaaaattacttaatataaggccaggcacagtagc

SEQ ID NO: 257205 - DNA, 402 bp, Homo sapiens
gtattcagacaggaatttggaagatttttggccaaagaaacgaaatagagttaaaaatctaaaatccagacctttgggtgtttcccagctcagtcttcaggttcttgtcaaatgatcagactcagctgggcgtgttgactcgtgcctgtaatccctgcactttgggaggccgaagtgggcggatcatgaggtcaggagttcaagaccagcctggaacatagtgaaaccccatctctactaaaaatacaaaaaattagctgggcgtggttgtgggtgcctgtaatcctagctactcgggaggctgaggcaggagaatcacttgaaccctggaggtggaggttgcaggcagccgagatcacaccactgcacaccagcccgggtgacagtgtgagatttcatctt

SEQ ID NO: 257206 - DNA, 717 bp, Homo sapiens
gcttttttagattaactcttaagtactccacgcttctgaaacgggcgtaggcacagcgtcagttctgtacagtgcggacgcagcaggacagaatctccctgggcatctttctggagcatcagttttactgcaagattttaagaaacaaatttaattgatttccaagttaagaaattaaaccttgaaaactagactaaaaagtcatctgcacctgacgtaacagactttctgcaggaagaaaactctaaggagagcatattgtccattattataaatagtgaaaatgagaaatcatagcaagtcccttgaaaaccctgccctgccagtcttctaatagggccttggtatggttttatgtgtattttctttttgaagtgtgctcaccttttgaatatacaaatttggggttttgaccaaattttgcaagttttcggctattgtttatttgcttttgtatcacatttaatttttctgtctctccctctccttctcggactcagtcattccacaggtctccaaggcgcttttcattttcttcaaacttgtttcactcttcagattggatgatttctattgctgtcttctgtttctactgtttataaactcaacggtctttttaatttttcatttcattatctctctattccattcttttcatcatttccatttctctgctgaggctccacatgagttaattcattatgaggatgttttcct

SEQ ID NO: 257207 - DNA, 396 bp, Homo sapiens
ccaagagagaaaagagaggttttgtgggtaccttggacttctgttggcatggtgggctgccctcccccaaatgctgctggaacatgggcactgccagcttgtggcttttgtattttgcttttctgtggcctgagacaggtttctattttgggcccatggctgaggtctgtgaagctgcatgctaaaattctgtttctgagcattttctagagagagggtaaaactataatgactctgaaaaatttaaaagccactcatctacgttcaccttggactttctgtttagtgttgattcacacaagatgtaactgattgattataatcagtaactaattgattagttatcccacatttaagattaagattattccaggtcactttggcattttggatgtt

SEQ ID NO: 257208 - DNA, 420 bp, Homo sapiens
ctcccgggtttaagtaattctcctgcctcagcctccctagtagctgtgtgtgtggagagagcacgccactgagagagagtgagcgagagtgagagagtgtgtgtgtgtgaatgtatcacactctatatgtgctgggattacaggcacgagccaccacgcctggcccatgactgttatatttttagtacagacagagtttcaccatgttggccaggctggtctcaaactcctgacctcaagtgattcggccgccttggccatccaaagtgggattacaggcgtgagccactgtgcccagccatagcttatatatatatatatatatatataattttatttttttttgaaacatagtgttgtgctgtctgccctgtcacccagctgagattgcgcctgggcaacagggcgagactccaactc

SEQ ID NO: 257209 - DNA, 387 bp, Homo sapiens
tcttctccatcttgtttttcattcttttttctggctggttcccctagcctttcttctttcctgcctctgatgttgttctctctctcaaagttgagtactgttccagttgtgccagtgtgaatgttcagttgcccaccagtggaacacctgcccagaatgaaccatgggtgagggctggccacattgccaaagggaagcttagagctcatgctggtgctgatttctccatctgctgcctgtggccttgccgtggttccccaggaagccaacatttacactccattgcttctcaagatctttgctaaacctttattcatagaaaacctgaaagtcagtcagcagctggaatagcatttagtcattacagaattgtgcctaaccacattt

SEQ ID NO: 257210 - DNA, 411 bp, Homo sapiens
ctattcaactagtttcatattttaatgcatctaaaagtttctaagaccagaattattctagaagacacaaatagtaactgacaatacattcagttcattgagcatttttttctgagacaagatctcactatgttgtccaggctgggctcaagcattcctcccacctcagcttcccaagtagctcagactataggtgtgtgccaccaggcccagcttaatttttaaaattttatcttagtagagatgaggtctcactgtgttgcccaggctagtctcgaactccagggctcaagtgatcctcctgccttggctgcacaaagtgctgggattacagacatgagccacctctcctggccactgagccaatatttattggctgataacatgtactatgttgagtgccgaagaccc

SEQ ID NO: 257211 - DNA, 261 bp, Homo sapiens
agaaggtttttttttttttcccataaactcttagattttccaatattttacaattgtttccaggagtttctcttctcctctatcaaaagtgaagccaagtggggagtgaacagagaggcccctgaaggagagaaggcaaagaacaaggcttaagtcttgaacagtggagttcaagttatcacagtagtggaccaagctgcacctagctgtaggacccgaggcagatcatcagttgccccatctttaaagagggggtgatgc

SEQ ID NO: 257212 - DNA, 522 bp, Homo sapiens
cctttggatcggagcagaaggaagttgtcccacatcttcctcctcccagggacccctgaggcataccctctggccagggcccccacccaggccctgggcatctgcctcgggggctgtgcccatctcccttctaccacccagctggtgtctgtgccaagaaaggggaagtaccatctttgctgaattcttgacttttgtgctgttaaaaaatcagctttaacagagttttgctcatttaatttcatttccattgcacagctaagcgcctttgttaaattttgtatattgatactttttgttgtcagcagtttattcttttttttttggatataaatccattagggtgagagaagattaaaaagatacattacaattaaaatgttaatgaaatccgtatcacacaacttttgaaaccctttaggcattaatcttgcctgtgtcatgtccattaactttggctattcttattccacactgacccctgctgagagatttgtgctataattggatttttttttaata

SEQ ID NO: 257213 - DNA, 524 bp, Homo sapiens
acatgagacctattcgtctaggaataaactgtcctagccacaaaagatcagacaaaacccaagaccagagagtcattttcttctaaaatgctttatctgaaagattttaaaaagaaaagtggggagaaatgtgaaaggaaaatagaaactcgggactccaattcactaggccaaatggaaaaatttaagctgaaagctgagtcatgcaagcaactgcctttcctttagttcctaagcagatagctacagataaaggtcaaatatctccactctatcaccttatcttgtgtacagcacagatttactgagcataagacgaatacataattcactattcccctatgtggttttatcttgcaacctgtggattcagtaatgtgaccctacacttcctatttcccctccagcctgctttgcccctttaaatattgaagccctcaaaatcatctttggagaaaggcacagatctgtctcctgggtgtgtcttcaatcgtggcacaataaacttctaaactgattgaaat

SEQ ID NO: 257214 - DNA, 449 bp, Homo sapiens
ccggagcgcagggaaggaaggttgggtctctggagtccgcgggggtggggggctccctcccaggtctcgcccttcagcttttctgtttcccacttcagggccacacgtccgtcgttccgaacctccaatcacattggtaaccaacatcatgggttcccagtggccccgttgtggggtcttttcctcctggggtctctgctggggcttctccctctcctcgcttccggccatccccttcgctggggagcagttggctgcttttccgcagccagtgcctttcgcgggtccagttgatcctatgagatgcaccatggaggggtaaatgcagcctgggctcctccagaagccagggtgcccactgctgcgtggagatgctaccaagcgttcaagttgtgcgggttgtggaagaagctggtgagccctggagtcaggcctggaactcagaaccg

SEQ ID NO: 257215 - DNA, 673 bp, Homo sapiens
aaagggccagattgcaaggagagtcccagaactttgtacagggggacagtttaggggtgggtgtccctggactttgtgcgtgtgtgtgtatgtgtgtgtgtagcatcacttgaggcatgctggaactgtggggatcacctagtttttttctagtggagaatggactatttggcccttggcacctagaagcagccaggagggaagtactgaccatttaaaagtggcagatctccgggccccatttctgcagccttcattctgcaactccagccacccacctgtgccaacgtcaagccagttgggattgccttgctcatgtgcctcctcccatctgcttttttcatgtgtgctacagccttagaaataaggactcttagacagctgtctttatgttcccaagaagtatctgtctttaagcaaatctagtctgcaaattttggatttattcaaaagcttaaattagggttttttttaaaaaaaccttgaatttcccaattgatttactgtaggattttttgagagaacaaattccccagagatttaaaactagtcagttcacagaaaatcagcttaactcaacaaatgctaaattgtgtactatgctcagagcactttgtaatgggaaatagaagagcaagacaaggcccttcccctcaagtcgccttgtctggct

SEQ ID NO: 257216 - DNA, 444 bp, Homo sapiens
gactccatctcaaaaaaaagaaaagaaaaagaaaattcatgaatctgtagctatagctatgccagtgtgtgagaaaactttgcaccttttgcaaaatccctttttacgtcgtattgaaaatccagctcttatgtgggcacaggaatgctataagaaaggcatatctatagaatatgatttgagaaaaaatgaagtcattatatgataacataaagcataaggaaggtaaaggatctaaagctggaaaatttaatgccagcaaaggatggtttgatgcttatagaaagaggtttgagtttaaaaatgtcaagatgacaggagaagccagctgttgctgaccaagaggtagcagacgagttcccaggcaccattaagaaaaccattgcagagaaaagatgtctgcctgaacagatttttaatgcagacgaaagtgccttattctgg

SEQ ID NO: 257217 - DNA, 1148 bp, Homo sapiens
aggaccgtcggtagtgatggtggtggatgcatggctggcggagtgcatggtggggagcgtgggtgtgcccagcagagcaggaagcaagctgcccaagaggtgtgcaccatgctcccactcttctacctgcttccagaccaagcacacacaaatctgggccaggctccctttcttcccacgagtgctacagatcagcctccacaaaaccagccactccccaggctcaagctcaagctcagagggacacaagccaaccaaggctacagttagagaccggtcctcagaggcctcgtgtagtgcgacgcccttgtgtggcagtaagaaaacgagggtcctggaaaggccccggacactgcttgtggacaccagtgcttctggcagacccacgcaggggccccgagaagggcgctgctccacgggactcaggtccacacggggagctcttgcctttctccggacccaagatctggcccgcaagcaaaaataccaaagaaaaacatgctagcacaaaaatattaaataacaactttgctaccttttaagtgcaggtttcaccaaataccacctagagactctgctacttttcaaagacatccacaaatagcagcattagtcaaacattaggcaatcaattaggcaaatgcaatctagcaatatggccaaagacaacctaccaaaccaagcagggattaccccagaaacgcaaggctggttaaacacaaagacaaaaacatcaatctaataacaacaacaaaaaagacaagaaatacaaggctccagattagagagaaatgtaactgtccacagaccacgtgattgtgacatataaaataaggatccacaaaacagtgggccgggcgcagtggctcacgcctgtaatcccagcactttgggaggccgaggcgggcggatcacgaggtcaggagatcgagaccatcctagctaacactgtgaaaccccatctctactaaaaatacaaaaaattagctgggtgaggtgtcgggcgcctgtggtcccagctactcgggaggctgaggcaggagaatggcgtgaacccaggaggcggagcttgcagtgaggcgagattgcgccactacactccagcctgggcgacagagcaagactccgtttccaaaaaaaaaaaaaaa

SEQ ID NO: 257218 - DNA, 156 bp, Homo sapiens
ggagggagcaatttacaaagcaaacacctgaaactgatttttaaaaaatatctttgactgggcacggtggctcacgcctgtaatcccagcactttgggaggccgaggtgggtggatcacgaggtcaggagatcgagaccatcctggctaacacggt

SEQ ID NO: 257219 - DNA, 621 bp, Homo sapiens
  misc_feature (464)..(464): n is a, c, g, or t
aggcacaattaggctgggcgaggtggctcatgcctgtaatcctagcactttgggaggacgagatatcggcctccagagattggaatgacttgaggtcaggagttcgaggccagcctggccaatatggtgaaaccacatctctaataaatatacaaaaattagccgggcatggtggcacatgcctgtaatcccagctactcaggaggctgaggctgaggcaagagaaacactggaagaggttgcagtgagctgagattgtgccattgcaccccagcctgggtgacagagcgagactgtctaagggggcaattaaggaaggctagtattaaggggaggggtggcttgctataattttaatttacaaaatatatgtgagtttgtccatttctgtgcattatcttcttttttttttttttttcctaagacagagtcgtgctctgtcgcccaggctggagtgcccgacncgaacttggaaactgcaatcattataggtagtttagcataacatttgagggaaaatcacgaactccagataggctccgaccagaagtgccccataaccaatcggtccacaggaatggccttcattttggtcccgcttgtacacctcgggttgccccc

SEQ ID NO: 257220 - DNA, 451 bp, Homo sapiens
caggaatgggcttacaagcccagttcccaaatggccaaattccacatatttgcagattggcaaagcacacaggggacctcgagatgagctggacccctggtttgcagacctcttcctgctactgcccttgagcaagcccatttcctgtccaagcctcagttttcccaaatgagaaaacaagagggggtttttaggtgaatctttctccttgctagtgttaacagcttaggtcatggattgaaaaacttgttctgtaaagggccatataagcaaatgttttagactttgcaggccacatggccctattgtggtgactcagccctgtctttgtagtgtgaaagtagccctagataatgcataaatgagtgggtatggctgtgttccaaccaactttatttatagatatgaaaacctgaattatatctaattttcacatcgcaaaatatgattc

SEQ ID NO: 257221 - DNA, 484 bp, Homo sapiens
gtgcccactccatgtgctctccgtccatctgatgggctggatgtagatttcaatggggttatgggagatagcagagccacagaaggaaagctgtatggccccctgaattgccacgtgaggaaagccacccaccgaagtgtgtttttggttgttacatgaacaagaagtcaacctgtgcatgtgcgagccacggtacatttgctggatctacttgtgatggcaggtggtccaattccacagtgacagaaccaggtcaagagcaagtatgctgcctcttgtgttgtaaagggatttatgcagcagatggcccagacagagacccgaaggtactccagaattccttttactcagaccaagtggcaaccccacccctgctgtacccagctgtgaaacccaggcttttttcagtccagaagaaccaccacaaatcatttctgaaaatgatatctgtagaataaataaataaatgcctcaagtgataata

SEQ ID NO: 257222 - DNA, 1672 bp, Homo sapiens
tgaagagatcacactgtactgaaacctacattattttccaaaatctctggatctgcttctgtcttgcaggcagagagctcatccagtagcccttagctcttcccagccccctcctttgatttgtgggtgccactgcggcagtgctgagtctcagtggtttctagtcttcaccaagttctgcccacccagatggtttttacctgtcctcaccagaaacctgcactgtctagattgctgaggctgcttctccttaaccgatctgctatctgtattccaggggcaccccagggttagaggtaaatggcacaggccttgaaatctccaactgctctgactccaggttggtgcacttcaatgccaagtactaaccacacaattacaggatgccaccaaaaccttgatatggggctgctgcatcctaattaaaaaaaaagttaatagacattattttttagaacagttctaggtttacagaaaacttgagtggataatacagagagttctcctaggctcccctgtcctccagcacacaattttccctactagtatgttgtattagtgtggtccattcattacaattgatgaaccactgttgatacgtcattatcaactaaagtccatagtttacattagagttcattctttgagtttcacggattatgggttttggcaattacataatgtcctaaatccccaatacagcgtcatgcgaaagagtttcactgctgaaaattccctgtgcttcaccatttcacgcgtcctcctctcctccacccctgacaaccactcaccattttactacttctatctttttgactttccaagaatgtcctagagttggagtggtacagtatgtgggtttccagactggcttctttctagcattatgtactttaagttccttcatgtcttttcatggcttgataacttgttttttaaaatcagtgaatcagatttccttgtatggctacaacagtttgtttattctttcgcttggtgaaagacatcttgggcacttccaagttttggcaatgatgaataaaattgctgtaagtatttctgtgcaggattgtgagtgaacttaagttttccaaagtgactgtacccttttgatttccactagcgatggaaagttctggttgctcctcatctttgacagcatttggtgtgttcacctttttgaattttagccattctaaacagcttatctgcccctactgtggaatgatgtgacagacatagaataacacttacagtgattctagttcaaaatgaggcaacatggaagggataaagaagtcactgaccccaaaatagtttggaaatggagctgggcaaaatccagcagaagtttccttaattaggatcgacagcctgggaccggcccgccgtcctgtgggtctttgcctctgggctgtctgctgggcatttcttggaaccattattatttatctttttttctcgcacttttttgggtatggcttctatcgcactccaaatgtttttgagattcatccttgttgttctgtgtgtcaccagtttgttcctttagccattccatggaatgagtgtatcacagtttattgatccattcttgtattgacagatacttgaatgttttcagttttttgtattatgaataaaactgctatgaacattcttgtataagtga

SEQ ID NO: 257223 - DNA, 1252 bp, Homo sapiens
ctacctcttcctaggcccacagccagtgcctttggagtactgaggcgcgcacagagtccttagcccggcgcagggcgcgcagcccaggctgagatccgctgcttctgtggaagtgagcatggttgggcagcgggtgctgcttctagtggccttccttctttctggggtcctgctctcagaggctgccaaaatcctgacaatatctacactgggtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaagtaagtgaaccctcagcattcagtttgggattcacatagagtccttgggtgcatagttggtggctgccacctgccagtgggatcctgaggttgaagtagggattggcaaaggaggcacctagggcacgttcttaaaggaagtgctgactttcagggtttggcaagtacagtgtcaggccttgcaggatcctgagatagagatctccttaaattggctcctctcttgccatgccctggtcttagaatcagtgggatgagccctttaattaaagttgctattttcattttaat

SEQ ID NO: 257224 - DNA, 1192 bp, Homo sapiens
agggggatacccaccatggtagaccagagccactggaaagaggcatgagtccacatatccataaaggcaaatatccaaatattggctgtctggacctacaggaatactaaagaaggcactgcagagacccacaactgagaaatactggctgtgtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaagtaagtgaaccctcagcattcagtttgggattcacatagagtccttgggtgcatagttggtggctgccacctgccagtgggatcctgaggttgaagtagggattggcaaaggaggcacctagggcacgttcttaaaggaagtgctgactttcagggtttggcaagtacagtgtcaggccttgcaggatcctgagatagagatctccttaaattggctcctctcttgccatgccctggtcttagaatcagtgggatgagccctttaattaaagttgctattttcattttaat

SEQ ID NO: 257225 - DNA, 1434 bp, Homo sapiens
ctacctcttcctaggcccacagccagtgcctttggagtactgaggcgcgcacagagtccttagcccggcgcagggcgcgcagcccaggctgagatccgctgcttctgtggaagtgagcatggttgggcagcgggtgctgcttctagtggccttccttctttctggggtcctgctctcagaggctgccaaaatcctgacaatatctacactgggtgagtgcttggccggagaattcccagacaggcgcgtcccggatccccgcactgccagggctccagcgaacggcgattgatcagagttatccaggcgattttccaggctgggcttgcggacctggctggaggagggagaagcccatctagccgtggggcagagaggggcctctattgctgaggtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaagtaagtgaaccctcagcattcagtttgggattcacatagagtccttgggtgcatagttggtggctgccacctgccagtgggatcctgaggttgaagtagggattggcaaaggaggcacctagggcacgttcttaaaggaagtgctgactttcagggtttggcaagtacagtgtcaggccttgcaggatcctgagatagagatctccttaaattggctcctctcttgccatgccctggtcttagaatcagtgggatgagccctttaattaaagttgctattttcattttaat

SEQ ID NO: 257226 - DNA, 374 bp, Homo sapiens
gggatttaaagcgttgaaagaaaaaaaacccatcaacctagaattctgtattcaccaaatgttatccttcaaaggtgaaggagatactggaaatacaataaaggtttttttgtttttttttttaagtgaaggagaagtaaagactttatcagacaatcaaaaattgagagaatttgtcaccagtagacctgcctcgcaagaagtgttaaattcttcagaaggaaagggaaattatgtaggtcagaaactcagatctacataaagaaaggaagagtgttagagaagaaataaatgaaggtaaaataaaaatttagctttctcatttttaactaataggtaaagttttttcagttaatagtgattacagcttatgg

SEQ ID NO: 257227 - DNA, 268 bp, Homo sapiens
gtggcaggcaccctgtagtcccagctactcgggaggctgaggcaggagaatggtgtgaacccaggaggcggagcttgcagtgagccgagattgcaccactgcactccagcctgggtgacagagcaagactccatctcaggaaaaaaaaaaaaaaaaaaaaaaaaaaaatttgttctcatgaacttcctggcttagccaaccacatccacccttccatgtgtaggttaatattcccaatctgccacctgctcctccttctatgtgattt

SEQ ID NO: 257228 - DNA, 219 bp, Homo sapiens
  misc_feature (1)..(1): n is a, c, g, or t
  misc_feature (10)..(10): n is a, c, g, or t
  misc_feature (160)..(160): n is a, c, g, or t
  misc_feature (188)..(188): n is a, c, g, or t
  misc_feature (215)..(215): n is a, c, g, or t
  misc_feature (219)..(219): n is a, c, g, or t
ncaagcagtncaagggcatcgtggactgcatcgtccgcatccccaaagatcagggcgtgctgtccttctggaggggcaacctggccaatgtcatccgctactcccccacgcaagccctcaatttcgccttcaaggataagtacaagcagatcttcctggngggcgtggacaagcacacgcagttctgnaggtactttgcgggcaacctggcctcnggcn

SEQ ID NO: 257229 - DNA, 532 bp, Homo sapiens
gacacacaaagccactgttcccatagcaaccctgccaagtgatgtcagaaaccagggttcggccttgaaggctacaacacaagtgcggtgttgaccagctagcaatgacgacaaccccgaagacagcgccgtgcctccagcaacagaaatcagcagtgcacgtgtgtgcacacactgtcttgttttatgcttaaaaattgtgaataatccatttttaagtgtgtgtattctctagaagcctgtgtttctcctgatgtgtgttttatgcttaaaaattgtaaataatccatttttaagtgtgtatattctttagaagcccgtgtttctcctgatgtgtcatatcacttggaaaatcagatttccttttgctttcatgaagacctattttctgaaattgaagatgaaatgattcatttgctcaaacccttaaaatgtcctgactttattccttagggaggttcatcatgttcagaggagaagagagtgaaggattgtttaataaagaccaatcatgtaaattttatgatataca

SEQ ID NO: 257230 - DNA, 385 bp, Homo sapiens
cataacaatccttaatgtgtacgcactgaacagcagatcatcaaagtacatgaagctaaatctgatagaactgcatagagaaatagataaattcactcttagagttggaggcattggcatccctctatcagaaatggacaggtttagcaagcagaaaatcagtaagggcataacatgatcaatcatgatcaaaaacttgattcagtcaactatatgtaactgacatctatggaccactttacccaacaacagcagatgacacattttctcacacacacatgaaacattcagcagaatagaccacattctgggctagaaaatgcacctcaacaaatttaaaagaatagaaatcatacaaagtatgttctcagactacaatggaatg

SEQ ID NO: 257231 - DNA, 312 bp, Homo sapiens
aggcaaaagtaggaaacttagcaggaagtagagctaaatggacagttatgacaattctgtccccctctgcctgccagttcctcccaagcacccactccagggaaacactggaaagcctgcagaatcacagcagtggtttttattttgaatgagattaattttgtcggtgtcatttacaaataattttttttaacttccaaaactttagctaaattgaaactgtggtctgatggctgttaacaaagattaaaaatcaaaagggtccatgtccagttttcaatgttgtatagattttataaacgctcagaatca

SEQ ID NO: 257232 - DNA, 503 bp, Homo sapiens
aacctgagtatatgtctatctgtatagcgttcctctccctgtctttcaggaacattattagtaggatgtgattaatttctcccaaggatcccagaattccagttttactagtaattctttgtggattgtaattagaacaagagtagcaggtactctgatggtttattctacctcatgggacctttggggctatggcagagtttatattttgttctgaatgttgtgggaaacctttagagggttttgtgcaagggaaaactctggttgctctgtacagtttggattgtaggaaggcaggagagaaagagagtagcctgattagtccgtagcaatatcctaggaaagaaatgatggtagcttggaatggaaatagaatgaaggtagtgagtagtagtcagattcacatatgttttataatagagttgacagaacttgctgatgggttagatataggttggtattggtgaaggaaatagagtctgagaaaagaaaaaggtttgggg

SEQ ID NO: 257233 - DNA, 336 bp, Homo sapiens
ccatagcatgaggtataatatttagatttgatttagaattaacttattttcccacacttaaacagaaaagtgtctcattatctgatattagtatctatgaataatgtgtaattaaattgacaatatttctcttatctttcatcacattatgaaatactcccatacatggattctaccaggttaaacttaactatgaaatattttttatttaagggaccaagctgattaaaggagagagagtgagagagagagagagagagagagagagagagagaaagaaagagagaaagaattgttcagaaaattattcagaaaaatgtcaacagggcctcagga

SEQ ID NO: 257234 - DNA, 248 bp, Homo sapiens
aaactggcttaggtattttgtgtagaactgtcccacactttactggacaattaacatctctggtctggtccctgcccaccaatcatcattaacatgtccagtgattagacaaccataaactcctcacctgtcttcaaatgcccctcctagtgatgggtactgctcaagttgagaaataccgggctaaccacattcccttccgactctcattactgtccctcagcttttaatacagaggattatactgt

SEQ ID NO: 257235 - DNA, 545 bp, Homo sapiens
aaaactgaaaccttacacattacaggattgttatcttgttagttggacaccgttaaatgaccaaagctattcatggtctcctgatgagaacccaagtaaagagtcttcccttagttaattcacaggatcctcccttactcaactggaccagcactttacagttgcataaaaccctggttttgagtttttcttgtccctcaatattcactaaggctgtcatgaaaattattatgcttattaaaataaaactccatggattgcttaatgaaagatacttaagaatttgccaggtttaagttttattgctatttagagaacaagattttctaaacctattgccctgtgactcttcaaaaccatcagccaggaattctttttggatacactgatatttctctatgttatccttagtacagcttagcttaccaaaggatagatggacaaaagagtcttaaaagttaagtcttggaacaatataaaatgcagtctgcaaacacttgggggtgcatcataccagtcaattacacataccaatacttttttag

SEQ ID NO: 257236 - DNA, 460 bp, Homo sapiens
ttcagttgcaaatatatatgtacttctgaaataagtgacattatttaaaatatttttttcaaaagttttagcttttattacatgtatcttatttacactgtttgcttgctaaaccatttctttatagagtagtctgtttcaaatttctagtatggtatggctcgtaaaaatttactgagtgatctatatcctaattgagaatatggaatgaaacatggaaataaggcaggggagagaccttctctaatgaaggatgggggggggaaatttcttttgagcagtgataaaaatagcaaacaagaacaaacatttgactattattgctgaaaggagtgattaataattaactaaaaggaaaagcatctgcttcttgagttctgtaaaagtccagattgaaggccaagaagtattaaatcacaatagcaatcaaaagacaagaaagaaaaatgaaaacatggtg

SEQ ID NO: 257237 - DNA, 339 bp, Homo sapiens
  misc_feature (2)..(3): n is a, c, g, or t
tnncagctttgctctaacttacttaaaaatgcaattcaggagtacactctcaatcatgtagcaagccagaaagaacattgagatctttattgaatattatgtgtatatagggaagttcctctaaagccaatgggtgctatgtaaacgccgattgttattatcacaacaatgatggtggtggtggtggtagtgagggtgatggaggtgatggtgggatagcagaagtgaggatagtggtggtttgccactttcagtagtggtatgaataagtccccagccaagccaggtggaagccagtctttcacatattgatggggatattgagtttacaacccccac

SEQ ID NO: 257238 - DNA, 494 bp, Homo sapiens
tctgtctactgtcaagtttacttcagaaattcctatcgtcaaactttcagacaatagaggaaaagttgaaaacattcctatggaggaaaaaaagcactagttatctctatttacaaacagaaaaactgagcgtagaaaaattaatatctgatctatgttgtcagtagaagggtaacttatttcccaattacatagtgattattaggtgccaggtataattcaaccctgtcaggttagcattatttttattcccattttaagataaggaagctgaggctcagagaagttaagtaactatctcaagtcacaggagtctggctccatagactgtcctgttcaccattcagtaaggctaggacacgaaagaaaatcctgacttgtggggttaatcctctttccattaaaggtaagtgcacattcagttatctcatgaataatcaaagccatatttacatttctgtccaatgtattcttgaaaaaaaaaaaacaatctc

SEQ ID NO: 257239 - DNA, 630 bp, Homo sapiens
gggaaagaattgtttccttttcttgacaatagaaaaagtctgaagacattctgtcagaccaactgcatgatgtgtgaggcccagtgtaaaatgaaaatacagagtctcttgttcaaaaattattaacaatctccagatggtgatagcagagcattgaaccaattgtggggctcttctgggtgcagggccatttgcaactgtagaagttaacatgcccatgaagctagtctggacatctttagagtgatgataaaaatgtacatgagtaactcacactttagtgcctggactcttaagctatttgaaaattagcaattgtcatcattgagtcatcagtataattactgttttctaggagccctctaccttcgcaattcccggtgctgtggagctgtcagagttttaacatctcaaccaagccacatggatactatttcctcagaaaagacaaaattgatccaagcagaagagtgaactcaccgaagaggactctctacccataactggggatgcctcagccactcacacttactccaagattagtgtcactgattatggaaagaattgacttcttcccctggtcttgctcatttttctagagcccaggacaataaatgtgttttacggcag

SEQ ID NO: 257240 - DNA, 397 bp, Homo sapiens
  misc_feature (395)..(397): n is a, c, g, or t
gggaaagaattgtttccttttcttgacaatagaaaaagtctgaagacattctgtcagaccaactgcatgatgtgtgaggcccagtgtaaaatgaaaatacagagtctcttgttcaaaaattattaacaatctccagatggtgatagcagagcattgaaccaattgtggggctcttctgggtgcagggccatttgcaactgtagaagttaacatgcccatgaagctagtctggacatctttagagtgatgataaaaatgtacatgagtaactcacactttagtgcctggactcttaagctatttgaaaattagcaattgtcatcattggggccaccggaaaattactttttttttgtaagccctttccctcccggccaccccttaaaaaaaaaaannn

SEQ ID NO: 257241 - DNA, 360 bp, Homo sapiens
ctgagagtatttgggactgatagagaagctggtggtgggggtgttatttgcagagaaagcagctggcactaagtttacaggctaattagaaatggtcacgcctctaatcccagcactgtgagaggctgaggtgggcagatcacttgaggtcaggagttcaagaccagtctggtcaacatggcaaaaccccgtctctactaaaaatgcaaaaatcagctgggtgtagtggtgcgtgcctgtaatcccagctactgggagctgaggcgaaagaattgcttgaacctggaaggtggaggctgcagtgagccaagattgtgccacttcactccagcccgggcaacagagcaagactctgtgtca

SEQ ID NO: 257242 - DNA, 352 bp, Homo sapiens
gttgttctgagcctaaggggtctttgtgagatcttgcactacaaactgcagccaaggggatcccgaatgggcaagacttgatcctcatactggtgaaacctcctgagtccccagggaccctgtcagaccaggctccagcctccctgcggtctctgagagagaatgtggctagttctgccccacggctccctggcagtccagcggtcagaagtggccacgcagaacccaacattcagcctgggtgcagacactgcctctagcctcctccccaagcactctcctagtatggtaagagaataaactgaagtccctagaggccaagggtctcacctaagtggtcatatcctacagt

SEQ ID NO: 257243 - DNA, 1474 bp, Homo sapiens
cgagactccatctcaaaaacaaaacaaataaacgaacaaaaaaacccacaacgtattattttcttgtttacgaggtttcttgtctctctggctccaccagaagaggagcagggacccttcttgctgttgttcattgctgcatcccccacaccgagagcagagcctggcatgggcagaaagtcctcagtcgatatttggtggccccaagcgaatgaagcatccaagaagggaaagctgggggctccccactgcacttgccacctgagtcacattttcagaagcctctggaaagtcgtgcacagcccaggagtgttgagcaatttcggtttcctctgaggttgaaggacccaggcgtgtcagccctgctccagacaccttgggcatggaggagagtgtcgtacggccctcagtgtttgtggtggatggacagaccgacatcccattcacgaggctgggacgaagccaccggagacagtcgtgcagtgtggcccgggtgggtctgggtctcttgctgttgctgatgggggctgggctggccgtccaaggctggttcctcctgcagctgcactggcgtctaggagagatggtcacccgcctgcctgacggacctgcaggctcctgggagcagctgatacaagagcgaaggtctcacgaggtcaacccagcagcgcatctcacaggggccaactccagcttgaccggcagcggggggccgctgttatgggagactcagctgggcctggccttcctgaggggcctcagctaccacgatggggcccttgtggtcaccaaagctggctactactacatctactccaaggtgcagctgggcggtgtgggctgcccgctgggcctggccagcaccatcacccacggcctctacaagcgcacaccccgctaccccgaggagctggagctgttggtcagccagcagtcaccctgcggacgggccaccagcagctcccgggtctggtgggacagcagcttcctgggtggtgtggtacacctggaggctggggaggaggtggtcgtccgtgtgctggatgaacgcctggttcgactgcgtgatggtacccggtcttacttcggggctttcatggtgtgaaggaaggagcgtggtgcattggacatgggtctgacacgtggagaactcagagggtgcctcaggggaaagaaaactcacgaagcagaggctgggcgtggtggctctcgcctgtaatcccagcactttgggaggccaaggcaggcggatcacctgaggtcaggagttcgagaccagcctggctaacatggcaaaaccccatctctactaaaaatacaaaaattagccggacgtggtggtgcctgcctgtaatccagctactcaggaggctgaggcaggataattttgcttaaacccgggaggcggaggttgcagtgagccgagatcacaccactgcactccaacctgggaaacgcagtgagactgtgcctc

SEQ ID NO: 257244 - DNA, 184 bp, Homo sapiens
acttacacattattttggaaaaacagaattctcttatgatatgtcgtataactatatacaaatgtaccttatgattgttctgccttcacatcaatatttattggactagacctggaaatggtggtctgggagaactaagaaacaaatattattccacctgtggaaccacgaaggagttttgaag

SEQ ID NO: 257245 - DNA, 451 bp, Homo sapiens
aacagttaactttcccccaaagttaggaaataaaatttaaaaagtttaatttctataatactttaaaatgcattctatggcttggagtgattcacctaactgtcctgaattcacatttttaaaaagagaactgcttgggcaagtcacttcaccttttggggatttcaattcttcacctgaaaaatgaaggggtttgaagtagatgatctctgaagttccttttatcttcaagtctctataaatctgtgactctaaaatatgtgccttgcaggaatcctgcaagaattaatgcttttaaaataatttaagactcaaagatgaaaggttttatactagtgccaaaaactatttttatcaagcgaagcatgccagggaagtctgttgtgcctggggatagctgctgtcagtggcatccccagcactgcctgtgcccaacacagccccagatagt

SEQ ID NO: 257246 - DNA, 410 bp, Homo sapiens
catttcgctaacctccactgagccccaagctctgaagatcaaagtcaaagcacgaaatgaacgtgagagagctggaaagctaactacaaagcctctaaaagttacgtaacatgaagaaacacactcgattctgcctctcccattgaatagagcaataaaacatggacacaacacacaaagcagctatttgaggactctgagaaggaaatggcagcacacagattgggggagaagaccagaatttgaaatgctgctgaaccacagtagagtgatacaagatgtgaccgttgaagaatgctgggtgaaaggcgactgccttcatggaacccgtatggactccgtgtatattttttgggtaatttcctatgactcagtaattatttcaaaataaaaatgtttaaaaagtgaaa

SEQ ID NO: 257247 - DNA, 511 bp, Homo sapiens
ccttccccaaatgcccttttctaattctccagagcataaaatgctaattgtgaatattaaatttatgtgggtggcacatatcctgtttaacataattttattatttaattatttcttgagacagagtcttgctttgttgcccaggctggagcacggtaggcagtcataactcactgcagcctcaagctcctggaccatgcaaccctcccatctcagccttgtgagtagctaggaccacaggcatgagccaccacaccgagccttaaaatatgttttttaaataagcagaaccatgttttttcagagtagcatgcacaaagacaaagagacaattttagatgtcacacacagtaagtcaagctaatgattcagatagcctgttgtagtctcacctttccaatattataaatgatagtctgatccagaatttctcttttattcccaggcaaaaattaacttattcattttttattcaacaaatattttggggctaatatttattcaacagatg

SEQ ID NO: 257248 - DNA, 570 bp, Homo sapiens
tttcttaatttgggtatctattatgaataccttcacttaagtatttatgaatttagatatgaaaggtaaaactaaccactatccaaattaatatacagttcatttccagaaccctagtttcttccatgtgctcactcgcattcagtattacaacccccaaagataaacaccttactgactgccttctccataaatttgcctgttcttgaacgttatatacgtatacttttttgtatctgttttctttcagtgaagattatgtctgtattatttactcatgttgggtgtagttgtttttttcatcgtcgtataatactccattgtgtgaatgtataaagtatatcctttattatttattgtagataagcctttgggttttcagttttttactaacgggaacattcttgtgcatgtcttagtagacttaggcactcattgctgttgtgtgtgcataaagatataaaggtatttgagtttattttatttgatttctagtgaggttgaacatgtcttgtactcaataactgttcagatttcattaaagtcttttggtaatcttaatattttctg

SEQ ID NO: 257249 - DNA, 441 bp, Homo sapiens
aagacaggcatagaaaatcacaagggtattgattggggaagtgataagtgtccatgaaatcttcacaatttatgttcagagattgccgtaaagacaggcataagaaattataaaagtattaatttggggaactaataaatgtccatgaaatcttcacaatccacgttcttctgccatgggttcagccagtccctctgtttggggttcctgacttcctgcaacatttattcttaaatttttttgcagaatacattttttttcattaagagctttgaattttaatttggctcttgtatgaacttcctaggaggtcttaagaaaatcattacatctttttttgctggtttcctaatcttaaagttgatgatagtgttattgtttcaggaccagcaagacagaacgtaacttttatagagcactggaaacatgaagctaaaaata

SEQ ID NO: 257250 - DNA, 726 bp, Homo sapiens
gttttattgtgaccggaagataatgagcctagtgtcacgccaaggctgacgctaggtgacgtatatcacatgcaaaggattgaggatggccatgatgtcagactccacctcccgtcgtcaaccagctatgggagcacagagctcacggggacactccacttgtctgcccgcacatgtctgggtctttgtccaggtaacccaaatgctgctaagtggacgggcaatgcagggaagagcagtccttggagtcacagtctcggcttccaaccccaggattaccacttcctttctagaccggtggcggtggaaaaacctctccacgcctcggttctccttgctggcaaaatgggtgtgtgagtgcctaccttgtggggtggttgtggaggcagagggagcggagtatggagctggaatgttcaggcttcagcagctcagtgtacaatgtggtccgctgcttaatgcctctaatgtcccctgagggcagagatggggccctcagtcttccctgttcttgtggctattctgaagtccccagtgaggcctgagcttcccctccactttgtccaggctgcttcctgtgactctcattcttttgatgtggttttggtgtcttccttccagcctgctggccatcttttcactgaactcctctctccgtccagaaggaaatttttccccattatgaccagttctggtttggaggtgggcagaacccacagtggcagc

SEQ ID NO: 257251 - DNA, 415 bp, Homo sapiens
gatgcttgcaaaaccattcaaaacactgtgtgaaacatccatgattcttccctccaaactaaagtatctccctgccttcttatgcttctttgttctttgaatctcagaaattgtggcaataatttcttaagcaaacagccgaataattgcacagggacaacctctcatgctgaacatgcaagataacaagcaagaatcagtagagaaaagaaacacaggaacgtcaaccacaaagatgtgtttgccacaaattattctggtgaacttctatgggaggaagatgtgtcagtgaaggcccagaaatgtggctccaccacccatcactgacaaagcccaagcatggaggagccctagcctcagtactgtgtacaggtagggctgagagaagggggcgataggccggactttcctttgg

SEQ ID NO: 257252 - DNA, 342 bp, Homo sapiens
caactcaccccagccaactaatttattttctgtctctatagatttgcaatgcccactttatttttaacatttcccccactgatcatcttgacaactgtatcagtcctatccccctacttcttttactggcctagcacagttcaagctgggaatataaacgagaataagagaaagatcatgattaggtgtcaacagctcttaacccgaggtctatttaatggctttagggtgttcatgacagtactttatactccgtgtaaaatatacatggacatatggtcacttctgggaagaggagtccatgcattaaacaaacagattctcctggggggtatgtgatcc

SEQ ID NO: 257253 - DNA, 358 bp, Homo sapiens
ggacgggatggctccaagctcttgttctcctaacatctggacaggcgctctttgaagtgtatgaatatatttttaaaagattgggcagtaagcttgtcttccccgtgctttctcgaaagcttactgagctcgtggccctgagcgcgggccggcatagatttcctcttccacccgctgcggcttttctgagcacctggaagcatcggggtgtgaagtcaaaccagacgtgggtgaggagagtgtggcttgccttccctgccgggcagaatttcctgaaactgggctaattctttgtagaaatgtgaacgctgaatttattaaaaaataataataaaacacaggaaacaacttacatgta

SEQ ID NO: 257254 - DNA, 779 bp, Homo sapiens
cccagccctagtttgctaatattttacttaggatcttctatactcactactgaggttggccattaatttccccttcttaccctgtccttgtcctgtcttgataccaaagttagaatgagctgaagagcttgtcctctcttttctctggaacaggtatgtaataatagggatacttgtccttgaaagttgttagaagttgcttataagccatctagacatggtgccatggtgggttttgttgtgaccggggttattttgatttggttatgttttggtatgtttttaacagtctttacaattgattgggtgtgagggacaatggaaagatcatcccactcttccccaacagttggtgattctctggtcattttaacagcaagagaggaaacagtaattttaccagcaatatgaatgtgaagaagtagttttctgaaagcagatgatgaaaatggggtggggaacctaatcaggttctgcaggtgcctgcagtaattcagcgtatgagatggatatgagaaattcttagaagaatctaaaatccttattaaacctgaaggttgaattcatctccaatactgagctgctaatatagagcagtagggaatcactgtagattaacccctttagtttcttgctggctgaagaaaggtctaatgactcggaagcctttgaaaaccaaagcatacatccttctggaatttccttttctgctgaaagaaatactagcagtggcatgtgtgtggtccagcctgggtgacagagcaagacactgtctccag

SEQ ID NO: 257255 - DNA, 439 bp, Homo sapiens
cagaagacgtaaacaatccaaggaaaaataagccatcctgatactatagaactaatcagaaatcttttgcacaatccgagttttcaatatctttttctatttttatactacaaagggcctcaaaaactctagttataaaaaaatatagggctgggccaggcatggtgcctgatgcctgcaatcccagcactttgggagaccaagacaggtggatcacctgaggtccggaattcgagaccagcctgaccaacatggcaaaaccccgtctctactaaaaatacaaaaattagctgggtgtggtggtgggcacctgtaatcccaggtactggggaggctgaggcagaagaatcacttgaacccgggaggcggagattgcagtgagccaagattgtgccatcactccagcctggcaacagagcgagactccatgtcaaaaaaa

SEQ ID NO: 257256 - DNA, 529 bp, Homo sapiens
ttcatttaaaaaaagttgtatgaaattaatataaaggcattccaacttatttacttgtttcagatacaatctctttattccatgtctgcacgccctccagctcacaccgtggggcctctaaccttccaccatggtcctcccctggactctctgtgtgtgcagatcctcttctggagcagaactgggttgtcacaggcctggagcgtgtgtttggaaggttctgactttgctgtcttgggaatcagttgccaacaagggtgaccaagctcctcagctagagacaggccatgtccagaggccctgcaggaggacataccccctagagggagaggcaagggtaggagagccagcctcccgcccctagagggagaggcaagggtaggagagccagcctcccgctgacagtgagcaccaaggcctggatgcaggatgcctgcctggagaacatccggcccagcccagcccggctgcccgctgaacccagcctccttgtgaatggtgtgtatagcggaactgtccaggccaacgc

SEQ ID NO: 257257 - DNA, 704 bp, Homo sapiens
aacaaagccaaaattcaaaccagtctgtctccccagcagtggtacttagctctgtctgtgaatcagaatcactgacgaactatataaacaatgatgcctgggtcctagccccagagattctgatgccattggtctcgtatatcccgatttgctaaagctccccagctgtatcagtaatctgttgctgcaaaatgaattaccacagacttaatggattaaaataatggcagatctactatccaacagtttttgtgggctaggaatctgagcacagcctaatagagtcctctgcacaaggctgtgattcaattgtcagccagggctgtggtctcatcagagatttcgtagtgaaacgatctttgtttaagctccctcagggactaagttctccatttccttcatggccatcagcactctttactcctggaagctgcccacagttcccttaagaaggagtcttatacaacacaatgtaatcatagaagtgattcatgtcaacttcaccataaaatgtaacctaactaagggagtgacatctcaatgccttttccatattccactgggcatgactcattaggggtcaccttagagtgtatttgtcgcacaggtgattttaatgcaccatcaagattgagaatcacagctctaaagcattttgctctatttcttttccactagaaatagtgcaaatttgaaattcatag

SEQ ID NO: 257258 - DNA, 597 bp, Homo sapiens
tatctgagtaagagatgagagtaattcctatttatacagattgtttgtcatgtgtgaaataaggctcaaaaatatcttttattccaagtttttgtcttgcttgatacttgtttttataatgtagttatcaacagtctgcggctgccaatccattatggttactacaaaatagttagaatgtaattctggtctcatctatggaacaatcagattaatcttttctctgggtaattgttgagctgtagatggcattgccacatggttcatctgatttggtggttaaagggcctgaattaactgactgccaaacaatttgtctggcatttcaaccattctaatgacagggtgggattaactatggggcaatccacttgattgactgaaaatccagttagaacatgaagaaaattgcattttttggtgatttggtgtcataaagttacacgttactccattcatagtttacacttgtctgaagtggcattcctgcttagctatagttatttctaggagtaactaacagtgaatgttctttcattttgtggtaaatagaaaaaagagtggctatcttttctgttgactcagtgttaaaaattc

SEQ ID NO: 257259 - DNA, 1039 bp, Homo sapiens
agttccacctcttccacgaagccctccttgattgctgggccctggttgaactccttattagtaacacccaggttagtcctacttaattcttacctgcagccaaagtggacttagcatctccttgcatgcctggtaaagtcaagggttttcagccagggcctgtgtataaagcagaagcagcacagagtctggtttgaagcttagtgcttgggttcagacagttgtgggttacaatcccttctacacatgttctctgtggaaaccatttggttctctgtgcttggaactcgcctgcaacgggacaaagccatctcacctagactgttgttatgaagattgaattaggtgattctgagaggcatttatgcgtcctccctgagtaacaatccatgaaaagtgggcgtcattgctgaagctcaaggaagaaatatgaaatttgattatatccttattcacggcattgggtcaccaactcagcactttttatgaaagtagcatctgacctggcaaaggctgtgtcatcttattacctcagaaagacaaatttacggggtcagacgatggatggcttgtagatttctcaatgggctggaaggaaggagagaaaaagagagacaggagagagtacacatttaattctgcttcccctagggtgatatttccttcctccccttccagggttctcaaaaaggcattctaggaagtcctgtaaaatacatgctcataaaaatctcataatttccacaaattgttgagaatttaaaactcggttgggagtttgctgtttcagcctgagacaccggggtcacgtttcagtgcctgcagtcttgagacagtaccaggcatctgggatgaagctgaggaaagaagatgtgggggccctgctggcctgctccttctctcgaaagacgcttaccggctgctggtgtgtcacagggctttaggatttggaaaaacagagggatttaaaagaagatagaatggtcagaatttcgagaactgtgtgctgaagtgccatctttagggtgctcataacacg

SEQ ID NO: 257260 - DNA, 249 bp, Homo sapiens
atgaccctcctcctgcacaaattggagttcctgcagctggaaagaaatcggctcatgccatgttttatgatgcctcgcctgggccaggcggggccagtacagcctgatgtgctcacagctggcctggctgcccccgaaaccacagtgactgtccttgcttgcccgccctggccccgggcctccacgtccaggctggagaaacttggctcccctgcagctttcaaaataaagtggtttttatttcataaa

SEQ ID NO: 257261 - DNA, 753 bp, Homo sapiens
tttctgtatccaaaaagatatttattgtgcttattaaatatgtttggtctgtcttttccagcaactctacttccagtagtggatgctgtgcagcctactgtgtttcggtgggcattggactcttaagataggcagctgctccagtgcacgtgtgtgcattccctgggcttagcagctcctggtcaccctgtctgcactagcaaggctcccagtgagtcaacgaggagggtggccccagagcagagggccccaggcacgaagcacctcactcactctctcctgcatcctgccaccccacaagccactcctgcaggcgggcctgccggtgaaagccctggaggagatcacagtggaagaggcccatttccctggatagcaactgtcccacccaggggggtttcaggaggaggatggagggcacacaacaccggtggcttgtggggccctcacactggctgacacagccaccttgcaatcctgacacctgagcgggaccaggcagcatttgtcacgaggtgtgggaggcaagcaacaagagcagagtgtgaacagccttcttaagtctggctcctggctgccccatcctccattcccagctacagccgcccagggtaacttcagtttctccaagattttctcactgattttggttagtttctgaaatgcacactgccttctcgcctccacagctcacccagggtcgattttggagagggagccagtagcccgtgcagcacaacacatggaggcctg

SEQ ID NO: 257262 - DNA, 1043 bp, Homo sapiens
tgatataattcctgttgctgtagaaagactttctacagtcactaatatatcaagttatgttcactagaaaaaaagtttacttagtttatagaaatgggctgaaaaatcctaattacttatctgtgaggttattttcatgaaggttaatcatccagaaactattagagagcctcggaatatatttcttctaatctgctctacctatcccattcaaaggagggaatctgaagatttaaggacaaagagcagttgaaaactcagagctgtggttaatgggagaatttcaaggatggtgaaaaaaactaacatcattgcatccctgttttttgtattctggactttttagtttagctcttggtaaactacatcagaaattctttatgctaactctaacacacattttggggtattgctaatttaatctttgaatactgtttttgctgtttcatgattatatgttatgtcctaccagctagattgccaactcttgactactgactggaagtttattgtttattcagcaaataatgaattaagtcagtgaagtgagagatttcgtgtgtaaggattgttaacttgaacatttcaccagttacacacagttcagccctacttaaattttaaaaatcattgttggcacttgacattgttatgaggagttttgtattttcaacttgtattttgagagtgtcctcatgtgactgaagtatgtgctactcttcttaattgaataaccccagaatctccagaattgataattggaggaaattctactgttggaaagaagggatggattatacagccctgttttttgaccgttcattttgtccttggagtcactaccacttggcctcaaagtgtgaacatgtaaccctttccttaatactttgctacacagctgagcagaaactgtaaatttggatcctttgtcagtacaacttaaaatggaacaatttcaatggcttagggtaagataagtatgtaaagatacttttgtaatagaagaaaaaacattggatattaaaatcacacagtagtaaatg

SEQ ID NO: 257263 - DNA, 596 bp, Homo sapiens
gaacataaatatggcaaatacaggtgtgagcacagagccagggctatgcagtgccttccagttcctaaagaggaaaaaagctaggtgaacagaagtgaagggggttgagacagagacactcttggctgggtactaatgaaacatttggaggtttctttttttgatatttatattcttactgcttagatgctgagaataaatggcatgtcctgataagggataaagtactggcgtacatcaagaaaagctgctttagctgcaatacagagaacagaatggaggtagcaagcatgtgagcgggaagatccatcaaaggccattacaaccgtgcaggccagaactggagacttccagaagagaaaggattcatgctggatatagatgcctggagttcagaggtgagatctggggcgagtcatccatgaacaggtattatttgaagccaccaggatggattaggccaaccacagactgagtggagcttgaagataaattttaaaggaagcaaccaaatgtatctttagcatctctcttaaaatcataaaaccttaagctttatggacatgtcacaaatcaaataaatcattttcctgaaa

SEQ ID NO: 257264 - DNA, 320 bp, Homo sapiens
tacttggaaaggcactctgctctaaccacagcctgctaatgagtaacattcagtgcagtgttctagaattagccagtcgtcatccaaagctctgagttccatcctgcaaaaagggatgagacacaagaacctccaaatagacagctgtcaacctatctccaaggtctcaagtctagctttgtttctacttggatatttattttgtctctcccctaaaaacctgcctttgccctcaaacaatatggtttggctttgttcacctctgaactgggtcctgataccacagtcttactgtactaataaacttgtcaaaaactgac

SEQ ID NO: 257265 - DNA, 454 bp, Homo sapiens
taggctgggcacatcgattttgaaagcttgctagatttgtgttgtgtaccctccagtaaccaaaattatgtgagatatattactacatgggatggaaaatgtgttcagatttggcctttctaaaataaggaaaataagaaagaaaagtgctatgggagtattttctcctcctcctccttccctctcaaataagcatttctcaccagccaacatccctcttgcatcactgaatcataagatcccagggcagcgctttttctgaggggccaagtgaaacatcacaggtggaaacgtaccaagcaggtgcaaatgttatgacccaaaactgctactgagcagtgggagagagtttctctgttgttccagaaaagtttgagcagctaataatttgcttaatgtttgcaattgtttaggtatctttttatagtaaaaataaatccataaaatgttgcat

SEQ ID NO: 257266 - DNA, 433 bp, Homo sapiens
ttcagtgccaagatacagcttcaaagttaggatagtcgtatttctctgatttcccttttgctgcaagatatgtactgtaatgtggatttagcagctcattgacaggatgtcacctatcatttacccccacatgaaacttggaaacagaagtggttttatatatgtatatatttccatagttctatcctttttttttttttgtcccatccacctctgctgttttctttattgtaattcaattcttggttaggtttcagggattgttctcaagttttcttgttctttgtgctgtgcctcagggcagaatgtattgtcataagcaagataattgcagcattattagtttattcctcaccctaataaatacatatgttcagttagtcaaggaaagaagcatttgtatctgccaatgcttcatgtctttgataaaaaa

SEQ ID NO: 257267 - DNA, 443 bp, Homo sapiens
gaactggaaaggttgagtagcctgaattctaattctgaaatgtaatcccccctgggctagtaattcatcttcttgattttcttatttatgtagtagaaattatagtacttaccacacatgggctattggaaaattaattatctaatataatcttttgaagagaaaagtgacatttaagtacctgagtaatattagtaaatatttttcatttctaagaaaagataaacaggtgatctttacattagcaaaatggttatttgtagttacacaaaagcatatattggtgttaagagctaaaatataggttgtctatgtttgtaaggaaaagttgaagacaaaactgttgaaaggatgtgttatccagatagtaagcgtttatatttttcaggataatctacagagtgttttggttaatgaataaattacagttttatgtgtaagaa

SEQ ID NO: 257268 - DNA, 1030 bp, Homo sapiens
aagatacacaaatagtgaaatataaacccaagtgttaaatatgctctaagaaaagtaaaatgtggccaggcacacaggctcacacctgtaatcccagcaccttgggagactgaagcgggaggatcacttgagctcctgacctcaagtgatccacctgccttggcctcccaaagtgccagaattacaggcatcagccactgtggctggcaccccacctcccattttattttttctttagcagagacgaggtcttgctatgttgctcaggctggtcttaaactcctgagttctcccacctcagcctccaaaagtgctgggattacaggcgtcagctaccatgcctatccacattttgtttttttgttttggtttggtttgggtatgtcactttttgatattaggtgatccaaaataatttatcttggtatgcaagatgttcaaggaacaaacatctacaataaggtaccaaagttttgaattatttatctgtgtatatgtatgtatacccacacagaccattatgaggcattttagaaatcactttctcacatgcattccaatataatttcctgagagagaaaggagttccatgcagggagttatacataaaccacagcctacttttatggccattttgaattacttttgtatttcaaattcactttttaaaacttcacccatggggcgggaggattgcttgagcccaggagttcgggacagcagtgaggtatgatcatgccactgcactccagcatgggcaacaaagcaagacccccatctctaaaaaaatcaataaataaaggaaacttcacccatacccacagaagagaaaattgtgaatgagtgcatcaacatctacagtacacaaaaacagtagtctctgaacattgttagtagggtcctaacagttatgatagccaagtgaaaactctcaaaggaaagtgaaaatattccttatatcaataacatggagggaatctaccaattttatgtttttaacaataaattttatgccttttcaaaaaaaaaa

SEQ ID NO: 257269 - DNA, 1591 bp, Homo sapiens
ggatttctaactgcctcattttaatttagttacttccgaggccctttctccaaatgtagtcactttttgaggtactgggggttaggtcttcaacataagaatttgagggaaataaaactgagcccatagcagggtaataggaaaggctttaccaagttaaagctgggattggaaataccccatttctgtgattaaaaaatgtacctttgacatttctgaaatcagtatatttctgaccttcagggtacagtttaaaaaggcatactgccctggttttaccattagtggttgaaaggatggacagtacagacttctactgggaaagaggtcttagtgttagatgcatcagcttcttgggtcaggggcaagatttttctctaagttgcctatcggaattgaatctgccttgcctgagcctctcctttcagactttcttccctctccccagccatcagtgacctttcagtcttcatcccaggtcctctttcttcctctgcctcagagcctagttaattgcttctattcagtgaaattagagttcaagagtctgggactgggattccttctcagagaatgcaggagtagaaggcaaacacatctgacttcttgcttacgtcatagaacattacaggatgctgtggactgaattgtgtcccccacgaattcgtatgttgaaaccctaactcctagtgtgattgaatttggagtaagaaagtaattaaggttaaatgatgtcatatggcatgtgaaaacacagccagaagctggccatctgcatactaccaggaactgacttgccagcctccaggactgtgagaaaataaactgttgcttaagccatcagtctatggtgttttgttaaagcagtccaagctaactaacacacagaggtacgagtccctctgaaaattgtcagtgttccttcagttctctttgggtcaacttcagtctaagaataggtcttaggccagtcaagctgtacccctgacactgaggatggttccactaattcgccatcccctaattcaggagggggaaggatagatacgtgaacaaaattgagatccttttgagaaggaagaggaagggaatcagtgctgggcgcacatttagcaatgtccagatgcccatatgcgatatgaccatgatatgatcttaggtggcattaattgaatactatttagaaggagggaaatggcctttttctactcccagcagttgagaccaaacttgtagtaggcacaaggagaggcagcatagagggtagaggctaagcatgcagggccctggagattggctgcttgcattttaatactgtctttcacatcctagcattgtgactttgagcaggatacttctgtgtctcctcatctccaaaatggagaataataatagtaacctagctaatgggattactgaagattcaagtaatacaattgaaatgctttaaccagagcctggcacataaatactaaataaaaattggtgtttataattagtctgctctgggaaacattctttcaagaagcatacagactaagtgccacagatttagagaatgtgactgaagagggaaggggacaagccatgt

SEQ ID NO: 257270 - DNA, 1294 bp, Homo sapiens
ggatttctaactgcctcattttaatttagttacttccgaggccctttctccaaatgtagtcactttttgaggtactgggggttaggtcttcaacataagaatttgagggaaataaaactgagcccatagcagggtaataggaaaggctttaccaagttaaagctgggattggaaataccccatttctgtgattaaaaaatgtacctttgacatttctgaaatcagtatatttctgaccttcagggtacagtttaaaaaggcatactgccctggttttaccattagtggttgaaaggatggacagtacagacttctactgggaaagaggtcttagtgttagatgcatcagcttcttgggtcaggggcaagatttttctctaagttgcctatcggaattgaatctgccttgcctgagcctctcctttcagactttcttccctctccccagccatcagtgacctttcagtcttcatcccaggtcctctttcttcctctgcctcagagcctagttaattgcttctattcagtgaaattagagttcaagagtctgggactgggattccttctcagagaatgcaggagtagaaggcaaacacatctgacttcttgcttacgtcatagaacattacaggatgctgtggactgaattgtgtcccccacgaattcgtatgttgaaaccctaactcctagtgtgattgaatttggagtaagaaagtaattaaggttaaatgatgtcatatggcatgtgaaaacacagccagaagctggccatctgcatactaccaggaactgacttgccagcctccaggactgtgagaaaataaactgttgcttaagccatcagtctatggtgttttgttaaagcagtccaagctaactaacacacagaggtacgagtccctctgaaaattgtcagtgttccttcagttctctttgggtcaacttcagtctaagaataggtcttaggccagtcaagctgtacccctgacactgaggatggttccactaattcgccatcccctaattcaggagggggaaggatagatacgtgaacaaaattgagatccttttgagaaggaagaggaagggaatcagtgccacgctctgtttaaagcatttcaattgtattacttaaatcttcagtaatcccattagctagggtactattattattctccattttggagatgaggagacacacaagtttcctgctcaaagtcacaatgctaggatgtgaaagaccgtattaatatgcaagcagccaattcccagggccctgcatgcttaacctcta

SEQ ID NO: 257271 - DNA, 488 bp, Homo sapiens
gtgcacagacttagaagtaatgtaaaacactttgaattttacaacagtgattggtccattactgttggcagcttgggagttgtgagcatttcaacattctgagttgaaattcaacctgagaagcgaggtttctgggtgcaaacaatatatagtgcttgcccagaatacctgtttactcagtggagttgggttgttttctctacagaagacctaagagataaactaggtgtgaactggttttcttgccccagttggttccagaactgcctccagagttatttctaatatgtgaatctttgcctgtaagtgacttcttgttgtccacggtgtaaactccaaactatgtcatggcctacaagtcttctgggatgaaccatatgataggccttcctatatccatcccattcctctccctttgtgtagcagccacatggtttacaaagacaagccctccagcttcaaaggtagctcagattggtctaagccaa

SEQ ID NO: 257272 - DNA, 683 bp, Homo sapiens
agatcttcctgtggagatggggggaaatgtcattaggtgtggccattgggcttcagcctccacgcgcaccgcggttcaaaccgctttgctttgcactggggtattttgagttctgtgcatccccatctgttacatgcacagccaacaaaagaacactgtgcttgggcacacacttttttcccccttttaataattgtttttagagcttttagtcttggggcagattttgaagctgtgtgtgggagacagtcacagatgggacagtacagtttcctcacttaatgcttctgttccagcataaaaatatcagagggacttcagtttttgtttaactcaggatgaatttcctggctggatactatcctagaattttccgtataattaaaacattaaacagtttcatgccagtggaagaaatttgcctctgcgttggcatttcttcattgtgggtggttggaagcctgtttagaggcggggttctggaggtactggttgtcttttttagttgttcagcttgtgtgtggactggtgcccttattgctgaagagggggtggtacctggaaatggaggacaacctcacttcagctgcagggcagagacttggagtgctctcatccctttgggtgtttcccagtgcagtgatattgttttgaaaccgcgtgcggcgtggggatcacttttt

SEQ ID NO: 257273 - DNA, 611 bp, Homo sapiens
agatcttcctgtggagatggggggaaatgtcattaggtgtggccattgggcttcagcctccacgcgcaccgcggttcaaaccgctttgctttgcactggggtattttgagttctgtgcatccccatctgttacatgcacagccaacaaaagaacactgtgcttgggcacacacttttttcccccttttaataattgtttttagagcttttagtcttggggcagattttgaagctgtgtgtgggagacagtcacagatgggacagtacagtttcctcacttaatgcttctgttccagcataaaaatatcagagggacttcagtttttgtttaactcaggatgaatttcctggctggatactatcctagaattttccgtataattaaaacattaaacagtttcatgccagtggaagaaatttgcctctgcgttggcatttcttcattgtgggtggttggaagcctgtttagaggcggggttctggaggtactggttgtcttttttagttgttcagcttgtgtgtggactggtgcccactatgatgacaaacgggtcgcttgtgagcaactagaggccaacgattacgtaatcgacctcctaacacgagggaag

SEQ ID NO: 257274 - DNA, 796 bp, Homo sapiens
ttccattcttgtcttgcattacctttccaaaattcttctcaaaatatcaataacactctagttacattaataaagtagtgatagtagtatttttaagtggataattgccaggcactctcctaagtgctacatatgcattatctaatttggtgttcacagcaacattgctgaactatgtcccttactttaagattagccctccatctaaatggtctcaccacattttaaagattgcttggattaattgaattaccgaatatagtggaaaaggtcttaggcattagtgttagacgacacctagctttgaagccaaggtcaaccccttttttctttcattcaataaatgtttattgagcatctactattttccaactattgttctgagcactaggaatggcatcttttatctgcattttgaagggaagataatgtctgccttgaaggttgctaaagtctaagaaaaaggcacttaaaaaaaaaaggtttgcttccttgccctcctaactgatcttccttctctagtttttcattcctctgttgcaatctacagagtactcatagagctttcttttttctcttcaaactcttgctcaaaagccttagatggcttttctcatctgataggaaagtttcaagttcataggatgtcatagaggaacttttatagcctgctatttaaaaccatatatgggccaggcacggtggctcacgcctgtaatcccagcactttgggaggccacggagggtggatcacctgaggtcaggagttcaagacgagcctggccagcacggtaaa

SEQ ID NO: 257275 - DNA, 316 bp, Homo sapiens
acacacagaaccaacagctctttctgagatttgcttgatgaataacatatcctcctggcttccctttctaagacttatctatatttttaaacaagctaaagtgttatcagctgaggcagaatgtaaaatgaaattttgctgcacatacccagaaggacacaggcattgtaggaatacagttttactgtgggagagatttttacagcagatcaataacagaatactttatatggacacaacagaggattttagataacttttgactctagtttgttattcctacaattataccaacatatactttgtccttttacca

SEQ ID NO: 257276 - DNA, 482 bp, Homo sapiens
agatgacactgataccccaaaagtcattgtggcaccctgttagaaagggggcatgtgcgggccaggtagtaaatagagttctgaccaagatctactagtgagttcgcagtttctgcagacctaattggaattcatttactggcttgcaaatgtgtaactcggatatacatatagggacatatttgtggaccacccacactggtcagttgcctgtggtctaagatccatcataattggaaggggccagtgaagatgatgacaacaacgacgatgatgactacttcttctttcttcttcttcttcttcttcttcttcttcctcttcctcttcctcttcttccttcttcttcttcttcttcttcttcttcttcttcttcttcttcttcttctttcttcttctatcccttcaagcatttattctttgagttgcaaacaatacaattgcattccttaagttattttaaaatatacggttaagttata

SEQ ID NO: 257277 - DNA, 444 bp, Homo sapiens
caaaattcatgtgttagcaacttaagcctcaatcagcagaattgaagtgtgagacctttaagaggtgatgaggtcaggcgggctttgccctcctgaatggattgatgctgttatcttgggagggggttcctggtaaaaggatgagttcggcttccccttctctcacactctcttgcccctccaccttccgccatgggatgaggcagcaagaaggccctcgccagatgtgcccctcgatctttgacttctcagcctccagaactgtgagccaaataaaaagtttctgcttattgtaaattactataaaaaatatattttttaaaaaggccacacatggtggctcatgcctgtaatcccagcacttttggaggctgaggcggaaggattccttgagcccaggagttcaagactaacctgggcaacatagtgagaccttgtctctac

SEQ ID NO: 257278 - DNA, 428 bp, Homo sapiens
gagcgtcctcatttggaaggagagttagcatcatgctgtggctaaagaaactcagtttttatgcctaccaataatgtgaaaatcacctcactcctgtttggctgattgggttgaatttctcttaataccatactgaatgtaacttgacgagttagtagggaactggtaacaacttatttcacagagtatttctagttattgatgtagtttgggtgtttgtcccctccaaatctcatgtgaaaatttcatccccagtgtttgaggtggggcctactcggaggtgtttgggtcatggagacgaatccctcatgagtgacttggtgccatctcatggtaaagagttcaatgtgagatctggttgtgtaaaagagcctggcatctctctcttgctcttctttgtcttgcttcctctctcaccatgtgacact

SEQ ID NO: 257279 - DNA, 855 bp, Homo sapiens
ttgacaaggtcgggtcttaagaatagcctgtcgggggtacccgaagtggggcgcggttgccaaggccgggccggaagttccaacggtctttatattctcccgtgctagggccagcttgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctgagacgcggtctggcccatgctggtcttgaattcctggatgcaagctatcctcctgcctcagcctcccgaagtgctaggattacaggtgtgagccactatgcccagcttctacctccatttcttacacactagtctcaccttgccttctgtcatcacaggacaggtcttgttcttcaaag

SEQ ID NO: 257280 - DNA, 352 bp, Homo sapiens
tcttttgagacagtgtctcacttttgtaacccaggctggagagcagtggatctcttggctcactgcagcctcctgggctcaagcaatcctcccacctcagtctcctgaatagctggcactataggctcacactaccatgccagctaatttgtgtgtttttttttttttggtagagacgcggtctggcccatgctggtcttgaattcctggatgcaagctatcctcctgcctcagcctcccgaagtgctaggattacaggtgtgagccactatgcccagcttctacctccatttcttacacactagtctcaccttgccttctgtcatcacaggacaggtcttgttcttcaaag

SEQ ID NO: 257281 - DNA, 1013 bp, Homo sapiens
ttgacaaggtcgggtcttaagaatagcctgtcgggggtacccgaagtggggcgcggttgccaaggccgggccggaagttccaacggtctttatattctcccgtgctagggccagcttgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgatttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctgatgtcacgtgggttatgaagaagtctgaagaacgccttcatttcatgcaaatctataagctcctgcttttggctttaccatatgttgtgtctaatctccttctgagaaggacgaaaaactttcttccaagtgaagatccatttaagaacacatgtatttacatgcctataatatgctggttgtgtatgctttgtcttttaagttattaaaggaacgtctaaaaaatacattctccgtgcagtatttacaacctttgaaaaaggtcataatttaaatggtcaaactagaaccaggatttaatgtgaaaaattaaactgattctttattcacaaattta

SEQ ID NO: 257282 - DNA, 1553 bp, Homo sapiens
ttgacaaggtcgggtcttaagaatagcctgtcgggggtacccgaagtggggcgcggttgccaaggccgggccggaagttccaacggtctttatattctcccgtgctagggccagcttgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgagtgagtatgaaaacagtggcttcacattttatgttttcttggattaaactaatcagactcctgaagcttagttacatgtgcttttaaaaataatgcttgcgtaattgataatttagtgttaatcatttaaatgttaacttaggttgttggtgctatcgaataatactcagttcgagtaagtaaaaagtcagatcctgagcaatcagaggtgcaattttgttcattatgactgtattctacttcagtttcggttcaggaaaacccattctatagttcccattgactacctttgggtactcatacactgtattaaacatcagataattctaacattcattcagaactggaatgcccgctctatgctggattctgttagttgctgaggatacaatagtgaccaaaaatgcaatttccttatgcatcctttacctcttctgttctgcaaccaacatttgtatgagcccaaaattcccttgtaagatataaaaaaaagacttaagttcaatgtttcatttcactccgtttttatcctgttttcagtttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctgatgtcacgtgggttatgaagaagtctgaagaacgccttcatttcatgcaaatctataagctcctgcttttggctttaccatatgttgtgtctaatctccttctgagaaggacgaaaaactttcttccaagtgaagatccatttaagaacacatgtatttacatgcctataatatgctggttgtgtatgctttgtcttttaagttattaaaggaacgtctaaaaaatacattctccgtgcagtatttacaacctttgaaaaaggtcataatttaaatggtcaaactagaaccaggatttaatgtgaaaaattaaactgattctttattcacaaattta

SEQ ID NO: 257283 - DNA, 1396 bp, Homo sapiens
ttgacaaggtcgggtcttaagaatagcctgtcgggggtacccgaagtggggcgcggttgccaaggccgggccggaagttccaacggtctttatattctcccgtgctagggccagcttgcgcattcttacctgtcggggtgcggcgagtgtctcacctctctgcacttccaaggactcttgtcatctgccttaggcgggaaatgctgttgctggattgcaaccccgaggtggatggtctgaagcatttgctggagacaggggcctcggtcaacgcacccccggatccctgcaagcagtcgcctgtccacttagccgcaggaagcggccttgcttgctttcttctctggcagctgcaaacgggcgctgacctcaaccagcaggatgttttaggagaagctccactacacaaggcagcaaaagttggaagcctggagtgcctaagcctgcttgtagccagtgatgcccaaattgagtgagtatgaaaacagtggcttcacattttatgttttcttggattaaactaatcagactcctgaagcttagttacatgtgcttttaaaaataatgcttgcgtaattgataatttagtgttaatcatttaaatgttaacttaggttgttggtgctatcgaataatactcagttcgagtaagtaaaaagtcagatcctgagcaatcagaggtgcaattttgttcattatgactgtattctacttcagtttcggttcaggaaaacccattctatagttcccattgactacctttgggtactcatacactgtattaaacatcagataattctaacattcattcagaactggaatgcccgctctatgctggattctgttagttgctgaggatacaatagtgaccaaaaatgcaatttccttatgcatcctttacctcttctgttctgcaaccaacatttgtatgagcccaaaattcccttgtaagatataaaaaaaagacttaagttcaatgtttcatttcactccgtttttatcctgttttcagtttatgtaataagaacgggcaaacagctgaagatctcgcttggtcatgtggatttccagactgtgccaagtttcttacaacaattaaatgtatgcagacaataaaagcaagtgaacaccctgacaggaatgattgtgttgccgtgctcagacagaaacggagtctcggaagtgtagaaaataccagtgggaaaaggaagtgctggtaagtaactcagagctgctgcttttttcctcccgcagtgatctcttgtttgcatagcatttattattccatttaatactgacactcgtatttctagtagtattgtttcattctcattaacattttagtactggttatacttaccagagtctagagaccaaaaatgggactgcatggtgg

SEQ ID NO: 257284 - DNA, 412 bp, Homo sapiens
cattgcattgaacataaagcttactaacaaagtaatcttagtgaagggagagatgtgaaggattactttgttgacatcattaaaggaaagtgaagacatatcaagcttagatttcaatgtcatctttcatataagaatattagaacagcttcctattataattatctagtttatcattcatatattgcttctgcagctatttcttcatgaattattattctgttttacacgttagcttgtttctgtggaaaagacaatttttttttgtttaaaagtttacttcttaaacttcattgtaagaaaaacaaatttaagcccccccttgtttttgccattttattgttacacagaaaaatcccatttttcttaatcagtaggagcaaacactgaaagatgtttactatcttacata

SEQ ID NO: 257285 - DNA, 734 bp, Homo sapiens
gctgccccttccctatccccattcctttccatattcaatatttctctcctatatctgattctttaccccgtatcagggataaagggcttttcatttgactattttggaccctcatgctttctctctatctgtccccccggagctgctgtaagagttaaattcagcataaatggaagttctgactcctctggctacatgaggggaggcacctcctgcttcccagaggcttggctctctctgaggagggcagcaagtaaggagtgaggctgttgatcccagaaatcccagggttgatggtggaccctgtgggacactataatcagctggcagatcctggaccacaggttggagacccagcttcagatcagatcagccggtccaaggtgagaaaaatggagttcccgacctagaaagccaagttctctttgcgggtgtgcagtttgcagatgacagctcagcctggctgagtgctgtccccatgacgcccctcctgtcctttccaaagccttccttcctctgcaaggaaggctctgggaagcactcagccaggctgagctgccgtctgcctgcacacccgcaatggggacttgtctcaattgcaggtaacttcataggccccacgtcgcttcgagcgtccgcaccgatgatgggatttttcattccgtggcgccccagtggacatgctaccatgggatcccaattccattgggactaactcaattgggctggaggct

SEQ ID NO: 257286 - DNA, 883 bp, Homo sapiens
ccacatgctgatccccactacaatcagtgacctgaactcagagtccgagtaggacacgcaggtggacctggtgactgagatgacatcctctctaaagatttggggcatactcttggccctgctttgcatcctttgcaggctgtgtgtatacagtaacaacatttactggagagaattcataaaacttcattacttaagtccaagtcgagaattcaaagagtacaaatgtgatgtcctcatgagagaaaaagaggctctgaaaggcaagagctttcatatgttcatctatagcttatggttcaaaattcagcgtgcatgcatcaatgagaaggggagcgaccgatatagaaatgcatatgtatgggccccaggtgccctcaaagtactcgagtgtcactgggagaagtacaacaataggtacacagagagcagaagcttcagctacattgaattccattgtggcgtagatggatatgttgataacatagaagacctgaggattatagaacctatcagcaactagaaagtctatgcacatcctcagatattggtagagtattcagtgcttccaaagtggtgggccctgcctccatcaatagcccctgccactccccgcttacatttatgtgtcagtgttttccaactacttagagtttatgtacctcgtgatttcttgataccaaatctttgtgtggtttctgtatctgtaatacaattttgtcctaatttgcctaatttacacccacattttttccaagattcagctcatatggcatctgtcctcgactaacctaagactttcctgatattgactctctttatacctacccaagctgaatgaccctccttttcttaaataaaatatattattctaacgtaaaga

SEQ ID NO: 257287 - DNA, 474 bp, Homo sapiens
agtttgttcatctgtgaaatggagataaaaatagaacctccactgggaagtcttttgtaaaggataaaagacagtgcatgaaaagctcataggagacacgatgcatttgacttacgaaaaatgtgggcaccttcattacatttaaaggacaacatatggccgggcaaggtggctcacacctgtaatcccagcactttggaaggccaaggcagctggatcactggaggtcaggagttggagacaagcctggccaacgtggagaaccccgtctctactaaaaatacaaaaattagctgggcgtggtgatgggtgcctgtaatcacagctacttgggaggctgaggcaggagaaccgcttgaaccagggaggcagaggtcgcagtgagccaagatcacgccactgcactccatcctggtgacagagcgagactctgtctcaaagaaataaaaataaaaataaataaataaataaata

SEQ ID NO: 257288 - DNA, 384 bp, Homo sapiens
tctgtcattacatgaggctttttgcatgactgaaatacctgtaattactgtgtcatttttgtcatagttgacttaaaggtgtaactataataatcacgaactaaattcttggtgagcagctgtgtaaggccattttaacagctggggtaacccagctcagcctgtaagagttaagcttaatcatgagacaggttatgttaagtcattgaagacttcatactgggcatttctgaaatacttagaaaattcagtgggatagttggatttttgttttatcttaagtactttttaaaatgcttaatgaaaggatgaggaaaagtattttaacaactaaagttcttaggcacaaataatagaaataaaatccaaagtttactcattaaa

SEQ ID NO: 257289 - DNA, 327 bp, Homo sapiens
atgctgtatgccaccttttgaaaaaaggacaaataaataatatatacttgtattataaaaagaaacactggacggattcacagtaaacatgtttacctgtaaaagctagaaggtcaggggaaaactaggattgagaacaggataagatattcacaaatgtgcttttttgtacagctttaagttttgaatcgcatgactatgtgacctagtcaaactatttcagagtaaaaataaacagccagtagagtctctatcgccctaggagtggaggctgatcacagggtaatctaaggatgagatcataaaataaaacaaaccctccaagca

SEQ ID NO: 257290 - DNA, 457 bp, Homo sapiens
gaaataacttaataataatacaattcaataggaaatggcaatttaggagcaagcataagaaaaggggttgcaacaaaaaaagacaaacatctttgtttcaaccctttgagccatagatttctttctttcttttttaatttgtggaatagtagaattttttactttttatattataaaataattaaatggtagaacatttggtaatagatattcgtaggaaatctggaaaaacagataagagtaagaaaaaaagtgtgtaatctcttctaccatatatatattatatctccatggtttgctcttgctcccatttctagttgttgggcactcttctaatctgcagtgaaacttatggtggattaaatttgtgatgctctttggagtgtcaaaggacttccactaaatccctccttattcttattctttaccctctgtttctttgatcacccatagtgtg

SEQ ID NO: 257291 - DNA, 458 bp, Homo sapiens
ataagggacacaatacagtgatatactgccaagcaatgcaaagaaacagactactgatatatacccacagcataggtaaatctcaaaaacatgctgagtaagagaagctgtatgcaaaagagtacatactctatgttcccatttaggtgatactctagaatagtcaaaactaatctatgatggaaagaatatcagaccagcggttgcctctagagataattagggttgagattggctgggaagggcataaaaaaacccggagtaatgattctgttctctatcttaatagggatttgcgttccatagttgtatgcatttagcaaaagcttaattaatgtagacttaagatttgcacattttacttggtatggtggtacatgcctgtaatcccagctacttgggaggctgaggtaggatgattgcttgagtgctgggcaacatggcgaaatgcagtctta

SEQ ID NO: 257292 - DNA, 505 bp, Homo sapiens
atcttcacaaatgtaatttgtaatggctgcagaaaatttcagctctgaatgtactgcatcctaatcagtttcctattgttgagaattagtataatatccaggtgttttgtttttgttttgctattaataagtaaagctgagatgaatacttctgtatcaatcttgatccttattttagataatttccatttcattcctcccatttcttgcgtgcttcctatggtcaggtgctgtgctgtgtgctgagtatggaggaggtaggctgagatagacgtgacctttgctcttgcaaagctgatatcctaagggttggacagatgctaaatgtgcaaagaaacccaatacttgcagatggtgctgggtactaccaaggaaagaaatagggtatatgacagagtacctggaaagggcactggccaacttttatgggcagggaggtcaaagcaaacctgtctggagatgagacaggccaggaaaatcagggcaggggccagagtagggcaaa

SEQ ID NO: 257293 - DNA, 352 bp, Homo sapiens
atccccttaaggaagctcaaatgggaatttagagatgaaggatgaaatgaggcatcagactataatgggctatgctcagactttgattgagatcaatctgtggttataccccaattttaccacttgctagctgtctctccctggccaattaattgagcttctttgagcctcggtttcttcatgaataaaatgggattaataagacctaataggattaccatgagtagtaaagatgataaatgcacatgtacgtaatgtctaggaaatactcaaaatggaaatggaagctaatgttattaattaccattagcaacaatgcatacatgtgattatagtttggctctgtgtcccc

SEQ ID NO: 257294 - DNA, 280 bp, Homo sapiens
cttttcagtgaggcagctcaggctctggctgaaggtgggcgcaggacactacctgaagcttcaccccaagagatgagggccagctccactcttcccagtcaccgcctgtgggggagggaggctggacagggcatgaaggcagagcctggtggtctgcccctcccatctaggggtggcgcacagaaagggagactccaggccacagctcacttacaccccagaataaccttgccttgagggtgggatggcttgtctgccccaggcctgttggacatttagc

SEQ ID NO: 257295 - DNA, 451 bp, Homo sapiens
attcttatcccagttctttccttgacattcctcttccagtttgaggaaaacctctagacctctttatgtcatgcttcaaacctcagtaaagtagaacaccatctttactaattaattaatgattgcaaaaggcttggaaatttccaaaggctgaataattgccaagtgaagactattcagctttccactcgctttcatttatttttaattttttttagtcactgatggaaaacttaccctcatgtctgaaaacaattatactttattacattgagtgcttctggggagtttggcatttaacccattaaggaaaaagtttaaaagatgaaataaataaatctcccttatatttgagatgagctgctttagttttcctatatcaggatagtataaaaagaggaatatgatatagtaaaaaagaggagagacaggatggggaaaaggagaaagg

SEQ ID NO: 257296 - DNA, 352 bp, Homo sapiens
actcagctggcttaatgaaagacacgggtgtgggactttgtcagcagatgcaagcctggagccaccacacagcagagaggagtaggaaaccagagtatggaagccccttcctctcctgcaccaaatcactcacagcaccatgatgggcagcagtagaaggattagaaaccacaccgccctgataggagttgaacttttcttcaactggctcttaagctgacatgagattgcgctagttggaagataccaagatactcttaaaagagaagatgaagttctcatgtttcaacccctattactattgactgtcaacttcccaaaagaccccagaaaaacatgttactggaacaaa

SEQ ID NO: 257297 - DNA, 244 bp, Homo sapiens
aagagaaggtctcttttgtccgaggcaagcactcttgctgcacaatcatagctcattgcagcctcagaacaagtttggacttggttacaccaatttgcttctttaatctatcaatttacctttaactgccggcacatcaacgtagtgaaatatacctcatgtatttgcattgccattgtctcttctgtggagaggagggagcaggcagagatggttggtcatcaaaggggacttaagttttgcc

SEQ ID NO: 257298 - DNA, 394 bp, Homo sapiens
  misc_feature (348)..(348): n is a, c, g, or t
cagaatttagatgggcagaagcattttaggagattttcagattgagaaatggaggcatcgaggtcaaatcttttacctaaaccactgagcagcagagacagcttcctatcccatgtttcagtgctggagcagacccgtgtgtgtttgggagcaggggtagctggagctcttggaggcctcgcagagagatggccttgcccatgatgaagtcctctggtgactctgcaggactggcttcggtcttcaaattggatatttccactggcacataactaagcctcagtcaatggaactatacatccataagtctcagaaagcagaaggatggcttcctaaatgatttttccnttatgctatatgtgccaatagatatcactaatacaatcagtacaaa

SEQ ID NO: 257299 - DNA, 268 bp, Homo sapiens
attaagacagttaaactctcctgggttcctaggtgggagagaagtttaactgtctacaagtataaggggagaactggaaggcaaaagagggtagccttttggggcaaggtgtttctctttagagagactgtaattctcttgatccccacagggtggaggtaaacttggctggtttcctagttcagtgcatactaaacctctgaacttgcttgtgtgccactgaagagagggaagacacattgaggagaaatgcggagctgatacagac
